US012031129B2

(12) United States Patent
Rubens et al.

(10) Patent No.: US 12,031,129 B2
(45) Date of Patent: Jul. 9, 2024

(54) METHODS AND COMPOSITIONS FOR MODULATING A GENOME

(71) Applicant: Flagship Pioneering Innovations VI, LLC, Cambridge, MA (US)

(72) Inventors: Jacob Rosenblum Rubens, Cambridge, MA (US); Geoffrey A. von Maltzahn, Somerville, MA (US); Robert James Citorik, Somerville, MA (US); Barrett Ethan Steinberg, Somerville, MA (US); Donghui Li, Somerville, MA (US); William Edward Salomon, West Roxbury, MA (US)

(73) Assignee: Flagship Pioneering Innovations VI, LLC, Cambridge, MA (US)

( * ) Notice: Subject to any disclaimer, the term of this patent is extended or adjusted under 35 U.S.C. 154(b) by 797 days.

(21) Appl. No.: 16/706,448

(22) Filed: Dec. 6, 2019

(65) Prior Publication Data

US 2020/0109398 A1 Apr. 9, 2020

Related U.S. Application Data

(63) Continuation of application No. PCT/US2019/048607, filed on Aug. 28, 2019.

(60) Provisional application No. 62/864,924, filed on Jun. 21, 2019, provisional application No. 62/850,883, filed on May 21, 2019, provisional application No. 62/725,778, filed on Aug. 31, 2018, provisional application No. 62/723,886, filed on Aug. 28, 2018.

(51) Int. Cl.

| | |
|---|---|
| ***C12N 15/11*** | (2006.01) |
| ***C12N 9/22*** | (2006.01) |
| ***C12N 15/85*** | (2006.01) |
| ***C12N 15/90*** | (2006.01) |

(52) U.S. Cl.

CPC ................ *C12N 15/11* (2013.01); *C12N 9/22* (2013.01); *C12N 15/85* (2013.01); *C12N 15/907* (2013.01); *C12N 2310/20* (2017.05); *C12N 2800/00* (2013.01)

(58) Field of Classification Search

CPC .. C12N 2800/00; C12N 15/11; C12N 9/1276; C12N 9/22; C12N 15/85; C12N 15/907; C12N 2310/20; C12N 15/102

See application file for complete search history.

(56) References Cited

U.S. PATENT DOCUMENTS

| | | | |
|---|---|---|---|
| 6,693,086 | B1 | 2/2004 | Dow et al. |
| 8,889,418 | B2 | 11/2014 | Zhang et al. |
| 10,113,163 | B2 | 10/2018 | Liu et al. |
| 2003/0121063 | A1 | 6/2003 | Kazazian et al. |
| 2007/0037759 | A1 | 2/2007 | Deininger et al. |
| 2011/0045591 | A1 | 2/2011 | Schumann et al. |
| 2011/0059502 | A1 | 3/2011 | Chalasani |
| 2011/0171729 | A1 | 7/2011 | Wang et al. |
| 2014/0113375 | A1 | 4/2014 | Liu et al. |
| 2014/0273234 | A1 | 9/2014 | Zhang et al. |
| 2014/0315985 | A1 | 10/2014 | May et al. |
| 2014/0349400 | A1 | 11/2014 | Jakimo et al. |
| 2017/0275665 | A1 | 9/2017 | Silas et al. |
| 2018/0298391 | A1 | 10/2018 | Jakimo et al. |
| 2019/0055543 | A1 | 2/2019 | Tran et al. |
| 2019/0177735 | A1 | 6/2019 | Sederoff et al. |
| 2020/0248155 | A1 | 8/2020 | Halperin et al. |
| 2022/0396813 | A1 | 12/2022 | Feala et al. |
| 2023/0131847 | A1 | 4/2023 | Rubens et al. |
| 2023/0235358 | A1 | 7/2023 | Citorik et al. |
| 2023/0242899 | A1 | 8/2023 | Steinberg et al. |
| 2023/0272430 | A1 | 8/2023 | Bothmer et al. |
| 2023/0332184 | A1 | 10/2023 | Rubens et al. |

FOREIGN PATENT DOCUMENTS

| | | | |
|---|---|---|---|
| EP | 1700914 | A1 | 9/2006 |
| EP | 3448990 | B1 | 6/2021 |
| WO | 2003064644 | A1 | 8/2003 |
| WO | 2005049789 | A2 | 6/2005 |
| WO | 2008072540 | A1 | 6/2008 |
| WO | 2011064750 | A1 | 6/2011 |
| WO | 2014093718 | A1 | 6/2014 |
| WO | 2014150624 | A1 | 9/2014 |
| WO | 2015035139 | A2 | 3/2015 |
| WO | 2015191693 | A2 | 12/2015 |
| WO | 2016028843 | A2 | 2/2016 |
| WO | 2016036754 | A1 | 3/2016 |
| WO | 2016065364 | A1 | 4/2016 |
| WO | 2016201047 | A1 | 12/2016 |

(Continued)

OTHER PUBLICATIONS

Ade et al., Evaluating different DNA binding domains to modulate L1 ORF2p-driven site-specific retrotransposition events in human cells. Gene, 2018, vol. 642: 188-198. (Year: 2018).*

Fujiwara H., Site-specific non-LTR retrotransposons. ASMscience.org/MicrobiolSpectrum, 2015, pp. 1-16. (Year: 2015).*

Galantou RN., Cellular factors controlling human L1 retrotransposition. Ph.D. Dissertation, 2017, Universite Cote D'Azur, France, pp. 1-175. (Year: 2017).*

Govindraju A., Protein/Nucleic-Acid Structure and Sequence Requirements for Specifying Second-Strand Cleavage and Second-Strand Synthesis During the Integration of the Site-Specific Line R2Bm. Ph.D. Dissertation, The Univ. Texas, Arlington, 2017, pp. 1-101. (Year: 2017).*

(Continued)

*Primary Examiner* — Ganapathirama Raghu

(74) *Attorney, Agent, or Firm* — K&L Gates LLP

(57) ABSTRACT

Methods and compositions for modulating a target genome are disclosed. The composition may comprise a first RNA encoding a polypeptide comprising a retrotransposase reverse transcriptase domain and a retrotransposase endonuclease domain. The composition may also comprise a second RNA comprising a sequence that binds the polypeptide and a heterologous object sequence. The composition may insert the sequence of the heterologous object sequence into a target DNA.

16 Claims, 21 Drawing Sheets

Specification includes a Sequence Listing.

(56) References Cited

FOREIGN PATENT DOCUMENTS

| | | | |
|---|---|---|---|
| WO | 2016205728 | A1 | 12/2016 |
| WO | 2017059241 | A1 | 4/2017 |
| WO | 2017123609 | A1 | 7/2017 |
| WO | 2017137768 | A1 | 8/2017 |
| WO | 2017151719 | A1 | 9/2017 |
| WO | 2017173004 | A1 | 10/2017 |
| WO | 2017180711 | A1 | 10/2017 |
| WO | 2017186550 | A1 | 11/2017 |
| WO | 2017197238 | A1 | 11/2017 |
| WO | 2018027078 | A1 | 2/2018 |
| WO | 2018049168 | A1 | 3/2018 |
| WO | 2018071663 | A1 | 4/2018 |
| WO | 2018089860 | A1 | 5/2018 |
| WO | 2018165629 | A1 | 9/2018 |
| WO | 2018176009 | A1 | 9/2018 |
| WO | 2018218166 | A1 | 11/2018 |
| WO | 2019051097 | A1 | 3/2019 |
| WO | 2020014528 | A1 | 1/2020 |
| WO | 2020191153 | A9 | 1/2020 |
| WO | 2020191171 | A9 | 1/2020 |
| WO | 2020047124 | A1 | 3/2020 |
| WO | 2020082076 | A1 | 4/2020 |
| WO | 2020186262 | A1 | 9/2020 |
| WO | 2020191233 | A1 | 9/2020 |
| WO | 2020191234 | A1 | 9/2020 |
| WO | 2020191239 | A1 | 9/2020 |
| WO | 2020191241 | A1 | 9/2020 |
| WO | 2020191242 | A1 | 9/2020 |
| WO | 2020191243 | A1 | 9/2020 |
| WO | 2020191245 | A1 | 9/2020 |
| WO | 2020191246 | A1 | 9/2020 |
| WO | 2020191248 | A1 | 9/2020 |
| WO | 2020191249 | A1 | 9/2020 |
| WO | 2020252361 | A1 | 12/2020 |
| WO | 2021016075 | A1 | 1/2021 |
| WO | 2021080922 | A1 | 4/2021 |
| WO | 2021102390 | A1 | 5/2021 |
| WO | 2021178709 | A1 | 9/2021 |
| WO | 2021178717 | A2 | 9/2021 |
| WO | 2021178720 | A2 | 9/2021 |
| WO | 2021178898 | A9 | 9/2021 |
| WO | 2021248102 | A1 | 12/2021 |

OTHER PUBLICATIONS

Holstein et al., Efficient Non-viral Gene Delivery into Human Hematopoietic Stem Cells by Minicircle Sleeping Beauty Transposon Vectors. Mol. Therapy., 2018, vol. 26(4): 1137-1153. (Year: 2018).*

Sultana T., Influence of the genomic context on integration site selection by human L1 retrotransposons. Ph.D. Dissertation, 2016, Universite Cote D'Azur, France, pp. 1-184. (Year: 2016).*

Longsworth G., Expanding the Enzymatic Activity of the Programmable Endonuclease Cas9 in Zebrafish. Rice Univ., Master of Arts Thesis, Aug. 3, 2018, pp. 1-42. (Year: 2018).*

Jamburuthugoda et al., Identification of RNA binding motifs in the R2 retrotransposon-encoded reverse transcriptase. Nuc. Acids Res., 2014, vol. 42(13): 8405-8415. (Year: 2014).*

Luan et al., RNA Template Requirements for Target DNA-Primed Reverse Transcription by the R2 Retrotransposable Element. Mol. Cell. Biol., 1995, vol. 15(7): 3882-3891. (Year: 1995).*

Ade et al., "Evaluating different DNA binding domains to modulate L1 ORF2p-driven site-specific retrotransposition events in human cells," Gene (2018) vol. 642, pp. 188-198.

Christensen et al., "Footprint of the Retrotransposon R2Bm Protein on its Target Site Before and After Cleavage," Journal of Molecular Biology (2004) vol. 336, No. 5, pp. 1035-1045.

Denli et al., "Primate-Specific ORF0 Contributes to Retrotransposon-Mediated Diversity," Cell (2015) vol. 163, No. 3, pp. 583-593.

International Search Report & Written Opinion issued in PCT/US2019/048607 mailed on Jan. 15, 2020, 15 pages.

Kojima et al., "The Wide Distribution and Change of Target Specificity of R2 Non-LTR Retrotransposons in Animals," PLOS One (2016) vol. 11, No. 9, Article e0163496, 16 pages.

Larson et al., "Spliced integrated retrotransposed element (SpIRE) formation in the human genome," PLoS Biology (2018) vol. 16, No. 3, Article e2003067, 37 pages.

Meers et al., "DNA repair by RNA: Templated, or not templated, that is the question," DNA Repair (2016) vol. 44, pp. 17-21.

Piskareva et al., "The carboxy-terminal segment of the human LINE-1 ORF2 protein is involved in RNA binding," FEBS Open Bio (2013) vol. 3, pp. 433-437.

63rd Fujihara Seminar, "A new horizon of retroposon research," Jul. 31-Aug. 3, 2012, Kyoto, Japan, program booklet with abstracts, 90 pages.

Barnes et al., "Recombinant R2 Retrotransposon for Targeted Integration of Large Genetic Cassettes into the Human Genome," Molecular Therapy (2019) vol. 27, No. 4S1, Abstract 216, p. 109.

Chillón et al., "In vitro characterization of the splicing efficiency and fidelity of the RmInt1 group II intron as a means of controlling the dispersion of its host mobile element," RNA (2014) vol. 20, No. 12, pp. 2000-2010.

Fujiwara, "Site-specific non-LTR retrotransposons," Microbiol Spectrum (2014) vol. 3, No. 2, Article MDNA-0001-2014, 16 pages.

Kierzek et al., "Secondary structures for 5' regions of R2 retrotransposon RNAs reveal a novel conserved pseudoknot and regions that evolve under different constraints," J Mol Biol (2009) vol. 390, No. 3, pp. 428-442.

Kuroki-Kami et al., "Targeted gene knockin in zebrafish using the 28S rDNA-specific non-LTR-retrotransposon R2Ol," Mobile DNA (2019) vol. 10, Article 23, 12 pages.

Ruminski et al., "Processing and Translation Initiation of Non-long Terminal Repeat Retrotransposons by Hepatitis Delta Virus (HDV)-like Self-cleaving Ribozymes," J Biol Chem (2011) vol. 286, No. 48, p. 41286-41295.

Peters et al., "Recruitment of CRISPR-Cas systems by Tn7-like transposons," PNAS (2017) vol. 114, No. 35, pp. E7358-E7366.

Klompe et al., "Transposon-encoded CRISPR-Cas systems direct RNA-guided DNA integration," Nature (2019) vol. 571, No. 7764, pp. 219-225.

Strecker et al., "RNA-guided DNA insertion with CRISPR-associated transposases," Science (2019) vol. 365, No. 6448, pp. 48-53.

Faure et al., "CRISPR-Cas in mobile genetic elements: counter-defence and beyond," Nat Rev Microbiol (2019) vol. 17, No. 8, pp. 513-525.

Lim et al., "Specific insertions of zinc finger domains into Gag-Pol yield engineered retroviral vectors with selective integration properties," PNAS (2010) vol. 107, No. 28, pp. 12475-12480.

Mohr et al., "A Reverse Transcriptase-Cas1 Fusion Protein Contains a Cas6 Domain Required for Both CRISPR RNA Biogenesis and RNA Spacer Acquisition," Molecular Cell (2018) vol. 72 pp. 700-714.

Hwang et al., "Web-based design and analysis tools for CRISPR base editing," BMC Bioinformatics (2018) vol. 19, Article 542, 7 pages.

Anzalone et al., Search-and replace genome editing without double-strand breaks or donor DNA, Nature (2019) vol. 576, No. 7785, pp. 149-157.

Landrum et al., "ClinVar: public archive of interpretations of clinically relevant variants," Nucleic Acids Research (2015) vol. 44, pp. D862-D868.

Liu et al., "Computational approaches for effective CRISPR guide RNA design and evaluation," Computational and Structural Biotechnology Journal (2020): vol. 18, pp. 35-44.

Tang et al., "Rewritable multi-event analog recording in bacterial and mammalian cells," Science (2018) vol. 360, No. 6385, eaap8992.

Xu et al., "Accuracy and efficiency define Bxb1 integrase as the best of fifteen candidate serine recombinases for the Integration of DNA into the human genome," BMC Biotechnology (2013) vol. 13, Article 87, 17 pages.

Silas et al., Direct CRISPR spacer acquisition from RNA by a natural reverse-transcriptase-Cas1 fusion protein, Science (2016) vol. 351, No. 6276, Article aad4234, 31 pages.

(56) References Cited

OTHER PUBLICATIONS

Takahashi et al., "Transplantation of target site specificity by swapping the endonuclease domains of two LINEs," The EMBO Journal (2002) vol. 21, No. 3, pp. 408-417.
García-Rodríguez et al., Use of the computer-retargeted group II intron Rmint1 of Sinorhizobium meliloti for gene targeting, RNA Biology (2014) vol. 11, No. 4, pp. 391-401.
Sharon et al., "Functional Genetic Variants Revealed by Massively Parallel Precise Genome Editing," Cell (2018) vol. 175, pp. 544-557.
Opposition Brief filed in European Patent No. 3448990, mailed Mar. 15, 2022, 66 pages.
Halperin et al., "CRISPR-guided DNA polymerases enable diversification of all nucleotides in a tunable window," Nature (2018) vol. 560, No. 7717, pp. 248-252.
Su et al., "Human DNA polymerase [eta] has reverse transcriptase activity in cellular environments," J Biol Chem (2019) vol. 294, No. 15, pp. 6073-6081.
Krzywkowski et al., "Limited reverse transcriptase activity of phi29 DNA polymerase," Nucleic Acids Research (2018) vol. 46, No. 7, pp. 3625-3632.
Altenbuchner, "Editing of the Bacillus subtilis Genome by the CRISPR-Cas9 System," Applied and Environmental Microbiology (2016) vol. 82, No. 17, pp. 5421-5427.
U.S. Appl. No. 62/332,099, filed Apr. 13, 2016.
U.S. Appl. No. 62/263,223, filed Oct. 2, 2015.
Bono et al., "Connecting genotypes, phenotypes and fitness: harnessing the power of CRISPR/Cas9 genome editing," Molecular Ecology (2015) vol. 24, pp. 3810-3822.
Ran et al., "Genome engineering using the CRISPR/Cas9 system," Nature Protocols (2013) vol. 8, No. 11, pp. 2281-2308.
Paix et al., "Scalable and Versatile Genome Editing Using Linear DNAs with Microhomology to Cas9 Sites in Caenorhabditis elegans," Genetics (2014) vol. 198, pp. 1347-1356.
Trevino et al., "Genome Editing Using Cas9 Nickases," Methods in Enzymology, Eds. Doudna et al. (2014) vol. 546, Chapter 8, pp. 161-174.
Zhu et al., "The iCRISPR Platform for Rapid Genome Editing in Human Pluripotent Stem Cells," Methods in Enzymology, Eds. Doudna et al. (2014) vol. 546, Chapter 11, pp. 215-250.
Choudhuri, "Bioinformatics for Beginners: Genes, Genomes, Molecular Evolution, Databases and Analytical Tools," Elsevier (2014) p. 64.
Jinek et al., "A Programmable Dual-RNA-Guided DNA Endonuclease in Adaptive Bacterial Immunity," Science (2012) vol. 337, pp. 816-821 and Supplementary Materials.
[No Author Listed] Invitrogen—"ProQuest Two-Hybrid System: A sensitive method for detecting protein-protein Interactions," User Manual, Version A (2015) 116 pages.
Ivancevic et al., "LINEs between Species—Evolutionary Dynamics of LINE-1 Retrotransposons across the Eukaryotic Tree of Life," Genome Biology and Evolution (2016) vol. 8, No. 11, pp. 3301-3322.
Ivics et al., "Molecular Reconstruction of Sleeping Beauty, a Tc1-like Transposon from Fish, and Its Transposition in Human Cells," Cell 1997, vol. 91, pp. 501-510.
Jamburuthugoda et al., "The Reverse Transcriptase Encoded by the Non-LTR Retrotransposon R2 Is as Error-Prone as That Encoded by HIV-1," Journal of Molecular Biology (2011).
Jurka et al., "Sequence patterns indicate an enzymatic involvement in integration of mammalian retroposons," Proceedings of the National Academy of Sciences (1997) vol. 94, pp. 1872-1877.
Kajikawa et al., "A new mechanism to ensure integration during LINE retrotransposition—A suggestion from analyses of the 5' extra nucleotides," Gene (2012) vol. 505, pp. 345-351.
Kawashima et al., "A novel target-specific gene delivery system combining baculovirus and sequence-specific long Interspersed nuclear elements," Virus Research (2007) vol. 127, pp. 49-60.
Kelley et al., "The Phyre2 web portal for protein modeling, prediction and analysis," Nature Protocols (2015) vol. 10, No. 6, pp. 845-858.
Kleinstiver et al., "Engineered CRISPR-Cas9 nucleases with altered PAM specificities," Nature (2015) vol. 523, pp. 481-485.
Kojima et al., Recent Expansion of a New Ingi-Related Clade of Vingi non-LTR Retrotransposons in Hedgehog, Molecular Biology and Evolution (2011) vol. 28, No. 1, pp. 17-20.
Komor et al., "Programmable editing of a target base in genomic DNA without double-stranded DNA cleavag," Nature (2016) vol. 523, pp. 420-424.
Kurzynska-Kokorniak et al., "DNA-directed DNA Polymerase and Strand Displacement Activity of the Reverse Transcriptase Encoded by the R2 Retrotransposon," Journal of Molecular Biology (2007) vol. 374, pp. 322-333.
Lathe et al., "A single lineage of r2 retrotransposable elements is an active, evolutionarily stable component of the *Drosophila* rDNA locus," Molecular Biology and Evolution (1997) vol. 14, No. 12, pp. 1232-1241.
Letunic et al., "20 Years of the SMART protein domain annotation resource," Nucleic Acids Research (2018) vol. 46, pp. D493-D496.
Li et al., "A Review of the Structure, Preparation, and Application of NLCs, PNPs, and PLNs," Nanomaterials 7, 122, 2017.
Luan et al., "RNA Template Requirements for Target DNA-Primed Reverse Transcription by the R2 Retrotransposable Element," Molecular and Cellular Biology (1995) vol. 15, No. 7, pp. 3882-3891.
Lubelsky et al., "Sequences enriched in Alu repeats drive nuclear localization of long RNAs in human cells," Nature 555 (107-111), 2018.
Mahbub et al., "Globular domain structure and function of restriction-like-endonuclease LINEs-similarities to eukaryotic splicing factor Prp8," Mobile DNA (2017) vol. 8, Article 16, 15 pages.
Maita et al., "Crystal Structure of the Endonuclease Domain Encoded by the Telomere-specific Long Interspersed Nuclear Element, TRAS1," Journal of Biological Chemistry (2004) vol. 279, No. 39, pp. 41607-41076.
Malik et al., "Ribonuclease H evolution in retrotransposable elements," Cytogenetic and Genome Research (2005) vol. 110, pp. 392-401.
Mastroianni et al., "Group II Intron-Based Gene Targeting Reactions in Eukaryotes," PLoS One (2008) vol. 3, Issue 9, Article e3121, 15 pages.
Mills et al., "Which transposable elements are active in the human genome," Trends in Genetics (2007) vol. 23, No. 4, pp. 183-191.
Mita et al., "LINE-1 protein localization and functional dynamics during the cell cycle,"eLife (2018) vol. 7, Article e30058, 35 pages.
Miyagawa et al.,"Identification of cis- and trans-acting factors involved in the localization of MALAT-1 noncoding RNA to nuclear speckles," RNA (2012) vol. 18, pp. 738-751.
Miyoshi et al., "Poly(ADP-Ribose) Polymerase 2 Recruits Replication Protein A to Sites of LINE-1 Integration to Facilitate Retrotransposition," Molecular Cell (2019) vol. 75, pp. 1286-1298.
Moran et al., "High Frequency Retrotransposition in Cultured Mammalian Cells," Cell (1996) vol. 87, pp. 917-927.
Moss et al., "The R2 retrotransposon RNA families," RNA Biology (2011) vol. 8, No. 5, pp. 714-718.
Mukha et al., "Endonuclease domain of the *Drosophila melanogaster* R2 non-LTR retrotransposon and related retroelements- a new model for transposition," Frontiers in Genetics (2013) vol. 4, Article 63, 15 pages.
Naldini et al., "In Vivo Gene Delivery and Stable Transduction of Nondividing Cells by a Lentiviral Vector" Science (1996) vol. 272 pp. 263-267.
Nami et al., "Strategies for In Vivo Genome Editing in Nondividing Cells," Trends in Biotechnology (2018) vol. 36, No. 8, pp. 770-786.
Nichuguti et al., "Both the Exact Target Site Sequence and a Long Poly(A) Tail Are Required for Precise Insertion of the 18S Ribosomal DNA-Specific Non-Long Terminal Repeat Retrotransposon R7Ag," Molecular and Cellular Biology (2016) vol. 36, No. 10, pp. 1494-1508.
Nuñez et al., "Cas1-Cas2 complex formation mediates spacer acquisition during CRISPR-Cas adaptive immunity," Nature Structural & Molecular Biology (2014) vol. 21, No. 6, pp. 528-534.

(56) References Cited

OTHER PUBLICATIONS

Osanai et al., "Essential Motifs in the 3' Untranslated Region Required for Retrotransposition and the Precise Start of Reverse Transcription in Non-Long-Terminal-Repeat Retrotransposon SART1," Molecular and Cellular Biology (2004) vol. 24, No. 18, pp. 7902-7913.
Ostertag et al., "Biology of Mammalian L1 Retrotransposons" Annual Review of Genetics (2001) vol. 35, pp. 501-538.
Ostertag et al., "Twin Priming—A Proposed Mechanism for the Creation of Inversions in L1 Retrotransposition," Genome Research (2001) vol. 11, pp. 2059-2065.
Pei et al., "PROMALS3D—a tool for multiple protein sequence and structure alignments," Nucleic Acids Research (2008) vol. 36, No. 7, pp. 2295-2300.
Pellenz et al., "New human chromosomal safe harbor sites for genome engineering with CRISPR/Cas9, TAL effector and homing endonucleases," Human Gene Therapy (2018) doi: 10.1101/396390, 39 pages.
Qu et al., "Structure of a group II intron in complex with its reverse transcriptase," Nature Structural & Molecular Biology (2016) vol. 23, No. 6, pp. 549-557.
Ruschak et al. "Secondary structure models of the 3' untranslated regions of diverse R2 RNAs" RNA (2004) vol. 10(6): 978-987.
San Filippo et al., "Characterization of the C-Terminal DNA-binding-DNA Endonuclease Region of a Group II Intron-encoded Protein," Journal of Molecular Biology (2002) vol. 324, pp. 933-951.
Sano et al., "Mutations to create thermostable reverse transcriptase with bacterial family A DNA polymerase from Thermotoga petrophila K4," Journal of Bioscience and Bioengineering (2012) vol. 113, No. 3, pp. 315-321.
Sharma et al., "In vivo genome editing of the albumin locus as a platform for protein; replacement therapy," Blood (2015) vol. 126, No. 15: 1777-1784.
Shivram et al., "Targeting novel sites: The N-terminal DNA binding domain of non-LTR retrotransposons is an adaptable module that is implicated in changing site specificities," Mobile Genetic Elements (2011) vol. 1, No. 3, pp. 169-178.
Shukla et al., "High-throughput identification of RNA nuclear enrichment sequences," The EMBO Journal (2018) vol. 37, Article e98452, 11 pages.
Simon et al., "Retrons and their applications in genome engineering," Nucleic Acids Research (2019) doi: 10.1093/harlgkz865, 13 pages.
Smyshlyaev et al., "Acquisition of an Archaea-like ribonuclease H domain by plant L1 retrotransposons supports modular evolution," Proceedings of the National Academy of Sciences (2013) vol. 110, No. 50, pp. 20140-20145.
Spuch and Navarro, "Liposomes for Targeted Delivery of Active Agents against Neurodegenerative Diseases (Alzheimer's Disease and Parkinson's Disease)," Journal of Drug Delivery, vol. 2011, Article ID 469679, 12 pages, 2011. doi: 10.1155/2011/469679 for review.
Stamos et al., "Structure of a Thermostable Group II Intron Reverse Transcriptase with Template-Primer and Its Functional and Evolutionary Implications," Molecular Cell (2017) vol. 68, pp. 926-939.
Su et al., "Sequence-specific retrotransposition of 28S rDNA-specific LINE R2OI in human cells" RNA (2019 ) vol. 25, pp. 1432-1438.
Sultana et al., "Integration site selection by retroviruses and transposable elements in eukaryotes," Nature Reviews Genetics (2017) doi: 10.1038/nrg.2017.7, 17 pages.
Sultana et al., "The Landscape of L1 Retrotransposons in the Human Genome Is Shaped by Pre-insertion Sequence Biases and Post-insertion Selection," Molecular Cell (2019) vol. 74, pp. 555-570.
Taylor et al., "Affinity Proteomics Reveals Human Host Factors Implicated in Discrete Stages of LINE-1 Retrotransposition," Cell (2013) vol. 155, pp. 1034-1048.
Thompson et al., "Independently derived targeting of the 28S rDNA by A- and D-clade R2 retrotransposons," Mobile Genetic Elements (2011) vol. 1, pp. 29-37.
Truong et al., "Retrohoming of a Mobile Group II Intron in Human Cells Suggests How Eukaryotes Limit Group II Intron Proliferation," PLoS Genetics (2015) vol. 11, No. 8, Article e1005422, 35 pages.
Ustyantsev et al., "Convergence of retrotransposons in oomycetes and plants," Mobile DNA (2017) vol. 8, Article 4, 11 pages.
Wagstaff et al., "Molecular reconstruction of extinct LINE-1 elements and their interaction with nonautonomous elements," Molecular Biology and Evolution (2013) 30(1): 88-99.
Wallace et al., "L1 mobile element expression causes multiple types of toxicity," Gene (2008) vol. 419, pp. 75-81.
Wicker et al., "A unified classification system for eukaryotic transposable elements," Nature Reviews Genetics (2007) vol. 8, pp. 973-982.
Xiong et al., "Functional expression of a sequence-specific endonuclease encoded by the retrotransposon R2Bm," Cell (1988) vol. 55, pp. 235-246.
Xiong et al., "Origin and evolution of retroelements based upon their reverse transcriptase sequences," The EMBO Journal (1990) vol. 9, No. 10, pp. 3353-3362.
Yang et al., "Identification and characterization of nuclear and nucleolar localization signals in 58-kDa microspherule protein (MSP58)," Journal of Biomedical Science (2015) vol. 22, Article 33, 15 pages.
Yang et al., "Identification of the endonuclease domain encoded by R2 and other site-specific, non-long terminal repeat retrotransposable elements," PNAS (1999) vol. 96, pp. 7487-7852.
Yasukawa et al., "Next-generation sequencing-based analysis of reverse transcriptase fidelity,"Biochemical and Biophysical Research Communications (2017) vol. 492, pp. 147-153.
Zhang et al., "A novel RNA motif mediates the strict nuclear localization of a long noncoding RNA," Molecular and Cellular Biology 34, 2318-2329 (2014).
Zhang et al., "Genome Editing with mRNA Encoding ZFN, TALEN, and Cas9," Molecular Therapy (2019) vol. 27, No. 4, pp. 735-746.
Zhao et al., "An ultraprocessive, accurate reverse transcriptase encoded by a metazoan group II intron," RNA (2018).
Zhao et al., "Crystal structures of a group II intron maturase reveal a missing link in spliceosome evolution," Nature Structural & Molecular Biology (2016) vol. 23, No. 6, pp. 558-567.
Zimmerly et al., "A Group II Intron RNA Is a Catalytic Component of a DNA Endonuclease Involved in Intron Mobility," Cell (1995) vol. 83, pp. 529-538.
Zimmerly et al., "An Unexplored Diversity of Reverse Transcriptases in Bacteria," Microbiology Spectrum (2015) vol. 3, No. 2, Article MDNA-0058-2014, 16 pages.
Zimmerly et al., "Evolution of group II introns," Mobile DNA (2015) vol. 6, Article 7, 19 pages.
Zimmerman et al., "A Completely Reimplemented MPI Bioinformatics Toolkit with a New Hhpred Server at its Core," J Mol Biol (2018) vol. 430, pp. 2237-2243.
Zingler et al., "Analysis of 5' junctions of human LINE-1 and Alu retrotransposons suggests an alternative model for 5'- end attachment requiring microhomology-mediated end-joining," Genome Research (2005) vol. 15, pp. 780-789.
Takasu et al., "Targeted mutagenesis in the silkworm Bombyx mori using zinc finger nuclease mRNA injection," Insect Biochemistry and Molecular Biology 40(10): 759-765, 2010.
Templeton et al., "Improved DNA: liposome complexes for increased systemic delivery and gene expression," Nature Biotech, 15:647-652, 1997.
[No Author Listed] Rice University Events Listing for Aug. 3, 2018: Thesis Defense by Gia Longsworth, "Expanding the Enzymatic Activity of the Programmable Endonuclease Cas9 in Zebrafish," with Abstract, first posted on Aug. 3, 2018.
An et al., "Plug and play modular strategies for synthetic retrotransposons," Methods (2009) vol. 49, pp. 227-235.
Anand et al., "Structure based design of protein linkers for zinc finger nuclease," FEBS Letters, 587:19, 2013.

(56) References Cited

OTHER PUBLICATIONS

Babushok et al., "Progress in understanding the biology of the human mutagen LINE-1," Human Mutation (2007) vol. 28, No. 6, pp. 527-539.
Bailey et al., "The MEME Suite," Nucleic Acids Research (2015) vol. 43, pp. W39-W49.
Bao et al., "Repbase Update, a database of repetitive elements in eukaryotic genomes," Mobile DNA (2015) vol. 6, Article 11, 6 pages.
Bateman et al., "UniProt—the universal protein knowledgebase," Nucleic Acids Research (2017) vol. 45, pp. D158-D169.
Belfort et al., "Group II Intron RNPs and Reverse Transcriptases—From Retroelements to Research Tools," Cold Spring Harbor Perspectives in Biology (2019) 11:a032375, 17 pages.
Benitez-Guijarro et al., "RNase H2, mutated in Aicardi-Goutieres syndrome, promotes LINE-1 retrotransposition," The EMBO Journal (2018) vol. 37, Article e98506, 22 pages.
Bibillo et al., "High Processivity of the Reverse Transcriptase from a Non-long Terminal Repeat Retrotransposon," J Biol Chem (2002) vol. 277, No. 38, pp. 34836-34845.
Bibillo et al., "The Reverse Transcriptase of the R2 Non-LTR Retrotransposon: Continuous Synthesis of cDNA on Non-continuous RNA Templates," J Mol Biol (2002) vol. 316, pp. 459-473.
Birbach et al., "Cytosolic, nuclear and nucleolar localization signals determine subcellular distribution and activity of the NF-kappaB inducing kinase NIK," Journal of Cell Science, 117 (3615-3624), 2004.
Boissinot et al., "L1 (LINE-1) Retrotransposon Evolution and Amplification in Recent Human History," Molecular Biology and Evolution 2000, 915-928.
Burke et al., "R4, a non-LTR retrotransposon specific to the large subunit rRNA genes of nematodes," Nucleic Acids Res. 23, 4628-34 (1995).
Burke et al., "Sequence relationship of retrotransposable elements R1 and R2 within and between divergent insect species," Molecular Biology and Evolution (1993) vol. 10, No. 1, pp. 163-185.
Burke et al., "The domain structure and retrotransposition mechanism of R2 elements are conserved throughout arthropods," Molecular Biology and Evolution (1999) vol. 16, No. 4, pp. 502-511.
Candales et al., "Database for bacterial group II introns," Nucleic Acids Research (2012) vol. 40, pp. D187-D190.
Chan et al., "Crystal structure of a group II intron in the pre-catalytic state," Nature Structural & Molecular Biology (2012) vol. 19, No. 5, pp. 555-557.
Chen et al., "Fusion Protein Linkers: Property, Design and Functionality," Adv Drug Deliv Rev (2013) 65(10): 1357-1369.
Choi et al., "Interplay between RNASEH2 and MOV10 controls LINE-1 retrotransposition," Nucleic Acids Research (2018) doi: 10/1093/nar/gkx1312, 15 pages.
Christensen et al., "R2 Target-Primed Reverse Transcription—Ordered Cleavage and Polymerization Steps by Protein Subunits Asymmetrically Bound to the Target DNA," Molecular and Cellular Biology (2005) vol. 25, No. 15, pp. 6617-6628.
Christensen et al., "RNA from the 5' end of the R2 retrotransposon controls R2 protein binding to and cleavage of its DNA target site," Proceedings of the National Academy of Sciences (2006) vol. 103, No. 47, pp. 17602-17607.
Christensen et al., "Role of the Bombyx mori R2 element N-terminal domain in the target-primed reverse transcription (TPRT) reaction," Nucleic Acids Research (2005) vol. 33, No. 20, pp. 6461-6468.
Cordaux et al., "The impact of retrotransposons on human genome evolution,"Nature Reviews Genetics (2009) Nature Reviews vol. 10, pp. 691-703.
Cost et al., "Targeting of Human Retrotransposon Integration Is Directed by the Specificity of the L1 Endonuclease for Regions of Unusual DNA Structure," Biochemistry (1998) vol. 37, pp. 18081-18093.
Craig et al., Editors, "Mobile DNA III," ASM Press (2015) pp. 1-1346.
Dewannieux et al., "Role of poly(A) tail length in Alu retrotransposition," Genomics (2005) vol. 86, pp. 378-381.
Doucet et al., "A 3' Poly(A) Tract Is Required for LINE-1 Retrotransposition," Molecular Cell (2015) vol. 60, pp. 728-741.
Eickbush et al., "Integration of Bombyx mori R2 Sequences into the 28S Ribosomal RNA Genes of *Drosophila melanogaster*," Molecular and Cellular Biology (2000) vol. 20, No. 1, pp. 213-223.
Eickbush et al., "Integration, Regulation, and Long-Term Stability of R2 Retrotransposons," Microbiology Spectrum (2015) vol. 3, No. 2, MDNA3-011, 20 pages.
Eickbush et al., "R2 and R2-R1 hybrid non-autonomous retrotransposons derived by internal deletions of full-length elements," Mobile DNA (2012) vol. 3, Article 10, 15 pages.
Eickbush et al., "R2 Retrotransposons Encode a Self-Cleaving Ribozyme for Processing from an rRNA Cotranscript," Molecular and Cellular Biology (2010) vol. 30, No. 13, pp. 3142-3150.
Ellefson et al., "Synthetic evolutionary origin of a proofreading reverse transcriptase," Science (2016) vol. 352, Issue 6293, pp. 1590-1593.
Enyeart et al., "Biotechnological applications of mobile group II introns and their reverse transcriptases—gene targeting, RNA-seq, and non-coding RNA analysis," Mobile DNA (2014) vol. 5, Article 2, 19 pages.
Finn et al., "InterPro in 2017—beyond protein family and domain annotations," Nucleic Acids Research (2017) vol. 45, pp. D190-D199.
Finnegan, "Transposable elements—How non-LTR retrotransposons do it," Current Biology (1997) vol. 7, pp. R245-R248.
Flasch et al., "Genome-wide de novo L1 Retrotransposition Connects Endonuclease Activity with Replication," Cell (2019) vol. 177, p. 877-851.
Fujimoto et al., "Integration of the 5' end of the retrotransposon, R2Bm, can be complemented by homologous recombination," Nucleic Acids Research (2004) vol. 32, No. 4, pp. 1555-1565.
Garneau et al., "The CRISPR-Cas bacterial immune system cleaves bacteriophage and plasmid DNA," Nature (2010) vol. 468, pp. 67-71.
George et al., "Analysis of the 5' Junctions of R2 Insertions With the 28S Gene—Implications for Non-LTR Retrotransposition," Genetics (1996) vol. 142, pp. 853-863.
Gilbert et al., "Multiple Fates of L1 Retrotransposition Intermediates in Cultured Human Cells," Molecular and Cellular Biology (2005) vol. 25, No. 17, pp. 7780-7795.
Gladyshev-Rotifer et al., "rDNA-specific R9 retrotransposable elements generate an exceptionally long target site duplication upon insertion," Gene (2009) vol. 448, pp. 145-150.
Goodier et al., "Restricting retrotransposons—a review," Mobile DNA (2016) vol. 7, Article 16, 30 pages.
Govindaraju et al., "Endonuclease domain of non-LTR retrotransposons: loss-of-function mutants and modeling of the R2Bm endonuclease," Nucleic Acids Researh (2016) vol. 44, No. 7, pp. 3276-3287.
Ha et al.,"Exosomes as therapeutic drug carriers and delivery vehicles across biological membranes: current perspectives and future challenges," Acta Pharmaceutica Sinica B (2016) vol. 6, Issue 4, pp. 287-296.
Haack et al., "Cryo-EM Structures of a Group II Intron Reverse Splicing into DNA," Cell (2019) vol. 178, pp. 612-623.
Han et al., "Circular retrotransposition products generated by a LINE retrotransposon," Nucleic Acids Research (2012) vol. 40, No. 21, pp. 10866-10877.
Han, "Non-long terminal repeat (non-LTR) retrotransposons—mechanisms, recent developments, and unanswered questions," Mobile DNA (2010) vol. 1, Article 15, 12 pages.
Herschhorn et al., "Retroviral reverse transcriptases," Cellular and Molecular Life Sciences (2010) vol. 67, pp. 2717-2747.
Hockemeyer et al., "Efficient targeting of expressed and silent genes in human ESCs and iPSCs using zinc-finger nucleases," Nature Biotechnology 27(9): 851-857, 2009.

(56) References Cited

OTHER PUBLICATIONS

Bodea et al., "Retrotransposon-induced mosaicism in the neural geome," Open Biology (2018) vol. 8, No. 7, Article 180074, 17 pages.

* cited by examiner

| Homology 1-60bp | TAGCCAAATGCCTGGTCATCTAATTAGTAGTGACGGCATGAATGGATGAACGAGATTCCAC |
|---|---|

| Position | 1 | 5 | 10 | 15 | 20 | 25 | 30 | 35 | 40 | 45 | 50 | 55 | 60 |
|---|---|---|---|---|---|---|---|---|---|---|---|---|---|
| Mutation | | | | c | g | a | t | g | t | a | c | a | g |
| Mutant # | | | | 1 | 2 | 3 | 4 | 5 | 6 | 7 | 8 | 9 | 10 |
| Sequencing Result | | | | G | C | T | A | C | A | T | G | T | C |

| Homology 61-100bp | TGTCCCTACCTACTATCCAGGCGAAACCCAGCCAAGGGAA |
|---|---|

| Position | 65 | 70 | 75 | 80 | 85 | 90 | 95 | 100 |
|---|---|---|---|---|---|---|---|---|
| Mutation | g | g | t | c | t | t | t | t |
| Mutant # | 11 | 12 | 13 | 14 | 15 | 16 | 17 | 18 |
| Sequencing Result | C | C | A | G | A | A | A | A |

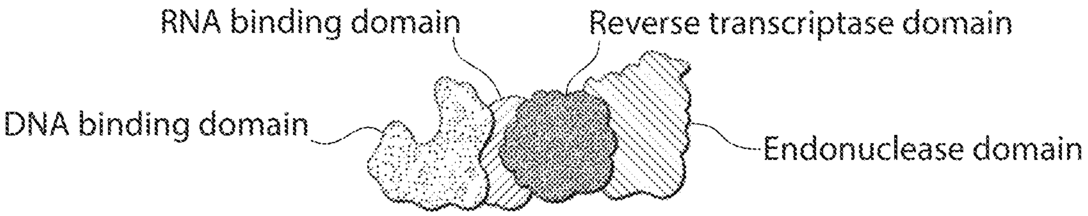

Figure 18A

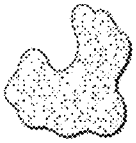

DNA binding
Zinc fingers
Cas9
Transcription factors

Figure 18B

Full-length Reverse transcriptase
Different full-length RT from other R2
Different full-length RT combined with additional RNA binding domain

Figure 18C

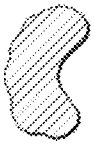

RNA binding
B-box protein
MS2 coat protein
dCas protein
UTR binding protein

Figure 18D

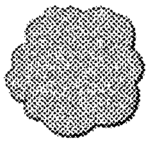

RT without RNA binding
Truncated RT from R2
HIV RT
AMV RT

Figure 18E

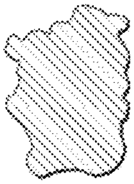

Endonuclease
Cas9 nickase
Cas ortholog
FokI
Restriction enyme

Figure 18F

METHODS AND COMPOSITIONS FOR MODULATING A GENOME

This application is a Continuation of International Application No. PCT/US2019/048607, filed Aug. 28, 2019, which claims priority to U.S. Ser. No. 62/723,886 filed Aug. 28, 2018, U.S. Ser. No. 62/725,778 filed Aug. 31, 2018, U.S. Ser. No. 62/850,883 filed May 21, 2019, and U.S. Ser. No. 62/864,924 filed Jun. 21, 2019, the entire contents of each of which is incorporated herein by reference.

SEQUENCE LISTING

The instant application contains a Sequence Listing which has been submitted electronically in ASCII format and is hereby incorporated by reference in its entirety. Said ASCII copy, created on Aug. 28, 2019, is named V2065-7000WO_SL.txt and is 4,004,548 bytes in size.

BACKGROUND

Integration of a nucleic acid of interest into a genome occurs at low frequency and with little site specificity, in the absence of a specialized protein to promote the insertion event. Some existing approaches, like CRISPR/Cas9, are more suited for small edits and are less effective at integrating longer sequences. Other existing approaches, like Cre/loxP, require a first step of inserting a loxP site into the genome and then a second step of inserting a sequence of interest into the loxP site. There is a need in the art for improved proteins for inserting sequences of interest into a genome.

SUMMARY OF THE INVENTION

This disclosure relates to novel compositions, systems and methods for altering a genome at one or more locations in a host cell, tissue or subject, in vivo or in vitro. In particular, the invention features compositions, systems and methods for the introduction of exogenous genetic elements into a host genome.

Features of the compositions or methods can include one or more of the following enumerated embodiments.

1. A system for modifying DNA comprising:
   (a) a polypeptide or a nucleic acid encoding a polypeptide, wherein the polypeptide comprises (i) a reverse transcriptase domain and (ii) an endonuclease domain; and
   (b) a template RNA (or DNA encoding the template RNA) comprising (i) a sequence that binds the polypeptide and (ii) a heterologous object sequence that encodes a therapeutic polypeptide or that encodes a mammalian (e.g., human) polypeptide, or a fragment or variant thereof.
2. A system for modifying DNA comprising:
   (a) a polypeptide or a nucleic acid encoding a polypeptide, wherein the polypeptide comprises (i) a reverse transcriptase domain and (ii) an endonuclease domain; and
   (b) a template RNA (or DNA encoding the template RNA) comprising (i) a sequence that binds the polypeptide and (ii) a heterologous object sequence, wherein one or more of:
      i. the heterologous object sequence encodes a protein, e.g. an enzyme (e.g., a lysosomal enzyme) or a blood factor (e.g., Factor I, II, V, VII, X, XI, XII or XIII);

ii. the heterologous object sequence comprises a tissue specific promoter or enhancer;
      iii. the heterologous object sequence encodes a polypeptide of greater than 250, 300, 400, 500, or 1,000 amino acids, and optionally up to 7,500 amino acids;
      iv. the heterologous object sequence encodes a fragment of a mammalian gene but does not encode the full mammalian gene, e.g., encodes one or more exons but does not encode a full-length protein;
      v. the heterologous object sequence encodes one or more introns;
      vi. the heterologous object sequence is other than a GFP, e.g., is other than a fluorescent protein or is other than a reporter protein.
      vii. the heterologous object sequence is other than a T cell chimeric antigen receptor
3. A system for modifying DNA comprising:
   (a) a polypeptide or a nucleic acid encoding a polypeptide, wherein the polypeptide comprises (i) a reverse transcriptase domain and (ii) an endonuclease domain; and
   (b) a template RNA (or DNA encoding the template RNA) comprising (i) a sequence that binds the polypeptide and (ii) a heterologous object sequence.
4. A system for modifying DNA comprising:
   (a) a polypeptide or a nucleic acid encoding a polypeptide, wherein the polypeptide comprises (i) a target DNA binding domain, (ii) a reverse transcriptase domain and (iii) an endonuclease domain; and
   (b) a template RNA (or DNA encoding the template RNA) comprising (i) a sequence that binds the polypeptide and (ii) a heterologous object sequence.
5. A system for modifying DNA comprising:
   (a) a polypeptide or a nucleic acid encoding a polypeptide, wherein the polypeptide comprises (i) a reverse transcriptase domain and (ii) an endonuclease domain, wherein one or both of (i) or (ii) are derived from an avian retrotransposase, e.g., have a sequence of Table 2 or 3 or at least 70%, 75%, 80%, 85%, 90%, 95%, 96%, 97%, 98%, or 99% identity thereto; and
   (b) a template RNA (or DNA encoding the template RNA) comprising (i) a sequence that binds the polypeptide and (ii) a heterologous object sequence.
6. A system for modifying DNA comprising:
   (a) a polypeptide or a nucleic acid encoding a polypeptide, wherein the polypeptide comprises (i) a reverse transcriptase domain and (ii) an endonuclease domain, wherein the polypeptide has an activity at 37° C. that is no less than 70%, 75%, 80%, 85%, 90%, or 95% of its activity at 25° C. under otherwise similar conditions; and
   (b) a template RNA (or DNA encoding the template RNA) comprising (i) a sequence that binds the polypeptide and (ii) a heterologous object sequence.
7. The system of embodiment 6, wherein the polypeptide is derived from an avian retrotransposase, e.g., an avian retrotransposase of column 8 of Table 3, or a sequence having at least 70%, 75%, 80%, 85%, 90%, 95%, 96%, 97%, 98%, or 99% identity thereto.
8. The system of embodiment 6, wherein the avian retrotransposase is a retrotransposase from *Taeniopygia guttata, Geospiza fortis, Zonotrichia albicollis*, or

*Tinamus guttatus*, or a sequence having at least 70%, 75%, 80%, 85%, 90%, 95%, 96%, 97%, 98%, or 99% identity thereto.

9. The system of embodiment 6, wherein the polypeptide is derived from a retrotransposase of column 8 of Table 3, or a sequence having at least 70%, 75%, 80%, 85%, 90%, 95%, 96%, 97%, 98%, or 99% identity thereto.
10. The system of any of the preceding embodiments, wherein the template RNA comprises a sequence of Table 3 (e.g., one or both of a 5' untranslated region of column 6 of Table 3 and a 3' untranslated region of column 7 of Table 3), or a sequence having at least 70%, 75%, 80%, 85%, 90%, 95%, 96%, 97%, 98%, or 99% identity thereto.
11. A system for modifying DNA comprising:
    (a) a polypeptide or a nucleic acid encoding a polypeptide, wherein the polypeptide comprises (i) a reverse transcriptase domain and (ii) an endonuclease domain; and
    (b) a template RNA (or DNA encoding the template RNA) comprising (i) a sequence that binds the polypeptide and (ii) a heterologous object sequence, wherein one or more of:
        i. the nucleic acid encoding the polypeptide and the template RNA or a nucleic acid encoding the template RNA are separate nucleic acids;
        ii. the template RNA does not encode an active reverse transcriptase, e.g., comprises an inactivated mutant reverse transcriptase, e.g., as described in Examples 1-2, or does not comprise a reverse transcriptase sequence; or
        iii. the template RNA does not encode an active endonuclease, e.g., comprises an inactivated endonuclease or does not comprise an endonuclease; or
        iv. the template RNA comprises one or more chemical modifications.
12. A system for modifying DNA comprising:
    (a) a polypeptide or a nucleic acid encoding a polypeptide, wherein the polypeptide comprises (i) a reverse transcriptase domain and (ii) an endonuclease domain; and
    (b) a template RNA (or DNA encoding the template RNA) comprising (i) a 5' untranslated sequence that binds the polypeptide, (ii) a 3' untranslated sequence that binds the polypeptide, (iii) a heterologous object sequence, and (iv) a promoter operably linked to the heterologous object sequence, wherein the promoter is disposed between the 5' untranslated sequence that binds the polypeptide and the heterologous sequence, or wherein the promoter is disposed between the 3' untranslated sequence that binds the polypeptide and the heterologous sequence.
13. A system for modifying DNA comprising:
    (a) a polypeptide or a nucleic acid encoding a polypeptide, wherein the polypeptide comprises (i) a reverse transcriptase domain and (ii) an endonuclease domain; and
    (b) a template RNA (or DNA encoding the template RNA) comprising (i) a 5' untranslated sequence that binds the polypeptide, (ii) a 3' untranslated sequence that binds the polypeptide, and (iii) a heterologous object sequence, and wherein the heterologous object sequence comprises an open reading frame (or the reverse complement thereof) in a 5' to 3' orientation on the template RNA; or wherein the heterologous object sequence comprises an open reading frame (or the reverse complement thereof) in a 3' to 5' orientation on the template RNA.
14. A system for modifying DNA comprising:
    (a) a polypeptide or a nucleic acid encoding a polypeptide, wherein the polypeptide comprises (i) a reverse transcriptase domain and (ii) an endonuclease domain, wherein at least one of (i) or (ii) is heterologous, and
    (b) a template RNA (or DNA encoding the template RNA) comprising (i) a sequence that binds the polypeptide and (ii) a heterologous object sequence.
15. A system for modifying DNA comprising:
    (a) a polypeptide or a nucleic acid encoding a polypeptide, wherein the polypeptide comprises (i) a target DNA binding domain, (i) a reverse transcriptase domain and (iii) an endonuclease domain, wherein at least one of (i), (ii) or (iii) is heterologous, and
    (b) a template RNA (or DNA encoding the template RNA) comprising (i) a sequence that binds the polypeptide and (ii) a heterologous object sequence.
16. A system for modifying DNA comprising:
    (a) a polypeptide or a nucleic acid encoding a polypeptide, wherein the polypeptide comprises (i) a sequence at least 80% identical (e.g., at least 85%, 90%, 95%, 97%, 98%, 99%, 100% identical) to a reverse transcriptase domain of a purinic/apyrimidinic endonuclease (APE)-type non-LTR retrotransposon and (ii) a sequence at least 80% identical (e.g., at least 85%, 90%, 95%, 97%, 98%, 99%, 100% identical) to an endonuclease domain of an APE-type non-LTR retrotransposon; and
    (b) a template RNA (or DNA encoding the template RNA) comprising (i) a sequence that binds the polypeptide and (ii) a heterologous object sequence.
17. A system for modifying DNA comprising:
    (a) a polypeptide or a nucleic acid encoding a polypeptide, wherein the polypeptide comprises (i) a sequence at least 80% identical (e.g., at least 85%, 90%, 95%, 97%, 98%, 99%, 100% identical) to a reverse transcriptase domain of a restriction enzyme-like endonuclease (RLE)-type non-LTR retrotransposon, (ii) a sequence at least 80% identical (e.g., at least 85%, 90%, 95%, 97%, 98%, 99%, 100% identical) to an endonuclease domain of a RLE-type non-LTR retrotransposon, and (iii) a heterologous target DNA binding domain (e.g., a heterologous zinc-finger DNA binding domain); and
    (b) a template RNA (or DNA encoding the template RNA) comprising (i) a sequence that binds the polypeptide and (ii) a heterologous object sequence.
18. The system of any of the preceding embodiments, wherein the template RNA comprises (iii) a promoter operably linked to the heterologous object sequence.
19. The system of any of the preceding embodiments, wherein the polypeptide further comprises (iii) a DNA-binding domain.
20. The system of embodiment 17, wherein the polypeptide comprises a sequence at least 80% identical (e.g., at least 85%, 90%, 95%, 97%, 98%, 99%, 100% identical) to the sequence of SEQ ID NO: 1016.
21. The system of any of the preceding embodiments, wherein the polypeptide comprises a sequence at least 80% identical (e.g., at least 85%, 90%, 95%, 97%, 98%, 99%, 100% identical) to a sequence in column 8 of Table 3.

22. The system of any of the preceding embodiments, wherein the nucleic acid encoding the polypeptide and the template RNA or the nucleic acid encoding the template RNA are covalently linked, e.g., are part of a fusion nucleic acid.
23. The system of embodiment 22, wherein the fusion nucleic acid comprises RNA.
24. The system of embodiment 22, wherein the fusion nucleic acid comprises DNA.
25. The system of any of the preceding embodiments, wherein (b) comprises template RNA.
26. The system of embodiment 25, wherein the template RNA further comprises a nuclear localization signal.
27. The system of any of the preceding embodiments, wherein (a) comprises RNA encoding the polypeptide.
28. The system of embodiment 27, wherein the RNA of (a) and the RNA of (b) are separate RNA molecules.
29. The system of embodiment 28, wherein the RNA of (a) and the RNA of (b) are present at a ratio of between 10:1 and 5:1, 5:1 and 2:1, 2:1 and 1:1, 1:1 and 1:2, 1:2 and 1:5, or 1:5 and 1:10.
30. The system of embodiment 28, wherein the RNA of (a) does not comprise a nuclear localization signal.
31. The system of any of the preceding embodiments, wherein the polypeptide further comprises a nuclear localization signal and/or a nucleolar localization signal.
32. The system of any of the preceding embodiments, wherein (a) comprises an RNA that encodes: (i) the polypeptide and (ii) a nuclear localization signal and/or a nucleolar localization signal.
33. The system of any of the preceding embodiments, wherein the RNA comprises a pseudoknot sequence, e.g., 5' of the heterologous object sequence.
34. The system of embodiment 33, wherein the RNA comprises a stem-loop sequence or a helix, 5' of the pseudoknot sequence.
35. The system of embodiment 33 or 34, wherein the RNA comprises one or more (e.g., 2, 3, or more) stem-loop sequences or helices 3' of the pseudoknot sequence, e.g. 3' of the pseudoknot sequence and 5' of the heterologous object sequence.
36. The system of any of embodiments 33-35, wherein the template RNA comprising the pseudoknot has catalytic activity, e.g., RNA-cleaving activity, e.g., cis-RNA-cleaving activity.
37. The system of any of the preceding embodiments, wherein the RNA comprises at least one stem-loop sequence or helix, e.g., 3' of the heterologous object sequence, e.g. 1, 2, 3, 4, 5 or more stem-loop sequences, hairpins or helices sequences.
38. Any above-numbered system, wherein the polypeptide comprises a sequence of at least 50 amino acids (e.g., at least 100, 150, 200, 300, 500 amino acids) having at least 80% identity (e.g., at least 85%, 90%, 95%, 97%, 98%, 99%, 100% identity) to a sequence of a polypeptide listed in Table 1, or a reverse transcriptase domain or endonuclease domain thereof.
39. Any above-numbered system, wherein the polypeptide comprises a sequence of at least 50 amino acids (e.g., at least 100, 150, 200, 300, 500 amino acids) having at least 80% identity (e.g., at least 85%, 90%, 95%, 97%, 98%, 99%, 100% identity) to a sequence of a polypeptide listed in any of Tables 2-3 or a reverse transcriptase domain, endonuclease domain, or DNA binding domain thereof.
40. Any above-numbered system, wherein the polypeptide comprises a sequence of at least 50 amino acids (e.g., at least 100, 150, 200, 300, 500 amino acids) having at least 80% identity (e.g., at least 85%, 90%, 95%, 97%, 98%, 99%, 100% identity) to the amino acid sequence of column 8 of Table 3, or a reverse transcriptase domain, endonuclease domain, or DNA binding domain thereof.
41. Any above-numbered system, wherein the template RNA comprises a sequence of Table 3 (e.g., one or both of a 5' untranslated region of column 6 of Table 3 and a 3' untranslated region of column 7 of Table 3), or a sequence having at least 70%, 75%, 80%, 85%, 90%, 95%, 96%, 97%, 98%, or 99% identity thereto.
42. The system of embodiment 41, wherein the template RNA comprises a sequence of about 100-125 bp from a 3' untranslated region of column 7 of Table 3, e.g., wherein the sequence comprises nucleotides 1-100, 101-200, or 201-325 of the 3' untranslated region of column 7 of Table 3, or a sequence having at least 70%, 75%, 80%, 85%, 90%, 95%, 96%, 97%, 98%, or 99% identity thereto.
43. Any above-numbered system, wherein (a) comprises RNA and (b) comprises RNA.
44. Any above-numbered system, which comprises only RNA, or which comprises more RNA than DNA by an RNA:DNA ratio of at least 10:1, 20:1, 30:1, 40:1, 50:1, 60:1, 70:1, 80:1, 90:1, or 100:1.
45. Any above-numbered system, which does not comprise DNA, or which does not comprise more than 10%, 5%, 4%, 3%, 2%, or 1% DNA by mass or by molar amount.
46. Any above-numbered system, which is capable of modifying DNA by insertion of the heterologous object sequence without an intervening DNA-dependent RNA polymerization of (b).
47. Any above-numbered system, which is capable of modifying DNA by insertion of a heterologous object sequence in the presence of an inhibitor of a DNA repair pathway (e.g., SCR7, a PARP inhibitor), or in a cell line deficient for a DNA repair pathway (e.g., a cell line deficient for the nucleotide excision repair pathway or the homology-directed repair pathway).
48. Any above-numbered system, which does not cause formation of a detectable level of double stranded breaks in a target cell.
49. Any above-numbered system, which is capable of modifying DNA using reverse transcriptase activity, and optionally in the absence of homologous recombination activity.
50. Any above-numbered system, wherein the template RNA has been treated to reduce secondary structure, e.g., was heated, e.g., to a temperature that reduces secondary structure, e.g., to at least 70, 75, 80, 85, 90, or 95 C.
51. The system of embodiment 50, wherein the template RNA was subsequently cooled, e.g., to a temperature that allows for secondary structure, e.g., to less than or equal to 30, 25, or 20 C
52. A system for modifying DNA comprising:
   (a) a polypeptide or a nucleic acid encoding a polypeptide, wherein the polypeptide comprises (i) a reverse transcriptase domain and (ii) an endonuclease domain; and
   (b) a template RNA (or DNA encoding the template RNA) comprising (i) a sequence that binds the polypeptide, (ii) a heterologous object sequence, (iii)

a first homology domain having at least 10 bases of 100% identity to a target DNA strand, at the 5' end of the template RNA, and (iv) a second homology domain having at least 10 bases of 100% identity to a target DNA strand, 5' end of the template RNA.

53. The system of any of the preceding embodiments, wherein (a) and (b) are part of the same nucleic acid.
54. The system of any of embodiments 1-52, wherein (a) and (b) are separate nucleic acids.
55. The system of any of the preceding embodiments, wherein the template RNA comprises at least 10 bases of 100% identity to a target DNA strand (e.g., wherein the target DNA strand is a human DNA sequence), at the 5' end of the template RNA.
56. The system of any of the preceding embodiments, wherein the template RNA comprises at least 10 bases of 100% identity to a target DNA strand (e.g., wherein the target DNA strand is a human DNA sequence), at the 3' end of the template RNA.
57. A host cell (e.g., a mammalian cell, e.g., a human cell) comprising any preceding numbered system.
58. A method of modifying a target DNA strand in a cell, tissue or subject, comprising administering any preceding numbered system to the cell, tissue or subject, wherein the system reverse transcribes the template RNA sequence into the target DNA strand, thereby modifying the target DNA strand.
59. The method of embodiment 58, wherein the cell, tissue or subject is a mammalian (e.g., human) cell, tissue or subject.
60. The method of any of the preceding embodiments, wherein the cell is a fibroblast.
61. The method of any of the preceding embodiments, wherein the cell is a primary cell.
62. The method of any of the preceeding embodiments, where in the cell is not immortalized.
63. A method of modifying the genome of a mammalian cell, comprising contacting the cell with:
    (a) a polypeptide or a nucleic acid encoding a polypeptide, wherein the polypeptide comprises (i) a reverse transcriptase domain, (ii) an endonuclease domain, and optionally (iii) a DNA-binding domain; and
    (b) a template RNA (or DNA encoding the template RNA) comprising (i) a sequence that binds the polypeptide and (ii) a heterologous object sequence.
64. The method of embodiment 63, wherein the polypeptide does not comprise a target DNA binding domain.
65. The method of embodiment 63, wherein the polypeptide is derived from an APE-type transposon reverse transcriptase.
66. The method of embodiment 63, wherein the (i) a reverse transcriptase domain (ii) an endonuclease domain, or both of (i) and (ii), have a sequence of Table 1 or a sequence having at least 80%, 85%, 90%, 95%, 97%, 98%, 99%, 100% identity thereto.
67. The method of embodiment 63, wherein the polypeptide further comprises a target DNA binding domain.
68. A method of modifying the genome of a mammalian cell, comprising contacting the cell with:
    (a) an RNA encoding a polypeptide, wherein the polypeptide comprises (i) a reverse transcriptase domain, (ii) an endonuclease domain, and optionally (iii) a DNA-binding domain; and
    (b) a template RNA comprising (i) a sequence that binds the polypeptide and (ii) a heterologous object sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid.
69. The method of embodiment 68, which results in the addition of at least 5, 10, 20, 50, 100, 200, 500, 1,000, 2,000, or 5,000 base pairs of exogenous DNA sequence to the genome of the mammalian cell.
70. The method of embodiment 68 or 69, which results in the addition of a protein coding sequence to the genome of the mammalian cell.
71. A method of inserting DNA into the genome of a mammalian cell, comprising contacting the cell with an RNA composition, wherein the RNA composition comprises:
    (a) a first RNA that directs insertion of a template RNA into the genome, and
    (b) a template RNA comprising a heterologous sequence, wherein the method does not comprise contacting the mammalian cell with DNA, or wherein the compositions of (a) and (b) do not comprise more than 1%, 0.5%, 0.2%, 0.1%, 0.05%, 0.02%, or 0.01% DNA by mass or by molar amount of nucleic acid, wherein the method results in the addition of at least 5, 10, 20, 50, 100, 200, 500, 1,000, 2,000, or 5,000 base pairs of DNA (e.g., exogenous DNA) sequence to the genome of the mammalian cell.
72. The method of embodiment 71, wherein the first RNA encodes a polypeptide (e.g., a polypeptide of any of Tables 1, 2, or 3 herein), wherein the polypeptide directs insertion of the template RNA into the genome.
73. The method of embodiments 72, wherein the template RNA further comprises a sequence that binds the polypeptide.
74. A method of adding at least 5, 10, 15, 20, 25, 30, 35, 40, 45, 50, 60, 70, 80, 90, 100, 150, 200, 250, 300, 350, 400, 500, 1000 bp of exogenous DNA to the genome of a mammalian cell, without delivery of DNA to the cell.
75. A method of adding at least 5, 10, 15, 20, 25, 30, 35, 40, 45, 50, 60, 70, 80, 90, 100, 150, 200, 250, 300, 350, 400, 500, 1000 bp of exogenous DNA to the genome of a mammalian cell, wherein the method does not comprise contacting the mammalian cell with DNA, or wherein the method comprises contacting the mammalian cell with a composition comprising less than 1%, 0.5%, 0.2%, 0.1%, 0.05%, 0.02%, or 0.01% DNA by mass or by molar amount of nucleic acid.
76. A method of adding at least 5, 10, 15, 20, 25, 30, 35, 40, 45, 50, 60, 70, 80, 90, 100, 150, 200, 250, 300, 350, 400, 500, 1000 bp of exogenous DNA to the genome of a mammalian cell, comprising delivering only RNA to the mammalian cell.
77. A method of adding at least 5, 10, 15, 20, 25, 30, 35, 40, 45, 50, 60, 70, 80, 90, 100, 150, 200, 250, 300, 350, 400, 500, 1000 bp of exogenous DNA to the genome of a mammalian cell, comprising delivering RNA and protein to the mammalian cell.
78. The method of any one of embodiments 68-77, wherein the template RNA serves as the template for insertion of the exogenous DNA.
79. The method of any one of embodiments 68-78, which does not comprise DNA-dependent RNA polymerization of exogenous DNA.
80. The method of any of embodiments 58-79, which results in the addition of at least 5, 10, 20, 50, 100, 200, 500, 1,000, 2,000, or 5,000 base pairs of DNA to the genome of the mammalian cell.

81. The methods of any of embodiments 68-80, wherein the RNA of (a) and the RNA of (b) are covalently linked, e.g., are part of the same transcript.

82. The methods of any of embodiments 68-80, wherein the RNA of (a) and the RNA of (b) are separate RNAs.

83. The method of any of embodiments 58-82, which does not comprise contacting the mammalian cell with a template DNA.

84. A method of modifying the genome of a human cell, comprising contacting the cell with:

(a) a polypeptide or a nucleic acid encoding a polypeptide, wherein the polypeptide comprises (i) a reverse transcriptase domain, (ii) an endonuclease domain, and optionally (iii) a DNA-binding domain; and (b) a template RNA (or DNA encoding the template RNA) comprising (i) a sequence that binds the polypeptide and (ii) a heterologous object sequence, wherein the method results in insertion of the heterologous object sequence into the human cell's genome, wherein the human cell does not show upregulation of any DNA repair genes and/or tumor suppressor genes, or wherein no DNA repair gene and/or tumor suppressor gene is upregulated by more than 10%, 5%, 2%, or 1%, e.g., wherein upregulation is measured by RNA-seq, e.g., as described in Example 14.

85. A method of adding an exogenous coding region to the genome of a cell (e.g., a mammalian cell), comprising contacting the cell with an RNA comprising the non-coding strand of the exogenous coding region, wherein optionally the RNA does not comprise a coding strand of the exogenous coding region, wherein optionally the delivery comprises non-viral delivery.

86. A method of expressing a polypeptide in a cell (e.g., a mammalian cell), comprising contacting the cell with an RNA, wherein the RNA comprises a non-coding strand that is the reverse complement of a sequence that would encoding the polypeptide, wherein optionally the RNA does not comprise a coding strand encoding the polypeptide, wherein optionally the delivery comprises non-viral delivery.

87. The method of any of embodiments 58-86, wherein the sequence that is inserted into the mammalian genome is a sequence that is exogenous to the mammalian genome.

88. The method of any of embodiments 58-87, which operates independently of a DNA template.

89. The method of any of embodiments 58-88, wherein the cell is part of a tissue.

90. The method of any of embodiments 58-89, wherein the mammalian cell is euploid, is not immortalized, is part of an organism, is a primary cell, is non-dividing, is a hepatocyte, or is from a subject having a genetic disease.

91. The method of any of embodiments 58-90, wherein the contacting comprises contacting the cell with a plasmid, virus, viral-like particle, virosome, liposome, vesicle, exosome, or lipid nanoparticle.

92. The method of any of embodiments 58-91, wherein the contacting comprises using non-viral delivery.

93. The method of any of embodiments 58-92, which comprises comprising contacting the cell with the template RNA (or DNA encoding the template RNA), wherein the template RNA comprises the non-coding strand of an exogenous coding region, wherein optionally the template RNA does not comprise a coding strand of the exogenous coding region, wherein optionally the delivery comprises non-viral delivery, thereby adding the exogenous coding region to the genome of the cell.

94. The method of any of embodiments 58-93, which comprises contacting the cell with the template RNA (or DNA encoding the template RNA), wherein the template RNA comprises a non-coding strand that is the reverse complement of a sequence that would encoding the polypeptide, wherein optionally the template RNA does not comprise a coding strand encoding the polypeptide, wherein optionally the delivery comprises non-viral delivery, thereby expressing the polypeptide in the cell.

95. The method of any of embodiments 63-94, wherein the contacting comprises administering (a) and (b) to a subject, e.g., intravenously.

96. The method of any of embodiments 63-95, wherein the contacting comprises administering a dose of (a) and (b) to a subject at least twice.

97. The method of any of embodiments 63-96, wherein the polypeptide reverse transcribes the template RNA sequence into the target DNA strand, thereby modifying the target DNA strand.

98. The method of any embodiments 63-97, wherein (a) and (b) are administered separately.

99. The method of any of embodiments 63-97, wherein (a) and (b) are administered together.

100. The method of any of embodiments 63-99, wherein the nucleic acid of (a) is not integrated into the genome of the host cell.

101. Any preceding numbered method, wherein the sequence that binds the polypeptide has one or more of the following characteristics:

(a) is at the 3' end of the template RNA;

(b) is at the 5' end of the template RNA;

(b) is a non-coding sequence;

(c) is a structured RNA; or (d) forms at least 1 hairpin loop structures.

102. Any preceding numbered method, wherein the template RNA further comprises a sequence comprising at least 20 nucleotides of at least 80% identity (e.g., at least 85%, 90%, 95%, 97%, 98%, 99%, 100% identity) to a target DNA strand.

103. Any preceding numbered method, wherein the template RNA further comprises a sequence comprising at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150 nucleotides of at least 80% identity (e.g., at least 85%, 90%, 95%, 97%, 98%, 99%, 100% identity) to a target DNA strand.

104. Any preceding numbered method, wherein the sequence comprising at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150 nucleotides, or about: 2-10, 10-20, 20-30, 30-40, 40-50, 50-60, 60-70, 70-80, 80-90, 90-100, 10-100, or 2-100 nucleotides, of at least 80% identity to a target DNA strand is at the 3' end of the template RNA.

105. Any preceding numbered method, wherein the template RNA further comprises a sequence comprising at least 100 nucleotides of at least 80% identity (e.g., at least 85%, 90%, 95%, 97%, 98%, 99%, 100% identity) to a target DNA strand, e.g., at the 3' end of the template RNA.

106. The method of embodiment 104 or 105, wherein the site in the target DNA strand to which the sequence comprises at least 80% identity is proximal to (e.g., within about: 0-10, 10-20, 20-30, 30-50, or 50-100 nucleotides of) a target site on the target DNA strand that is recognized (e.g., bound and/or cleaved) by the polypeptide comprising the endonuclease.
107. Any preceding numbered method, wherein the sequence comprising at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150 nucleotides, or about: 2-10, 10-20, 20-30, 30-40, 40-50, 50-60, 60-70, 70-80, 80-90, 90-100, 10-100, or 2-100 nucleotides, of at least 80% identity to a target DNA strand is at the 3' end of the template RNA;
    optionally wherein the site in the target DNA strand to which the sequence comprises at least 80% identity is proximal to (e.g., within about: 0-10, 10-20, or 20-30 nucleotides of) a target site on the target DNA strand that is recognized (e.g., bound and/or cleaved) by the polypeptide comprising the endonuclease.
108. The method of embodiment 107, wherein the target site is the site in the human genome that has the closest identity to a native target site of the polypeptide comprising the endonuclease, e.g., wherein the target site in the human genome has at least about: 16, 17, 18, 19, or 20 nucleotides identical to the native target site.
109. Any preceding numbered method, wherein the template RNA has at least 3, 4, 5, 6, 7, 8, 9, or 10 bases of 100% identity to the target DNA strand.
110. Any preceding numbered method, wherein the at least 3, 4, 5, 6, 7, 8, 9, or 10 bases of 100% identity to the target DNA strand are at the 3' end of the template RNA.
111. Any preceding numbered method, wherein the at least 3, 4, 5, 6, 7, 8, 9, or 10 bases of 100% identity to the target DNA strand are at the 5' end of the template RNA.
112. Any preceding numbered method, wherein the template RNA comprises at least 3, 4, 5, 6, 7, 8, 9, or 10 bases of 100% identity to the target DNA strand at the 5' end of the template RNA and at least 3, 4, 5, 6, 7, 8, 9, or 10 bases of 100% identity to the target DNA strand at the 3' end of the template RNA.
113. Any preceding numbered method, wherein the heterologous object sequence is between 50-50,000 base pairs (e.g., between 50-40,000 bp, between 500-30,000 bp between 500-20,000 bp, between 100-15,000 bp, between 500-10,000 bp, between 50-10,000 bp, between 50-5,000 bp).
114. Any preceding numbered method, wherein the heterologous object sequence is at least 10, 25, 50, 100, 150, 200, 250, 300, 400, 500, 600, or 700 bp.
115. Any preceding numbered method, wherein the heterologous object sequence is at least 715, 750, 800, 950, 1,000, 2,000, 3,000, or 4,000 bp.
116. Any preceding numbered method, wherein the heterologous object sequence is less than 5,000, 10,000, 15,000, 20,000, 30,000, or 40,000 bp.
117. Any preceding numbered method, wherein the heterologous object sequence is less than 700, 600, 500, 400, 300, 200, 150, or 100 bp.
118. Any preceding numbered method, wherein the heterologous object sequence comprises:
    (a) an open reading frame, e.g., a sequence encoding a polypeptide, e.g., an enzyme (e.g., a lysosomal enzyme), a membrane protein, a blood factor, an exon, an intracellular protein (e.g., a cytoplasmic protein, a nuclear protein, an organellar protein such as a mitochondrial protein or lysosomal protein), an extracellular protein, a structural protein, a signaling protein, a regulatory protein, a transport protein, a sensory protein, a motor protein, a defense protein, or a storage protein;
    (b) a non-coding and/or regulatory sequence, e.g., a sequence that binds a transcriptional modulator, e.g., a promoter, an enhancer, an insulator;
    (c) a splice acceptor site;
    (d) a polyA site;
    (e) an epigenetic modification site; or
    (f) a gene expression unit.
119. Any preceding numbered method, wherein the target DNA is a genomic safe harbor (GSH) site.
120. Any preceding numbered method, wherein the target DNA is a genomic NATURAL HARBOR™ site.
121. Any preceding numbered method, which results in insertion of the heterologous object sequence into the a target site in the genome at an average copy number of at least 0.01, 0.025, 0.05, 0.075, 0.1, 0.15, 0.2, 0.25, 0.3, 0.4, 0.5, 0.75, 1, 1.25, 1.5, 1.75, 2, 2.5, 3, 4, or 5 copies per genome.
122. Any preceding numbered method, which results in about 25-100%, 50-100%, 60-100%, 70-100%, 75-95%, 80%-90%, of integrants into a target site in the genome being non-truncated, as measured by an assay described herein, e.g., an assay of Example 6.
123. Any preceding numbered method, which results in insertion of the heterologous object sequence only at one target site in the genome of the cell.
124. Any preceding numbered method, which results in insertion of the heterologous object sequence into a target site in a cell, wherein the inserted heterologous sequence comprises less than 10%, 5%, 2%, 1%, 0.5%, 0.2%, or 0.1% mutations (e.g., SNPs or one or more deletions, e.g., truncations or internal deletions) relative to the heterologous sequence prior to insertion, e.g., as measured by an assay of Example 12.
125. Any preceding numbered method, which results in insertion of the heterologous object sequence into a target site in a plurality of cells, wherein less than 10%, 5%, 2%, or 1% of copies of the inserted heterologous sequence comprise a mutation (e.g., a SNP or a deletion, e.g., a truncation or an internal deletion), e.g., as measured by an assay of Example 12.
126. Any preceding numbered method, which results in insertion of the heterologous object sequence into a target cell genome, and wherein the target cell does not show upregulation of p53, or shows upregulation of p53 by less than 10%, 5%, 2%, or 1%, e.g., wherein upregulation of p53 is measured by p53 protein level, e.g., according to the method described in Example 30, or by the level of p53 phosphorylated at Ser15 and Ser20.
127. Any preceding numbered method, which results in insertion of the heterologous object sequence into a target cell genome, and wherein the target cell does not show upregulation of any DNA repair genes and/or tumor suppressor genes, or wherein no DNA repair gene and/or tumor suppressor gene is upregulated by more than 10%, 5%, 2%, or 1%, e.g., wherein upregulation is measured by RNA-seq, e.g., as described in Example 14.
128. Any preceding numbered method, which results in insertion of the heterologous object sequence into the target site (e.g., at a copy number of 1 insertion or more than one insertion) in about 1-80% of cells in a population of cells contacted with the system, e.g., about: 1-10%, 10-20%, 20-30%, 30-40%, 40-50%, 50-60%, 60-70%, or 70-80% of cells, e.g., as measured using single cell ddPCR, e.g., as described in Example 17.

129. Any preceding numbered method, which results in insertion of the heterologous object sequence into the target site at a copy number of 1 insertion in about 1-80% of cells in a population of cells contacted with the system, e.g., about: 1-10%, 10-20%, 20-30%, 30-40%, 40-50%, 50-60%, 60-70%, or 70-80% of cells, e.g., as measured using colony isolation and ddPCR, e.g., as described in Example 18.

130. Any preceding numbered method, which results in insertion of the heterologous object sequence into the target site (on-target insertions) at a higher rate that insertion into a non-target site (off-target insertions) in a population of cells, wherein the ratio of on-target insertions to off-target insertions is greater than 10:1, 20:1, 30:1, 40:1, 50:1, 60:1, 70:1, 80:1. 90:1, 100:1, 200:1, 500:1, or 1,000:1, e.g., using an assay of Example 11.

131. Any above-numbered method, results in insertion of a heterologous object sequence in the presence of an inhibitor of a DNA repair pathway (e.g., SCR7, a PARP inhibitor), or in a cell line deficient for a DNA repair pathway (e.g., a cell line deficient for the nucleotide excision repair pathway or the homology-directed repair pathway).

132. Any preceding numbered system, formulated as a pharmaceutical composition.

133. Any preceding numbered system, disposed in a pharmaceutically acceptable carrier (e.g., a vesicle, a liposome, a natural or synthetic lipid bilayer, a lipid nanoparticle, an exosome).

134. A method of making a system for modifying the genome of a mammalian cell, comprising:
  a) providing a template RNA as described in any of the preceding embodiments, e.g., wherein the template RNA comprises (i) a sequence that binds a polypeptide comprising a reverse transcriptase domain and an endonuclease domain, and (ii) a heterologous object sequence; and
  b) treating the template RNA to reduce secondary structure, e.g., heating the template RNA, e.g., to at least 70, 75, 80, 85, 90, or 95 C, and
  c) subsequently cooling the template RNA, e.g., to a temperature that allows for secondary structure, e.g., to less than or equal to 30, 25, or 20 C.

135. The method of embodiment 134, which further comprises contacting the template RNA with a polypeptide that comprises (i) a reverse transcriptase domain and (ii) an endonuclease domain, or with a nucleic acid (e.g., RNA) encoding the polypeptide.

136. The method of embodiment 134 or 135, which further comprises contacting the template RNA with a cell.

137. The system or method of any of the preceding embodiments, wherein the heterologous object sequence encodes a therapeutic polypeptide.

138. The system or method of any of the preceding embodiments, wherein the heterologous object sequence encodes a mammalian (e.g., human) polypeptide, or a fragment or variant thereof.

139. The system or method of any of the preceding embodiments, wherein the heterologous object sequence encodes an enzyme (e.g., a lysosomal enzyme), a blood factor (e.g., Factor I, II, V, VII, X, XI, XII or XIII), a membrane protein, an exon, an intracellular protein (e.g., a cytoplasmic protein, a nuclear protein, an organellar protein such as a mitochondrial protein or lysosomal protein), an extracellular protein, a structural protein, a signaling protein, a regulatory protein, a transport protein, a sensory protein, a motor protein, a defense protein, or a storage protein.

140. The system or method of any of the preceding embodiments, wherein the heterologous object sequence comprises a tissue specific promoter or enhancer.

141. The system or method of any of the preceding embodiments, wherein the heterologous object sequence encodes a polypeptide of greater than 250, 300, 400, 500, or 1,000 amino acids, and optionally up to 1300 amino acids.

142. The system or method of any of the preceding embodiments, wherein the heterologous object sequence encodes a fragment of a mammalian gene but does not encode the full mammalian gene, e.g., encodes one or more exons but does not encode a full-length protein.

143. The system or method of any of the preceding embodiments, wherein the heterologous object sequence encodes one or more introns.

144. The system or method of any of the preceding embodiments, wherein the heterologous object sequence is other than a GFP, e.g., is other than a fluorescent protein or is other than a reporter protein.

145. The system or method of any of the preceding embodiments, wherein the polypeptide comprises (i) a reverse transcriptase domain and (ii) an endonuclease domain, wherein one or both of (i) or (ii) are derived from an avian retrotransposase, e.g., have a sequence of Table 2 or 3 or at least 70%, 75%, 80%, 85%, 90%, 95%, 96%, 97%, 98%, or 99% identity thereto.

146. The system or method of any of the preceding embodiments, wherein the polypeptide has an activity at 37° C. that is no less than 70%, 75%, 80%, 85%, 90%, or 95% of its activity at 25° C. under otherwise similar conditions.

147. The system or method of any of the preceding embodiments, wherein the nucleic acid encoding the polypeptide and the template RNA or a nucleic acid encoding the template RNA are separate nucleic acids.

148. The system or method of any of the preceding embodiments, wherein the template RNA does not encode an active reverse transcriptase, e.g., comprises an inactivated mutant reverse transcriptase, e.g., as described in Example 1 or 2, or does not comprise a reverse transcriptase sequence.

149. The system or method of any of the preceding embodiments, wherein the template RNA comprises one or more chemical modifications.

150. The system or method of any of the preceding embodiments, wherein the heterologous object sequence is disposed between the promoter and the sequence that binds the polypeptide.

151. The system or method of any of the preceding embodiments, wherein the promoter is disposed between the heterologous object sequence and the sequence that binds the polypeptide.

152. The system or method of any of the preceding embodiments, wherein the heterologous object sequence comprises an open reading frame (or the reverse complement thereof) in a 5' to 3' orientation on the template RNA.

153. The system or method of any of the preceding embodiments, wherein the heterologous object sequence comprises an open reading frame (or the reverse complement thereof) in a 3' to 5' orientation on the template RNA.

154. The system or method of any of the preceding embodiments, wherein the polypeptide comprises (a) a reverse transcriptase domain and (b) an endonuclease domain, wherein at least one of (a) or (b) is heterologous.

155. The system or method of any of the preceding embodiments, wherein the polypeptide comprises (a) a target DNA binding domain, (b) a reverse transcriptase domain and (c) an endonuclease domain, wherein at least one of (a), (b) or (c) is heterologous.

156. A substantially pure polypeptide comprising (a) a reverse transcriptase domain and (b) a heterologous endonuclease domain.

157. A substantially pure polypeptide comprising (a) a target DNA binding domain, (b) a reverse transcriptase domain and (c) an endonuclease domain, wherein at least one of (a), (b) or (c) is heterologous.

158. A substantially pure polypeptide comprising (a) a reverse transcriptase domain, (b) an endonuclease domain, and (c) a heterologous target DNA binding domain.

159. A polypeptide or a nucleic acid encoding the polypeptide, wherein the polypeptide comprises (a) a reverse transcriptase domain and (b) an endonuclease domain, wherein at least one of (a) or (b) is heterologous to the other.

160. A polypeptide or a nucleic acid encoding the polypeptide, wherein the polypeptide comprises (a) a target DNA binding domain, (b) a reverse transcriptase domain and (c) an endonuclease domain, wherein at least one of (a), (b) or (c) is heterologous to the other.

161. Any polypeptide of numbered embodiments 156-160, wherein the reverse transcriptase domain has at least 80% identity (e.g., at least 85%, 90%, 95%, 97%, 98%, 99%, 100% identity) to a reverse transcriptase domain of an APE-type or RLE-type non-LTR retrotransposon listed in any of Tables 1-3.

162. Any polypeptide of numbered embodiments 156-161, wherein the endonuclease domain has at least 80% identity e.g., at least 85%, 90%, 95%, 97%, 98%, 99%, 100% identity, to a endonuclease domain of an APE-type or RLE-type non-LTR retrotransposon listed in any of Tables 1-3.

163. Any polypeptide of numbered embodiments 156-162 or any preceding numbered method, wherein the DNA binding domain has at least 80% identity e.g., at least 85%, 90%, 95%, 97%, 98%, 99%, 100% identity, to a DNA binding domain of a sequence listed in Table 1, 2, or 3.

164. A nucleic acid encoding the polypeptide of any preceding numbered embodiment.

165. A vector comprising the nucleic acid of numbered embodiment 164.

166. A host cell comprising the nucleic acid of numbered embodiment 164.

167. A host cell comprising the polypeptide of any preceding numbered embodiment.

168. A host cell comprising the vector of numbered embodiment 165.

169. A host cell (e.g., a human cell) comprising: (i) a heterologous object sequence (e.g., a sequence encoding a therapeutic polypeptide) at a target site in a chromosome, and (ii) one or both of an untranslated region (e.g., a retrotransposon untranslated sequence, e.g., a sequence of column 6 of Table 3) on one side (e.g., upstream) of the heterologous object sequence, and an untranslated region (e.g., a retrotransposon untranslated sequence, e.g., a sequence of column 7 of Table 3) on the other side (e.g., downstream) of the heterologous object sequence.

170. A host cell (e.g., a human cell) comprising: (i) a heterologous object sequence (e.g., a sequence encoding a therapeutic polypeptide) at a target site in a chromosome, wherein the target locus is a NATURAL HARBOR™ site, e.g., a site of Table 4 herein.

171. The host cell of embodiment 170, which further comprises (ii) one or both of an untranslated region 5' of the heterologous object sequence, and an untranslated region 3' of the heterologous object sequence.

172. The host cell of embodiment 170, which further comprises (ii) one or both of an untranslated region (e.g., a retrotransposon untranslated sequence, e.g., a sequence of column 6 of Table 3) on one side (e.g., upstream) of the heterologous object sequence, and an untranslated region (e.g., a retrotransposon untranslated sequence, e.g., a sequence of column 7 of Table 3) on the other side (e.g., downstream) of the heterologous object sequence.

173. The host cell of any of embodiments 169-173, which comprises heterologous object sequence at only the target site.

174. A pharmaceutical composition, comprising any preceding numbered system, nucleic acid, polypeptide, or vector; and a pharmaceutically acceptable excipient or carrier.

175. The pharmaceutical composition of embodiment 174, wherein the pharmaceutically acceptable excipient or carrier is selected from a vector (e.g., a viral or plasmid vector), a vesicle (e.g., a liposome, an exosome, a natural or synthetic lipid bilayer), a lipid nanoparticle.

176. A polypeptide of any of the preceding embodiments, wherein the polypeptide further comprises a nuclear localization sequence.

177. A method of modifying a target DNA strand in a cell, tissue or subject, comprising administering any preceding numbered system to the cell, tissue or subject, thereby modifying the target DNA strand.

178. Any preceding numbered embodiment, wherein the polypeptide comprises an amino acid sequence having at least 70%, 75%, 80%, 85%, 90%, 95%, 96%, 97%, 98%, 99%, or 100% sequence identity to an amino acid sequence listed in Table 5 (e.g., any one of SEQ ID NOs: 1017-1022), or a functional fragment thereof.

179. Any preceding numbered embodiment, wherein the reverse transcriptase domain comprises an amino acid sequence having at least 70%, 75%, 80%, 85%, 90%, 95%, 96%, 97%, 98%, 99%, or 100% sequence identity to the reverse transcriptase domain of an amino acid sequence listed in Table 5 (e.g., any one of SEQ ID NOs: 1017-1022), or a functional fragment thereof.

180. Any preceding numbered embodiment, wherein the retrotransposase comprises an amino acid sequence having at least 70%, 75%, 80%, 85%, 90%, 95%, 96%, 97%, 98%, 99%, or 100% sequence identity to an amino acid sequence listed in Table 5 (e.g., any one of SEQ ID NOs: 1017-1022), or a functional fragment thereof.

181. Any preceding numbered embodiment, wherein the polypeptide comprises an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

182. Any preceding numbered embodiment, wherein the reverse transcriptase domain comprises an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

183. Any preceding numbered embodiment, wherein the retrotransposase comprises an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

184. Any preceding numbered embodiment, wherein the polypeptide, reverse transcriptase domain, or retrotransposase comprises a linker comprising an amino acid sequence having at least 70%, 75%, 80%, 85%, 90%, 95%, 96%, 97%, 98%, 99%, or 100% sequence identity to the amino acid sequence SGSETPGTS-ESATPES (SEQ ID NO: 1023) or GGGS (SEQ ID NO: 1024).

185. Any preceding numbered embodiment, wherein the polypeptide comprises a DNA binding doman covalently attached to the remainder of the polypeptide by a linker, e.g., a linker comprising at least 1, 2, 3, 4, 5, 6, 7, 8, 9, 10, 11, 12, 13, 14, 15, 16, 17, 18, 19, 20, 25, 30, 35, 40, 45, 50, 60, 70, 80, 90, 100, 125, 150, 200, 300, 400, or 500 amino acids.

186. Numbered embodiment 185, wherein the linker is attached to the remainder of the polypeptide at a position in the DNA binding domain, RNA binding domain, reverse transcriptase domain, or endonuclease domain (e.g., as shown in any of FIGS. 17A-17F).

187. Numbered embodiment 185 or 186, wherein the linker is attached to the remainder of the polypeptide at a position in the N-terminal side of an alpha helical region of the polypeptide, e.g., at a position corresponding to version v1 as described in Example 26.

188. Numbered embodiment 185 or 186, wherein the linker is attached to the remainder of the polypeptide at a position in the C-terminal side of an alpha helical region of the polypeptide, e.g., preceding an RNA binding motif (e.g., a −1 RNA binding motif), e.g., at a position corresponding to version v2 as described in Example 26.

189. Numbered embodiment 185 or 186, wherein the linker is attached to the remainder of the polypeptide at a position in the C-terminal side of a random coil region of the polypeptide, e.g., N-terminal relative to a DNA binding motif (e.g., a c-myb DNA binding motif), e.g., at a position corresponding to version v3 as described in Example 26.

190. Any one of numbered embodiments 185-189, wherein the linker comprises an amino acid sequence having at least 70%, 75%, 80%, 85%, 90%, 95%, 96%, 97%, 98%, 99%, or 100% sequence identity to the amino acid sequence SGSETPGTSESATPES (SEQ ID NO: 1023) or GGGS (SEQ ID NO: 1024).

191. Any preceding numbered embodiment, wherein a polynucleotide sequence comprising at least about 500, 1000, 2000, 3000, 3500, 3600, 3700, 3800, 3900, or 4000 contiguous nucleotides from the 5' end of the template RNA sequence are integrated into a target cell genome.

192. Any preceding numbered embodiment, wherein a polynucleotide sequence comprising at least about 500, 1000, 2000, 2500, 2600, 2700, 2800, 2900, or 3000 contiguous nucleotides from the 3' end of the template RNA sequence are integrated into a target cell genome.

193. Any preceding numbered embodiment, wherein the nucleic acid sequence of the template RNA, or a portion thereof (e.g., a portion comprising at least about 100, 200, 300, 400, 500, 1000, 2000, 2500, 3000, 3500, or 4000 nucleotides) integrates into the genomes of a population of target cells at a copy number of at least about 0.21, 0.3, 0.4, 0.5, 0.6, 0.7, 0.8, 0.9, or 1.0 integrants/genome.

194. Any preceding numbered embodiment, wherein the nucleic acid sequence of the template RNA, or a portion thereof (e.g., a portion comprising at least about 100, 200, 300, 400, 500, 1000, 2000, 2500, 3000, 3500, or 4000 nucleotides) integrates into the genomes of a population of target cells at a copy number of at least about 0.085, 0.09, 0.1, 0.15, or 0.2 integrants/genome.

195. Any preceding numbered embodiment, wherein the nucleic acid sequence of the template RNA, or a portion thereof (e.g., a portion comprising at least about 100, 200, 300, 400, 500, 1000, 2000, 2500, 3000, 3500, or 4000 nucleotides) integrates into the genomes of a population of target cells at a copy number of at least about 0.036, 0.04, 0.05, 0.06, 0.07, or 0.08 integrants/genome.

196. Any preceding numbered embodiment, wherein the polypeptide comprises a functional endonuclease domain (e.g., wherein the endonuclease domain does not comprise a mutation that abolishes endonuclease activity, e.g., as described herein).

197. Any preceding numbered embodiment, wherein the polypeptide comprises an amino acid sequence having at least 70%, 75%, 80%, 85%, 90%, 95%, 96%, 97%, 98%, 99%, or 100% sequence identity to the R2 polypeptide from a medium ground finch, e.g., *Geospiza fortis* (e.g., as described herein, e.g., R2-1_GFo), or a functional fragment thereof.

198. Any preceding numbered embodiment, wherein the reverse transcriptase domain comprises an amino acid sequence having at least 70%, 75%, 80%, 85%, 90%, 95%, 96%, 97%, 98%, 99%, or 100% sequence identity to the R2 polypeptide from a medium ground finch, e.g., *Geospiza fortis* (e.g., as described herein, e.g., R2-1_GFo), or a functional fragment thereof.

199. Any preceding numbered embodiment, wherein the retrotransposase comprises an amino acid sequence having at least 70%, 75%, 80%, 85%, 90%, 95%, 96%, 97%, 98%, 99%, or 100% sequence identity to the R2 polypeptide from a medium ground finch, e.g., *Geospiza fortis* (e.g., as described herein, e.g., R2-1_GFo), or a functional fragment thereof.

200. Any one of numbered embodiments 197-199, wherein the nucleic acid sequence of the template RNA, or a portion thereof (e.g., a portion comprising at least about 100, 200, 300, 400, 500, 1000, 2000, 2500, 3000, 3500, or 4000 nucleotides) integrates into the genomes of a population of target cells at a copy number of at least about 0.21 integrants/genome.

201. Any preceding numbered embodiment, wherein the polypeptide comprises an amino acid sequence having at least 70%, 75%, 80%, 85%, 90%, 95%, 96%, 97%, 98%, 99%, or 100% sequence identity to the R4 polypeptidefrom a large roundworm, e.g., *Ascaris lumbricoides* (e.g., as described herein, e.g., R4_AL), or a functional fragment thereof.
202. Any preceding numbered embodiment, wherein the reverse transcriptase domain comprises an amino acid sequence having at least 70%, 75%, 80%, 85%, 90%, 95%, 96%, 97%, 98%, 99%, or 100% sequence identity to the R4 polypeptidefrom a large roundworm, e.g., *Ascaris lumbricoides* (e.g., as described herein, e.g., R4_AL), or a functional fragment thereof.
203. Any preceding numbered embodiment, wherein the retrotransposase comprises an amino acid sequence having at least 70%, 75%, 80%, 85%, 90%, 95%, 96%, 97%, 98%, 99%, or 100% sequence identity to the R4 polypeptidefrom a large roundworm, e.g., *Ascaris lumbricoides* (e.g., as described herein, e.g., R4_AL), or a functional fragment thereof.
204. Any one of numbered embodiments 201-203, wherein the nucleic acid sequence of the template RNA, or a portion thereof (e.g., a portion comprising at least about 100, 200, 300, 400, 500, 1000, 2000, 2500, 3000, 3500, or 4000 nucleotides) integrates into the genomes of a population of target cells at a copy number of at least about 0.085 integrants/genome.
205. Any preceding numbered embodiment, wherein introduction of the system into a target cell does not result in alteration (e.g., upregulation) of p53 and/or p21 protein levels, H2AX phosphorylation (e.g., gamma H2AX), ATM phosphorylation, ATR phosphorylation, Chk1 phosphorylation, Chk2 phosphorylation, and/or p53 phosphorylation.
206. Any preceding numbered embodiment, wherein introduction of the system into a target cell results in upregulation of p53 protein level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the p53 protein level induced by introducing a site-specific nuclease, e.g., Cas9, that targets the same genomic site as said system.
207. Numbered embodiment 205 or 206, wherein the p53 protein level is determined according to the method described in Example 30.
208. Any preceding numbered embodiment, wherein introduction of the system into a target cell results in upregulation of p53 phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the p53 phosphorylation level induced by introducing a site-specific nuclease, e.g., Cas9, that targets the same genomic site as said system.
209. Any preceding numbered embodiment, wherein introduction of the system into a target cell results in upregulation of p21 protein level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the p53 protein level induced by introducing a site-specific nuclease, e.g., Cas9, that targets the same genomic site as said system.
210. Numbered embodiment 205 or 209, wherein the p21 protein level is determined according to the method described in Example 30.
211. Any preceding numbered embodiment, wherein introduction of the system into a target cell results in upregulation of H2AX phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the H2AX phosphorylation level induced by introducing a site-specific nuclease, e.g., Cas9, that targets the same genomic site as said system.
212. Any preceding numbered embodiment, wherein introduction of the system into a target cell results in upregulation of ATM phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the ATM phosphorylation level induced by introducing a site-specific nuclease, e.g., Cas9, that targets the same genomic site as said system.
213. Any preceding numbered embodiment, wherein introduction of the system into a target cell results in upregulation of ATR phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the ATR phosphorylation level induced by introducing a site-specific nuclease, e.g., Cas9, that targets the same genomic site as said system.
214. Any preceding numbered embodiment, wherein introduction of the system into a target cell results in upregulation of Chk1 phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the Chk1 phosphorylation level induced by introducing a site-specific nuclease, e.g., Cas9, that targets the same genomic site as said system.
215. Any preceding numbered embodiment, wherein introduction of the system into a target cell results in upregulation of Chk2 phosphorylation level in the target cell to a level that is less than about 0.001%, 0.005%, 0.01%, 0.05%, 0.1%, 0.5%, 1%, 2%, 3%, 4%, 5%, 6%, 7%, 8%, 9%, 10%, 15%, 20%, 30%, 40%, 45%, 50%, 55%, 60%, 70%, 80%, or 90% of the Chk2 phosphorylation level induced by introducing a site-specific nuclease, e.g., Cas9, that targets the same genomic site as said system.

Definitions

Domain: The term "domain" as used herein refers to a structure of a biomolecule that contributes to a specified function of the biomolecule. A domain may comprise a contiguous region (e.g., a contiguous sequence) or distinct, non-contiguous regions (e.g., non-contiguous sequences) of a biomolecule. Examples of protein domains include, but are not limited to, an endonuclease domain, a DNA binding domain, a reverse transcription domain; an example of a domain of a nucleic acid is a regulatory domain, such as a transcription factor binding domain.

Exogenous: As used herein, the term exogenous, when used with reference to a biomolecule (such as a nucleic acid sequence or polypeptide) means that the biomolecule was introduced into a host genome, cell or organism by the hand of man. For example, a nucleic acid that is as added into an existing genome, cell, tissue or subject using recombinant DNA techniques or other methods is exogenous to the existing nucleic acid sequence, cell, tissue or subject.

Genomic safe harbor site (GSH site): A genomic safe harbor site is a site in a host genome that is able to accommodate the integration of new genetic material, e.g., such that the inserted genetic element does not cause significant alterations of the host genome posing a risk to the host cell or organism. A GSH site generally meets 1, 2, 3, 4, 5, 6, 7, 8 or 9 of the following criteria: (i) is located >300 kb from a cancer-related gene; (ii) is >300 kb from a miRNA/other functional small RNA; (iii) is >50 kb from a 5' gene end; (iv) is >50 kb from a replication origin; (v) is >50 kb away from any ultraconservered element; (vi) has low transcriptional activity (i.e. no mRNA+/−25 kb); (vii) is not in copy number variable region; (viii) is in open chromatin; and/or (ix) is unique, with 1 copy in the human genome. Examples of GSH sites in the human genome that meet some or all of these criteria include (i) the adeno-associated virus site 1 (AAVS1), a naturally occurring site of integration of AAV virus on chromosome 19; (ii) the chemokine (C-C motif) receptor 5 (CCR5) gene, a chemokine receptor gene known as an HIV-1 coreceptor; (iii) the human ortholog of the mouse Rosa26 locus; (iv) the rDNA locus. Additional GSH sites are known and described, e.g., in Pellenz et al. epub Aug. 20, 2018 (doi.org/10.1101/396390).

Heterologous: The term heterologous, when used to describe a first element in reference to a second element means that the first element and second element do not exist in nature disposed as described. For example, a heterologous polypeptide, nucleic acid molecule, construct or sequence refers to (a) a polypeptide, nucleic acid molecule or portion of a polypeptide or nucleic acid molecule sequence that is not native to a cell in which it is expressed, (b) a polypeptide or nucleic acid molecule or portion of a polypeptide or nucleic acid molecule that has been altered or mutated relative to its native state, or (c) a polypeptide or nucleic acid molecule with an altered expression as compared to the native expression levels under similar conditions. For example, a heterologous regulatory sequence (e.g., promoter, enhancer) may be used to regulate expression of a gene or a nucleic acid molecule in a way that is different than the gene or a nucleic acid molecule is normally expressed in nature. In another example, a heterologous domain of a polypeptide or nucleic acid sequence (e.g., a DNA binding domain of a polypeptide or nucleic acid encoding a DNA binding domain of a polypeptide) may be disposed relative to other domains or may be a different sequence or from a different source, relative to other domains or portions of a polypeptide or its encoding nucleic acid. In certain embodiments, a heterologous nucleic acid molecule may exist in a native host cell genome, but may have an altered expression level or have a different sequence or both. In other embodiments, heterologous nucleic acid molecules may not be endogenous to a host cell or host genome but instead may have been introduced into a host cell by transformation (e.g., transfection, electroporation), wherein the added molecule may integrate into the host genome or can exist as extra-chromosomal genetic material either transiently (e.g., mRNA) or semi-stably for more than one generation (e.g., episomal viral vector, plasmid or other self-replicating vector).

Mutation or Mutated: The term "mutated" when applied to nucleic acid sequences means that nucleotides in a nucleic acid sequence may be inserted, deleted or changed compared to a reference (e.g., native) nucleic acid sequence. A single alteration may be made at a locus (a point mutation) or multiple nucleotides may be inserted, deleted or changed at a single locus. In addition, one or more alterations may be made at any number of loci within a nucleic acid sequence. A nucleic acid sequence may be mutated by any method known in the art.

Nucleic acid molecule: Nucleic acid molecule refers to both RNA and DNA molecules including, without limitation, cDNA, genomic DNA and mRNA, and also includes synthetic nucleic acid molecules, such as those that are chemically synthesized or recombinantly produced, such as RNA templates, as described herein. The nucleic acid molecule can be double-stranded or single-stranded, circular or linear. If single-stranded, the nucleic acid molecule can be the sense strand or the antisense strand. Unless otherwise indicated, and as an example for all sequences described herein under the general format "SEQ. ID NO," "nucleic acid comprising SEQ. ID NO:1" refers to a nucleic acid, at least a portion which has either (i) the sequence of SEQ. ID NO:1, or (ii) a sequence complimentary to SEQ. ID NO:1. The choice between the two is dictated by the context in which SEQ. ID NO:1 is used. For instance, if the nucleic acid is used as a probe, the choice between the two is dictated by the requirement that the probe be complimentary to the desired target. Nucleic acid sequences of the present disclosure may be modified chemically or biochemically or may contain non-natural or derivatized nucleotide bases, as will be readily appreciated by those of skill in the art. Such modifications include, for example, labels, methylation, substitution of one or more naturally occurring nucleotides with an analog, inter-nucleotide modifications such as uncharged linkages (for example, methyl phosphonates, phosphotriesters, phosphoramidates, carbamates, etc.), charged linkages (for example, phosphorothioates, phosphorodithioates, etc.), pendant moieties, (for example, polypeptides), intercalators (for example, acridine, psoralen, etc.), chelators, alkylators, and modified linkages (for example, alpha anomeric nucleic acids, etc.). Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of a molecule. Other modifications can include, for example, analogs in which the ribose ring contains a bridging moiety or other structure such as modifications found in "locked" nucleic acids.

Gene expression unit: a gene expression unit is a nucleic acid sequence comprising at least one regulatory nucleic acid sequence operably linked to at least one effector sequence. A first nucleic acid sequence is operably linked with a second nucleic acid sequence when the first nucleic acid sequence is placed in a functional relationship with the second nucleic acid sequence. For instance, a promoter or enhancer is operably linked to a coding sequence if the promoter or enhancer affects the transcription or expression of the coding sequence. Operably linked DNA sequences may be contiguous or non-contiguous. Where necessary to join two protein-coding regions, operably linked sequences may be in the same reading frame.

Host: The terms host genome or host cell, as used herein, refer to a cell and/or its genome into which protein and/or genetic material has been introduced. It should be understood that such terms are intended to refer not only to the particular subject cell and/or genome, but to the progeny of such a cell and/or the genome of the progeny of such a cell.

Because certain modifications may occur in succeeding generations due to either mutation or environmental influences, such progeny may not, in fact, be identical to the parent cell, but are still included within the scope of the term "host cell" as used herein. A host genome or host cell may be an isolated cell or cell line grown in culture, or genomic material isolated from such a cell or cell line, or may be a host cell or host genome which composing living tissue or an organism. In some instances, a host cell may be an animal cell or a plant cell, e.g., as described herein. In certain instances, a host cell may be a bovine cell, horse cell, pig cell, goat cell, sheep cell, chicken cell, or turkey cell. In certain instances, a host cell may be a corn cell, soy cell, wheat cell, or rice cell.

Pseudoknot: A "pseudoknot sequence" sequence, as used herein, refers to a nucleic acid (e.g., RNA) having a sequence with suitable self-complementarity to form a pseudoknot structure, e.g., having: a first segment, a second segment between the first segment and a third segment, wherein the third segment is complementary to the first segment, and a fourth segment, wherein the fourth segment is complementary to the second segment. The pseudoknot may optionally have additional secondary structure, e.g., a stem loop disposed in the second segment, a stem-loop disposed between the second segment and third segment, sequence before the first segment, or sequence after the fourth segment. The pseudoknot may have additional sequence between the first and second segments, between the second and third segments, or between the third and fourth segments. In some embodiments, the segments are arranged, from 5' to 3': first, second, third, and fourth. In some embodiments, the first and third segments comprise five base pairs of perfect complementarity. In some embodiments, the second and fourth segments comprise 10 base pairs, optionally with one or more (e.g., two) bulges. In some embodiments, the second segment comprises one or more unpaired nucleotides, e.g., forming a loop. In some embodiments, the third segment comprises one or more unpaired nucleotides, e.g., forming a loop.

Stem-loop sequence: As used herein, a "stem-loop sequence" refers to a nucleic acid sequence (e.g., RNA sequence) with sufficient self-complementarity to form a stem-loop, e.g., having a stem comprising at least two (e.g., 3, 4, 5, 6, 7, 8, 9, or 10) base pairs, and a loop with at least three (e.g., four) base pairs. The stem may comprise mismatches or bulges.

BRIEF DESCRIPTION OF THE DRAWINGS

FIG. 8A shows that most sequences show high alignment to the expected integration product.

FIG. 15A: Hybrid capture of R2Tg identified on-target integrations in the human genome. The read coverage as aligned to the expected target integration in the R2 ribosomal site is indicated on the y-axis. The 5' junction between rDNA and R2Tg is indicated by the left vertical line, while the 3' junction is indicated by the right vertical line. Next-generation sequencing identifies reads spanning the expected junctions. FIG. 15B shows the number of reads from this experiment categorized as on-target integration or off-target integration at the 5' end and 3' end of the integrated sequence.

FIG. 16 discloses SEQ ID NO: 1538.

FIG. 17A: a wild-type full length enzyme. FIG. 17B, two full-length enzymes (each comprising a DNA-binding domain, an RNA-binding domain, a reverse transcriptase domain, and an endonuclease domain) connected by a linker. FIG. 17C, a DNA binding domain and an RNA binding domain connected by a linker to a full-length enzyme. FIG. 17D, a DNA-binding domain and an RNA-binding domain connected by a linker to an RNA-binding domain, a reverse transcriptase domain, and an endonuclease domain. FIG. 17E, a DNA-binding domain connected by a first linker to an RNA-binding domain, which is connected by a second linker to a second RNA-binding domain, a reverse transcriptase domain, and an endonuclease domain. FIG. 17F, a DNA-binding domain connected by a first linker to an RNA-binding domain, which is connected by a second linker to a plurality of RNA-binding domains (in this figure, the molecule comprises three RNA-binding domains), which are connected by a linker to a reverse transcriptase domain and an endonuclease domain. In some embodiments, each R2 binds UTRs in the template RNA. In some embodiments, at least one module comprises a reverse transcriptase domain and an endonuclease domain. In some embodiments, the protein comprises a plurality of RNA-binding domains. In some embodiments, the modular system is split and is only active when it binds on DNA where the system uses two different DNA binding modules, e.g., a first protein comprising a first DNA binding module that is fused to an RNA binding module that recruits the RNA template for target primed reverse transcription, and second protein that comprises a second DNA binding module that binds at the site of intergration and is fused to the reverse transcription and endonuclease modules. In some embodiments, the nucleic acid encoding the GENE WRITER™ comprises an intein such that the GENE WRITER™ protein is expressed from two separate genes and is fused by protein splicing after being translated. In some embodiments, the GENE WRITER™ is derived from a non-LTR protein, e.g., an R2 protein.

FIGS. 18A-18F are a schematic diagram showing different modular components of a GENE WRITER™ protein. The proteins depicted are: FIG. 18A: a wild-type full length enzyme. FIG. 18B: the DNA-binding domain of a GENE WRITER™ may comprise zinc fingers, Cas9, or a transcription factor, or a fragment or variant of any of the forgoing. FIG. 18C: the reverse transcriptase domain and RNA-binding domain together may comprise a reverse transcriptase domain (e.g., from an R2 protein) that is heterologous to one or more other domains of the protein, and may optionally further comprise one or more additional RNA binding domains, or a fragment or variant of any of the foregoing. FIG. 18D: the RNA binding domain may comprise, e.g., a B-box protein, an MS2 coat protein, a dCas protein, or a UTR binding protein, or a fragment or variant of any of the foregoing. FIG. 18E: the reverse transcriptase domain may comprise, e.g., a truncated reverse transcriptase domain, e.g., from an R2 protein; a reverse transcriptase domain from a virus (e.g., HIV), or a reverse transcriptase domain from AMV (avian myeloblastosis virus), or a fragment or variant of any of the foregoing. FIG. 18F: the endonuclease domain can comprise, e.g., a Cas9 nickase, a Cas ortholog, Fok I, or a restriction enzyme, or a fragment or variant of any of the foregoing. In some embodiments, a separate DNA binding domain can be attached to a polypeptide described herein (e.g., a DNA binding domain having stronger affinity for the target DNA sequence than an existing or prior DNA binding domain of the polypeptide, or a DNA binding sequence that binds to a different target DNA sequence than the existing or prior DNA binding domain of the polypeptide). In some embodiments, DNA binding domain mutants can be generated, e.g., having increased affinity to the target DNA sequence. In embodiments, the DNA binding domain comprises a zinc finger. In embodiments, the DNA binding domain is attached to the polypeptide (e.g., at the N-terminal or C-terminal ends) via a linker, e.g., as described herein. In embodiments, a zinc finger is attached to a DNA binding domain mutant (e.g., as described herein), such that the polypeptide exhibits increased binding to the target DNA sequence (e.g., as dictated by the zinc finger) without competition with the rDNA.

DETAILED DESCRIPTION

Figure 1:
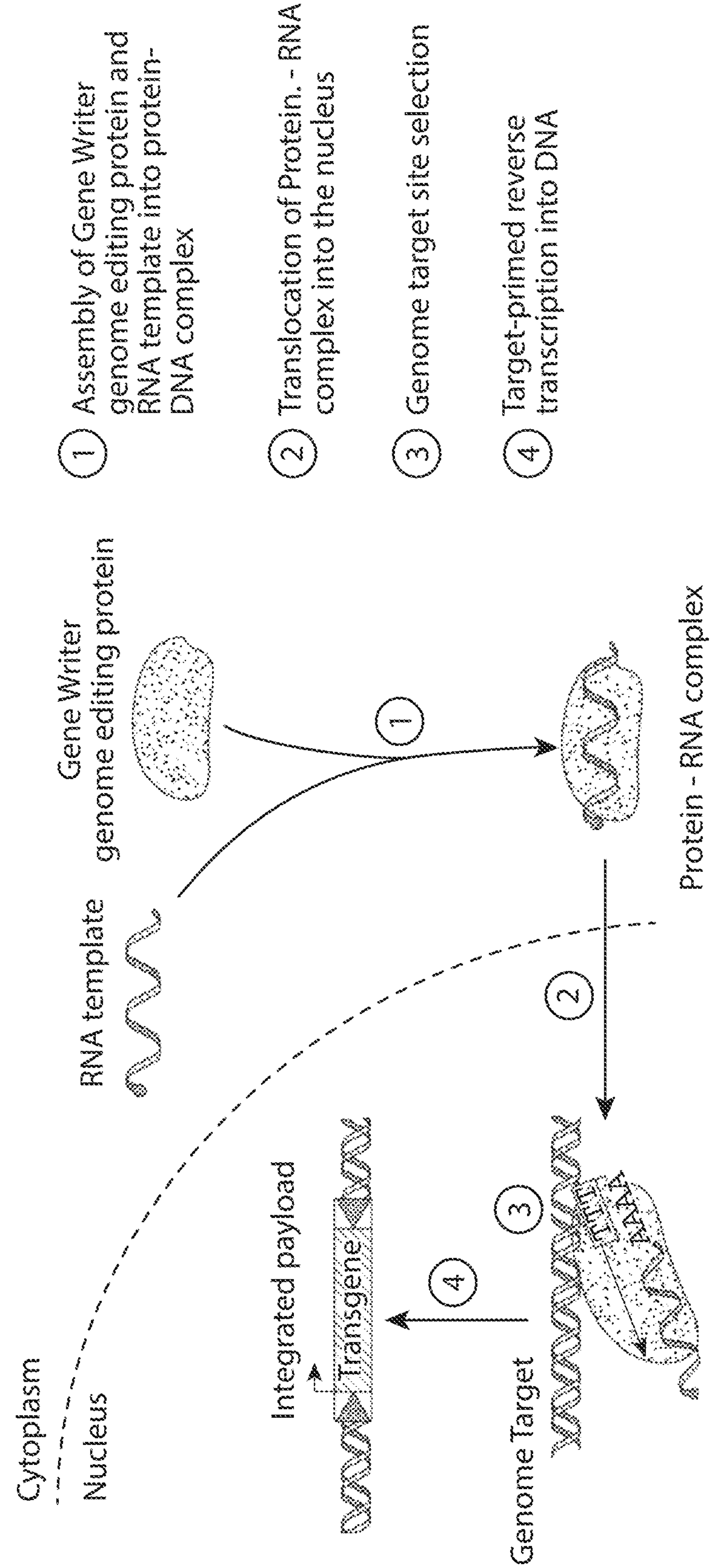
FIG. 1 is a schematic of the GENE WRITING™ genome editing system.
Figure 2:
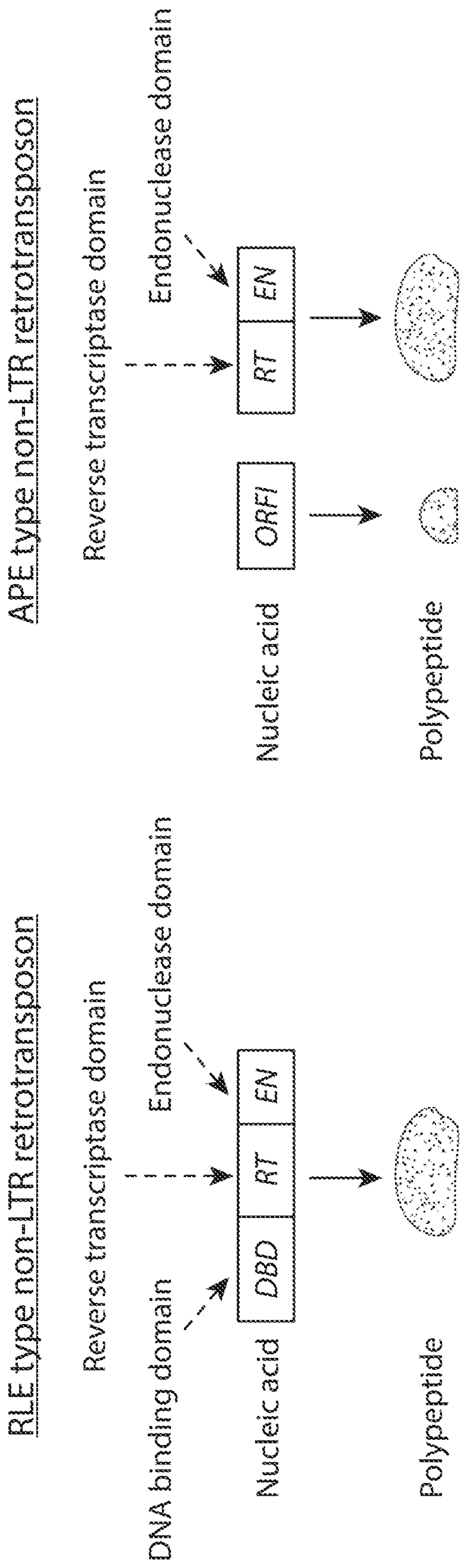
FIG. 2 is a schematic of the structure of the GENE WRITER™ genome editor polypeptide.

This disclosure relates to compositions, systems and methods for targeting, editing, modifying or manipulating a DNA sequence (e.g., inserting a heterologous object DNA sequence into a target site of a mammalian genome) at one or more locations in a DNA sequence in a cell, tissue or subject, e.g., in vivo or in vitro. The object DNA sequence may include, e.g., a coding sequence, a regulatory sequence, a gene expression unit.

More specifically, the disclosure provides retrotransposon-based systems for inserting a sequence of interest into the genome. This disclosure is based, in part, on a bioinformatic analysis to identify retrotransposase sequences and the associated 5' UTR and 3' UTR from a variety of organisms (see Table 3). While not wishing to be bound by theory, in some embodiments, retrotransposases identified in homeothermic (warm blooded) species, like birds, may have improved thermostability relative to some other enzymes that evolved at lower temperatures, and the thermostable retrotransposases may therefore be better suited for use in human cells. The disclosure also provides experimental evidence that several retrotransposases from different species, e.g., different species of animal and/or different species and clade of retrotransposon (e.g., as grouped by reverse transcriptase phylogeny, e.g., as described in Su et al. (2019) RNA; incorporated herein by reference in its entirety), can be used to catalyze DNA insertion into a target site in human cells (see Examples 7 and Example 28).

In some embodiments, systems described herein can have a number of advantages relative to various earlier systems. For instance, the disclosure describes retrotransposases capable of inserting long sequences (e.g., over 3000 nucleotides) of heterologous nucleic acid into a genome (see, e.g., FIG. 20A). In addition, retrotransposases described herein can insert heterologous nucleic acid in an endogenous site in the genome, such as the rDNA locus (see, e.g., Example 7). This is in contrast to Cre/loxP systems which require a first step of inserting an exogenous loxP site before a second step of inserting a sequence of interest into the loxP site.

GENE WRITER™ Genome Editors

Non-long terminal repeat (LTR) retrotransposons are a type of mobile genetic elements that are widespread in eukaryotic genomes. They include two classes: the apurinic/apyrimidinic endonuclease (APE)-type and the restriction enzyme-like endonuclease (RLE)-type. The APE class retrotransposons are comprised of two functional domains: an endonuclease/DNA binding domain, and a reverse transcriptase domain. The RLE class are comprised of three functional domains: a DNA binding domain, a reverse transcription domain, and an endonuclease domain. The reverse transcriptase domain of non-LTR retrotransposon functions by binding an RNA sequence template and reverse transcribing it into the host genome's target DNA. The RNA sequence template has a 3' untranslated region which is specifically bound to the transposase, and a variable 5' region generally having Open Reading Frame(s) ("ORF") encoding transposase proteins. The RNA sequence template may also comprise a 5' untranslated region which specifically binds the retrotransposase.

The inventors have found that, surprisingly, the elements of such non-LTR retrotransposons can be functionally modularized and/or modified to target, edit, modify or manipulate a target DNA sequence, e.g., to insert an object (e.g., heterologous) nucleic acid sequence into a target genome, e.g., a mammalian genome, by reverse transcription. Such modularized and modified nucleic acids, polypeptide compositions and systems are described herein and are referred to as GENE WRITER™ gene editors. A GENE WRITER™ gene editor system comprises: (A) a polypeptide or a nucleic acid encoding a polypeptide, wherein the polypeptide comprises (i) a reverse transcriptase domain, and either (x) an endonuclease domain that contains DNA binding functionality or (y) an endonuclease domain and separate DNA binding domain; and (B) a template RNA comprising (i) a sequence that binds the polypeptide and (ii) a heterologous insert sequence. For example, the GENE WRITER™ genome editor protein may comprise a DNA-binding domain, a reverse transcriptase domain, and an endonuclease domain. In other embodiments, the GENE WRITER™ genome editor protein may comprise a reverse transcriptase domain and an endonuclease domain. In certain embodiments, the elements of the GENE WRITER™ gene editor polypeptide can be derived from sequences of non-LTR retrotransposons, e.g., APE-type or RLE-type retrotransposons or portions or domains thereof. In some embodiments the RLE-type non-LTR retrotransposon is from the R2, NeSL, HERO, R4, or CRE clade. In some embodiments the GENE WRITER™ genome editor is derived from R4 element X4_Line, which is found in the human genome. In some embodiments the APE-type non-LTR retrotransposon is from the R1, or Tx1 clade. In some embodiments the GENE WRITER™ genome editor is derived from Tx1 element Mare6, which is found in the human genome. The RNA template element of a GENE WRITER™ gene editor system is typically heterologous to the polypeptide element and provides an object sequence to be inserted (reverse transcribed) into the host genome. In some embodiments the GENE WRITER™ genome editor protein is capable of target primed reverse transcription.

In some embodiments the GENE WRITER™ genome editor is combined with a second polypeptide. In some embodiments the second polypeptide is derived from an APE-type non-LTR retrotransposon. In some embodiments the second polypeptide has a zinc knuckle-like motif. In some embodiments the second polypeptide is a homolog of Gag proteins.

Polypeptide component of GENE WRITER™ gene editor system

Rt Domain:

In certain aspects of the present invention, the reverse transcriptase domain of the GENE WRITER™ system is based on a reverse transcriptase domain of an APE-type or RLE-type non-LTR retrotransposon. A wild-type reverse transcriptase domain of an APE-type or RLE-type non-LTR retrotransposon can be used in a GENE WRITER™ system or can be modified (e.g., by insertion, deletion, or substitution of one or more residues) to alter the reverse transcriptase activity for target DNA sequences. In some embodiments the reverse transcriptase is altered from its natural sequence to have altered codon usage, e.g. improved for human cells. In some embodiments the reverse transcriptase domain is a heterologous reverse transcriptase from a different retrovirus, LTR-retrotransposon, or non-LTR retrotransposon. In certain embodiments, a GENE WRITER™ system includes a polypeptide that comprises a reverse transcriptase domain of an RLE-type non-LTR retrotransposon from the R2, NeSL, HERO, R4, or CRE clade, or of an APE-type non-LTR retrotransposon from the R1, or Tx1 clade. In certain embodiments, a GENE WRITER™ system includes a polypeptide that comprises a reverse transcriptase domain of a retrotransposon listed in Table 1, Table 2, or Table 3. In embodiments, the amino acid sequence of the reverse transcriptase domain of a GENE WRITER™ system is at least about 50%, at least about 60%, at least about 70%, at least about 80%, at least about 85%, at least about 90%, at least about 95%, at least about 96%, at least about 97%, at least about 98%, at least about 99% identical to the amino acid sequence of a reverse transcriptase domain of a retrotransposon whose DNA sequence is referenced in Table 1, Table 2, or Table 3. A person having ordinary skill in the art is capable of identifying reverse transcription domains based upon homology to other known reverse transcription domains using routine tools as Basic Local Alignment Search Tool (BLAST). In some embodiments, reverse transcriptase domains are modified, for example by site-specific mutation. In embodiments, the reverse transcriptase domain is engineered to bind a heterologous template RNA.

Endonuclease Domain:

In certain embodiments, the endonuclease/DNA binding domain of an APE-type retrotransposon or the endonuclease domain of an RLE-type retrotransposon can be used or can be modified (e.g., by insertion, deletion, or substitution of one or more residues) in a GENE WRITER™ system described herein. In some embodiments the endonuclease domain or endonuclease/DNA binding domain is altered from its natural sequence to have altered codon usage, e.g. improved for human cells. In some embodiments the endonuclease element is a heterologous endonuclease element, such as Fok1 nuclease, a type-II restriction 1-like endonuclease (RLE-type nuclease), or another RLE-type endonuclease (also known as REL). In some embodiments the heterologous endonuclease activity has nickase activity and does not form double stranded breaks. The amino acid sequence of an endonuclease domain of a GENE WRITER™ system described herein may be at least about 50%, at least about 60%, at least about 70%, at least about 80%, at least about 85%, at least about 90%, at least about 95%, at least about 96%, at least about 97%, at least about 98%, at least about 99% identical to the amino acid sequence of an endonuclease domain of a retrotransposon whose DNA sequence is referenced in Table 1, 2, or 3. A person having ordinary skill in the art is capable of identifying endounclease domains based upon homology to other known endonuclease domains using tools as Basic Local Alignment Search Tool (BLAST). In certain embodiments, the heterologous endonuclease is Fok1 or a functional fragment thereof. In certain embodiments, the heterologous endonuclease is a Holliday junction resolvase or homolog thereof, such as the Holliday junction resolving enzyme from *Sulfolobus solfataricus*-Ssol Hje (Govindaraju et al., *Nucleic Acids Research* 44:7, 2016). In certain embodiments, the heterologous endonuclease is the endonuclease of the large fragment of a spliceosomal protein, such as Prp8 (Mahbub et al., *Mobile DNA* 8:16, 2017). For example, a GENE WRITER™ polypeptide described herein may comprise a reverse transcriptase domain from an APE- or RLE-type retrotransposon and an endonuclease domain that comprises Fok1 or a functional fragment thereof. In still other embodiments, homologous endonuclease domains are modified, for example by site-specific mutation, to alter DNA endonuclease activity. In still other embodiments, endonuclease domains are modified to remove any latent DNA-sequence specificity.

DNA Binding Domain:

In certain aspects, the DNA-binding domain of a GENE WRITER™ polypeptide described herein is selected, designed, or constructed for binding to a desired host DNA target sequence. In certain embodiments, the DNA-binding domain of the engineered RLE is a heterologous DNA-binding protein or domain relative to a native retrotransposon sequence. In some embodiments the heterologous DNA binding element is a zinc-finger element or a TAL effector element, e.g., a zinc-finger or TAL polypeptide or functional fragment thereof. In some embodiments the heterologous DNA binding element is a sequence-guided DNA binding element, such as Cas9, Cpf1, or other CRISPR-related protein that has been altered to have no endonuclease activity. In some embodiments the heterologous DNA binding element retains endonuclease activity. In some embodiments the heterologous DNA binding element replaces the endonuclease element of the polypeptide. In specific embodiments, the heterologous DNA-binding domain can be any one or more of Cas9, TAL domain, ZF domain, Myb domain, combinations thereof, or multiples thereof. In certain embodiments, the heterologous DNA-binding domain is a DNA binding domain of a retrotransposon described in Table 1, Table 2, or Table 3. A person having ordinary skill in the art is capable of identifying DNA binding domains based upon homology to other known DNA binding domains using tools as Basic Local Alignment Search Tool (BLAST). In still other embodiments, DNA-binding domains are modified, for example by site-specific mutation, increasing or decreasing DNA-binding elements (for example, number and/or specificity of zinc fingers), etc., to alter DNA-binding specificity and affinity. In some embodiments the DNA binding domain is altered from its natural sequence to have altered codon usage, e.g. improved for human cells In certain aspects of the present invention, the host DNA-binding site integrated into by the GENE WRITER™ system can be in a gene, in an intron, in an exon, an ORF, outside of a coding region of any gene, in a regulatory region of a gene, or outside of a regulatory region of a gene. In other aspects, the engineered RLE may bind to one or more than one host DNA sequence.

In certain embodiments, a GENE WRITER™ gene editor system RNA further comprises an intracellular localization sequence, e.g., a nuclear localization sequence. The nuclear localization sequence may be an RNA sequence that promotes the import of the RNA into the nucleus. In certain embodiments the nuclear localization signal is located on the template RNA. In certain embodiments, the retrotransposase polypeptide is encoded on a first RNA, and the template RNA is a second, separate, RNA, and the nuclear localization signal is located on the template RNA and not on an RNA encoding the retrotransposase polypeptide. While not wishing to be bound by theory, in some embodiments, the RNA encoding the retrotransposase is targeted primarily to the cytoplasm to promote its translation, while the template RNA is targeted primarily to the nucleus to promote its retrotransposition into the genome. In some embodiments the nuclear localization signal is at the 3' end, 5' end, or in an internal region of the template RNA. In some embodiments the nuclear localization signal is 3' of the heterologous sequence (e.g., is directly 3' of the heterologous sequence) or is 5' of the heterologous sequence (e.g., is directly 5' of the heterologous sequence). In some embodiments the nuclear localization signal is placed outside of the 5' UTR or outside of the 3' UTR of the template RNA. In some embodiments the nuclear localization signal is placed between the 5' UTR and the 3' UTR, wherein optionally the nuclear localization signal is not transcribed with the transgene (e.g., the nuclear localization signal is an anti-sense orientation or is downstream of a transcriptional termination signal or polyadenylation signal). In some embodiments the nuclear localization sequence is situated inside of an intron. In some embodiments a plurality of the same or different nuclear localization signals are in the RNA, e.g., in the template RNA. In some embodiments the nuclear localization signal is less than 5, 10, 25, 50, 75, 100, 150, 200, 250, 300, 350, 400, 450, 500, 600, 700, 800, 900 or 1000 bp in length. Various RNA nuclear localization sequences can be used. For example, Lubelsky and Ulitsky, *Nature* 555 (107-111), 2018 describe RNA sequences which drive RNA localization into the nucleus. In some embodiments, the nuclear localization signal is a SINE-derived nuclear RNA localization (SIRLOIN) signal. In some embodiments the nuclear localization signal binds a nuclear-enriched protein. In some embodiments the nuclear localization signal binds the HNRNPK protein. In some embodiments the nuclear localization signal is rich in pyrimidines, e.g., is a C/T rich, C/U rich, C rich, T rich, or U rich region. In some embodiments the nuclear localization signal is derived from a long non-coding RNA. In some embodiments the nuclear localization signal is derived from MALAT1 long non-coding RNA or is the 600 nucleotide M region of MALAT1 (described in Miyagawa et al., RNA 18, (738-751), 2012). In some embodiments the nuclear localization signal is derived from BORG long non-coding RNA or is a AGCCC motif (described in Zhang et al., *Molecular and Cellular Biology* 34, 2318-2329 (2014). In some embodiments the nuclear localization sequence is described in Shukla et al., The *EMBO Journal* e98452 (2018). In some embodiments the nuclear localization signal is derived from a non-LTR retrotransposon, an LTR retrotransposon, retrovirus, or an endogenous retrovirus.

In certain embodiments, a GENE WRITER™ gene editor system polypeptide further comprises an intracellular localization sequence, e.g., a nuclear localization sequence and/or a nucleolar localization sequence. The nuclear localization sequence and/or nucleolar localization sequence may be amino acid sequences that promote the import of the protein into the nucleus and/or nucleolus, where it can promote integration of heterologous sequence into the genome. In certain embodiments, a GENE WRITER™ gene editor system polypeptide (e.g., a retrotransposase, e.g., a polypeptide according to any of Tables 1, 2, or 3 herein) further comprises a nucleolar localization sequence. In certain embodiments, the retrotransposase polypeptide is encoded on a first RNA, and the template RNA is a second, separate, RNA, and the nucleolar localization signal is encoded on the RNA encoding the retrotransposase polypeptide and not on the template RNA. In some embodiments, the nucleolar localization signal is located at the N-terminus, C-terminus, or in an internal region of the polypeptide. In some embodiments, a plurality of the same or different nucleolar localization signals are used. In some embodiments, the nuclear localization signal is less than 5, 10, 25, 50, 75, or 100 amino acids in length. Various polypeptide nucleolar localization signals can be used. For example, Yang et al., *Journal of Biomedical Science* 22, 33 (2015), describe a nuclear localization signal that also functions as a nucleolar localization signal. In some embodiments, the nucleolar localization signal may also be a nuclear localization signal. In some embodiments, the nucleolar localization signal may overlap with a nuclear localization signal. In some embodiments, the nucleolar localization signal may comprise a stretch of basic residues. In some embodiments, the nucleolar localization signal may be rich in arginine and lysine residues. In some embodiments, the nucleolar localization signal may be derived from a protein that is enriched in the nucleolus. In some embodiments, the nucleolar localization signal may be derived from a protein enriched at ribosomal RNA loci. In some embodiments, the nucleolar localization signal may be derived from a protein that binds rRNA. In some embodiments, the nucleolar localization signal may be derived from MSP58. In some embodiments, the nucleolar localization signal may be a monopartite motif. In some embodiments, the nucleolar localization signal may be a bipartite motif. In some embodiments, the nucleolar localization signal may consist of a multiple monopartite or bipartite motifs. In some embodiments, the nucleolar localization signal may consist of a mix of monopartite and bipartite motifs. In some embodiments, the nucleolar localization signal may be a dual bipartite motif. In some embodiments, the nucleolar localization motif may be a KRASSQALGTIPKRRSSSRFIKRKK (SEQ ID NO: 1530). In some embodiments, the nucleolar localization signal may be derived from nuclear factor-κB-inducing kinase. In some embodiments, the nucleolar localization signal may be an RKKRKKK motif (SEQ ID NO: 1531) (described in Birbach et al., Journal of Cell Science, 117 (3615-3624), 2004).

In some embodiments, a nucleic acid described herein (e.g., an RNA encoding a GENE WRITER™ polypeptide, or a DNA encoding the RNA) comprises a microRNA binding site. In some embodiments, the microRNA binding site is used to increase the target-cell specificity of a GENE WRITER™ system. For instance, the microRNA binding site can be chosen on the basis that is recognized by a miRNA that is present in a non-target cell type, but that is not present (or is present at a reduced level relative to the non-target cell) in a target cell type. Thus, when the RNA encoding the GENE WRITER™ polypeptide is present in a non-target cell, it would be bound by the miRNA, and when the RNA encoding the GENE WRITER™ polypeptide is present in a target cell, it would not be bound by the miRNA (or bound but at reduced levels relative to the non-target cell). While not wishing to be bound by theory, binding of the miRNA to the RNA encoding the GENE WRITER™ polypeptide may reduce production of the GENE WRITER™ polypeptide, e.g., by degrading the mRNA encoding the polypeptide or by interfering with translation. Accordingly, the heterologous object sequence would be inserted into the genome of target cells more efficiently than into the genome of non-target cells. A system having a microRNA binding site in the RNA encoding the GENE WRITER™ polypeptide (or encoded in the DNA encoding the RNA) may also be used in combination with a template RNA that is regulated by a second microRNA binding site, e.g., as described herein in the section entitled “Template RNA component of GENE WRITER™ gene editor system.”

TABLE 1

Table 1: APE-type non-LTR retrotransposon elements

| Family | Sequence Accession | Mobile Element | Name | Organism |
|---|---|---|---|---|
| Dewa | AB097143 | ORF2 | *Danio rerio* retrotransposon DewaDr1 DNA, complete sequence | *Danio rerio* |
| HeT-A | KJ081250 | non-LTR retrotransposon: HeT-A | *Drosophila melanogaster* non-LTR retrotransposon HeT-A, partial sequence | *Drosophila melanogaster* |
| Keno | AB111948 | ORF2 | *Tetraodon nigroviridis* retrotransposon KenoTn1 DNA, partial sequence | *Tetraodon nigroviridis* |
| KenoDr1; Keno | AB097144 | ORF2 | *Danio rerio* retrotransposon KenoDr1 DNA, complete sequence | *Danio rerio* |
| KenoFr1; Keno | AB111947 | ORF2 | *Takifugu rubripes* retrotransposon KenoFr1 DNA, complete sequence | *Takifugu rubripes* |
| Kibi | AB097139 | ORF2 | *Danio rerio* retrotransposon KibiDr2 DNA, complete sequence | *Danio rerio* |
| Kibi | AB097138 | ORF2 | *Danio rerio* retrotransposon KibiDr1 DNA, complete sequence | *Danio rerio* |
| Kibi | AB097137 | ORF2 | *Tetraodon nigroviridis* retrotransposon KibiTn1 DNA, complete sequence | *Tetraodon nigroviridis* |
| Kibi | AB097136 | ORF2 | *Takifugu rubripes* retrotransposon KibiFr1 DNA, complete sequence | *Takifugu rubripes* |
| KoshiTn1 | AB097135 | ORF2 | *Tetraodon nigroviridis* retrotransposon KoshiTn1 DNA, complete sequence | *Tetraodon nigroviridis* |
| Mutsu | AB097142 | ORF2 | *Danio rerio* retrotransposon MutsuDr3 DNA, partial sequence | *Danio rerio* |
| Mutsu | AB097141 | ORF2 | *Danio rerio* retrotransposon MutsuDr2 DNA, partial sequence | *Danio rerio* |
| Mutsu | AB097140 | ORF2 | *Danio rerio* retrotransposon MutsuDr1 DNA, complete sequence | *Danio rerio* |
| R1 | HQ284568 | non-LTR retrotransposon: R1-like | *Trilocha* sp. GAS-2011 isolate TrilSp.6 non-LTR retrotransposon R1-like reverse transcriptase gene, partial cds | *Trilocha* sp. GAS-2011 |
| R1 | HQ284534 | non-LTR retrotransposon: R1-like | *Scopula ornata* isolate ScoOrn.6 non-LTR retrotransposon R1-like reverse transcriptase gene, partial cds | *Scopula ornata* |
| R1 | HQ284496 | non-LTR retrotransposon: R1-like | *Perigonia ilus* isolate PerIlus.31 non-LTR retrotransposon R1-like reverse transcriptase gene, partial cds | *Perigonia ilus* |
| R1 | HQ284489 | non-LTR retrotransposon: R1-like | *Oxytenis modestia* isolate OxyMod.2_3_4_7_9 non-LTR retrotransposon R1-like reverse transcriptase gene, partial cds | *Oxytenis modestia* |
| R1 | HQ284488 | non-LTR retrotransposon: R1-like | *Oxytenis modestia* isolate OxyMod.1 non-LTR retrotransposon R1-like reverse transcriptase gene, partial cds | *Oxytenis modestia* |
| R1 | HQ284476 | non-LTR retrotransposon: R1-like | *Oeneis magna dubia* isolate OenMag.26 non-LTR retrotransposon R1-like reverse transcriptase-like gene, partial sequence | *Oeneis magna dubia* |
| R1 | HQ284437 | non-LTR retrotransposon: R1-like | *Lymantria dispar* isolate LymDis.2 non-LTR retrotransposon R1-like reverse transcriptase gene, partial cds | *Lymantria dispar* |
| R1 | HQ284435 | non-LTR retrotransposon: R1-like | *Lymantria dispar* isolate LymDis.1 non-LTR retrotransposon R1-like reverse transcriptase gene, partial cds | *Lymantria dispar* |
| R1 | HQ284432 | non-LTR retrotransposon: R1-like | *Janiodes laverna* isolate JanLav.911 non-LTR retrotransposon R1-like reverse transcriptase-like gene, partial sequence | *Janiodes laverna* |
| R1 | HQ284431 | non-LTR retrotransposon: R1-like | *Janiodes laverna* isolate JanLav.811 non-LTR retrotransposon R1-like reverse transcriptase gene, partial cds | *Janiodes laverna* |
| R1 | HQ284430 | non-LTR retrotransposon: R1-like | *Janiodes laverna* isolate JanLav.5 non-LTR retrotransposon R1-like reverse transcriptase gene, partial cds | *Janiodes laverna* |

TABLE 1-continued

Table 1: APE-type non-LTR retrotransposon elements

| Family | Sequence Accession | Mobile Element | Name | Organism |
|---|---|---|---|---|
| R1 | HQ284428 | non-LTR retrotransposon: R1-like | *Janiodes laverna* isolate JanLav.411 non-LTR retrotransposon R1-like reverse transcriptase gene, partial cds | *Janiodes laverna* |
| R1 | HQ284426 | non-LTR retrotransposon: R1-like | *Janiodes laverna* isolate JanLav.211 non-LTR retrotransposon R1-like reverse transcriptase-like gene, partial sequence | *Janiodes laverna* |
| R1 | HQ284421 | non-LTR retrotransposon: R1-like | *Heteropterus morpheus* isolate HetMor.3 non-LTR retrotransposon R1-like reverse transcriptase gene, partial cds | *Heteropterus morpheus* |
| R1 | HQ284402 | non-LTR retrotransposon: R1-like | *Erinnyis ello* isolate EriEllo.22 non-LTR retrotransposon R1-like reverse transcriptase-like gene, partial sequence | *Erinnyis ello* |
| R1 | HQ284399 | non-LTR retrotransposon: R1-like | *Erebia theano* isolate EreThe.29 non-LTR retrotransposon R1-like reverse transcriptase gene, partial cds | *Erebia theano* |
| R1 | HQ284398 | non-LTR retrotransposon: R1-like | *Erebia theano* isolate EreThe.28 non-LTR retrotransposon R1-like reverse transcriptase-like gene, partial sequence | *Erebia theano* |
| R1 | HQ284397 | non-LTR retrotransposon: R1-like | *Erebia theano* isolate EreThe.27 non-LTR retrotransposon R1-like reverse transcriptase-like gene, partial sequence | *Erebia theano* |
| R1 | HQ284391 | non-LTR retrotransposon: R1-like | *Emesis lucinda* isolate EmeLuc.23 non-LTR retrotransposon R1-like reverse transcriptase gene, partial cds | *Emesis lucinda* |
| R1 | HQ284390 | non-LTR retrotransposon: R1-like | *Emesis lucinda* isolate EmeLuc.2 non-LTR retrotransposon R1-like reverse transcriptase gene, partial cds | *Emesis lucinda* |
| R1 | HQ284364 | non-LTR retrotransposon: R1-like | *Coenonympha glycerion* isolate CoeGly.9 non-LTR retrotransposon R1-like reverse transcriptase gene, partial cds | *Coenonympha glycerion* |
| R1 | HQ284363 | non-LTR retrotransposon: R1-like | *Coenonympha glycerion* isolate CoeGly.8 non-LTR retrotransposon R1-like reverse transcriptase-like gene, partial sequence | *Coenonympha glycerion* |
| R1 | HQ284362 | non-LTR retrotransposon: R1-like | *Coenonympha glycerion* isolate CoeGly.7 non-LTR retrotransposon R1-like reverse transcriptase gene, partial cds | *Coenonympha glycerion* |
| R1 | HQ284361 | non-LTR retrotransposon: R1-like | *Coenonympha glycerion* isolate CoeGly.5 non-LTR retrotransposon R1-like reverse transcriptase-like gene, partial sequence | *Coenonympha glycerion* |
| R1 | HQ284357 | non-LTR retrotransposon: R1-like | *Coenonympha glycerion* isolate CoeGly.13 non-LTR retrotransposon R1-like reverse transcriptase gene, partial cds | *Coenonympha glycerion* |
| R1 | HQ284356 | non-LTR retrotransposon: R1-like | *Coenonympha glycerion* isolate CoeGly.11 non-LTR retrotransposon R1-like reverse transcriptase-like gene, partial sequence | *Coenonympha glycerion* |
| R1 | HQ284350 | non-LTR retrotransposon: R1-like | *Catocyclotis adelina* isolate CatAde.18 non-LTR retrotransposon R1-like reverse transcriptase gene, partial cds | *Catocyclotis adelina* |
| R1 | HQ284340 | non-LTR retrotransposon: R1-like | *Caria rhacotis* isolate CarRha.11 non-LTR retrotransposon R1-like reverse transcriptase gene, partial cds | *Caria rhacotis* |
| R1 | HQ284339 | non-LTR retrotransposon: R1-like | *Caria rhacotis* isolate CarRha.1 non-LTR retrotransposon R1-like reverse transcriptase gene, partial cds | *Caria rhacotis* |

TABLE 1-continued

Table 1: APE-type non-LTR retrotransposon elements

| Family | Sequence Accession | Mobile Element | Name | Organism |
|---|---|---|---|---|
| R1 | HQ284319 | non-LTR retrotransposon: R1-like | *Archiearis parthenias* isolate BrePar.1 non-LTR retrotransposon R1-like reverse transcriptase gene, partial cds | *Archiearis parthenias* |
| R1 | HQ284318 | non-LTR retrotransposon: R1-like | *Brangas neora* isolate BraNeo.32 non-LTR retrotransposon R1-like reverse transcriptase gene, partial cds | *Brangas neora* |
| R1 | HQ284292 | non-LTR retrotransposon: R1-like | *Araschnia levana* isolate AraLev.31 non-LTR retrotransposon R1-like reverse transcriptase-like gene, partial sequence | *Araschnia levana* |
| R1 | HQ284286 | non-LTR retrotransposon: R1-like | *Araschnia levana* isolate AraLev.1 non-LTR retrotransposon R1-like reverse transcriptase gene, partial cds | *Araschnia levana* |
| R1 | HQ284280 | non-LTR retrotransposon: R1-like | *Anteros formosus* isolate AntForm.34 non-LTR retrotransposon R1-like reverse transcriptase gene, partial cds | *Anteros formosus* |
| R1 | HQ284279 | non-LTR retrotransposon: R1-like | *Anteros formosus* isolate AntForm.32 non-LTR retrotransposon R1-like reverse transcriptase-like gene, partial sequence | *Anteros formosus* |
| R1 | HQ284278 | non-LTR retrotransposon: R1-like | *Anteros formosus* isolate AntForm.31 non-LTR retrotransposon R1-like reverse transcriptase-like gene, partial sequence | *Anteros formosus* |
| R1 | HQ284270 | non-LTR retrotransposon: R1-like | *Agrotis exclamationis* isolate AgrExcl.27 non-LTR retrotransposon R1-like reverse transcriptase gene, partial cds | *Agrotis exclamationis* |
| R1 | HQ284267 | non-LTR retrotransposon: R1-like | *Agrius cingulata* isolate AgrCing.36_39 non-LTR retrotransposon R1-like reverse transcriptase gene, partial cds | *Agrius cingulata* |
| R1 | HQ284266 | non-LTR retrotransposon: R1-like | *Agrius cingulata* isolate AgrCing.3 non-LTR retrotransposon R1-like reverse transcriptase-like gene, partial sequence | *Agrius cingulata* |
| R1 | HQ284263 | non-LTR retrotransposon: R1-like | *Aglia tau* isolate AglTau.8 non-LTR retrotransposon R1-like reverse transcriptase gene, partial cds | *Aglia tau* |
| R1 | HQ284262 | non-LTR retrotransposon: R1-like | *Aglia tau* isolate AglTau.7 non-LTR retrotransposon R1-like reverse transcriptase gene, partial cds | *Aglia tau* |
| R1 | DQ836362 | MalR1 | *Maculinea alcon* R1-like non-LTR retrotransposon R1 reverse transcriptase (RT) pseudogene, partial sequence | *Phengaris alcon* |
| R1 | DQ836391 | MnaR1 | *Maculinea nausithous* R1-like non-LTR retrotransposon R1 reverse transcriptase (RT) gene, partial cds | *Phengaris nausithous* |
| R1 | KU543683 | non-LTR retrotransposon and non-LTR retrovirus reverse transcriptase; Region: RT_nLTR | *Bactrocera tryoni* clone Btry_5404 non-LTR retrotransposon R1, complete sequence | *Bactrocera tryoni* |
| R1 | KU543682 | non-LTR retrotransposon and non-LTR retrovirus reverse transcriptase; Region: RT_nLTR | *Bactrocera tryoni* clone Btry_5167 non-LTR retrotransposon R1, complete sequence | *Bactrocera tryoni* |
| R1 | KU543679 | non-LTR retrotransposon and non-LTR retrovirus reverse transcriptase; Region: RT_nLTR | *Bactrocera tryoni* clone Btry_4956 non-LTR retrotransposon R1, complete sequence | *Bactrocera tryoni* |

TABLE 1-continued

| Table 1: APE-type non-LTR retrotransposon elements | | | | |
|---|---|---|---|---|
| Family | Sequence Accession | Mobile Element | Name | Organism |
| R1 | KU543678 | non-LTR retrotransposon and non-LTR retrovirus reverse transcriptase; Region: RT_nLTR | *Bactrocera tryoni* clone Btry_5979 non-LTR retrotransposon R1, complete sequence | *Bactrocera tryoni* |
| R1 | AB078933 | ORF1 | *Papilio xuthus* non-LTR retrotransposon gene for gag-like protein, partial cds, clone: SARTPx2-2 | *Papilio xuthus* |
| R1 | AB078932 | ORF1 | *Papilio xuthus* non-LTR retrotransposon gene for gag-like protein, partial cds, clone: SARTPx2-1 | *Papilio xuthus* |
| R1 | AB078936 | ORF2 | *Papilio xuthus* non-LTR retrotransposon genes for gag-like protein, reverse transcriptase, partial cds, clone: SARTPx4-N18 | *Papilio xuthus* |
| R1 | AB078935 | ORF2 | *Papilio xuthus* non-LTR retrotransposon genes for gag-like protein, reverse transcriptase, partial and complete cds, clone: SARTPx3-N7 | *Papilio xuthus* |
| R1 | AB078934 | ORF2 | *Papilio xuthus* non-LTR retrotransposon genes for gag-like protein, reverse transcriptase, partial cds, clone: SARTPx3-N3 | *Papilio xuthus* |
| R1 | AB078931 | ORF2 | *Papilio xuthus* non-LTR retrotransposon genes for gag-like protein, reverse transcriptase, partial and complete cds, clone: SARTPx1-N14 | *Papilio xuthus* |
| R1 | AB078930 | ORF2 | *Papilio xuthus* non-LTR retrotransposon genes for gag-like protein, reverse transcriptase, partial and complete cds, clone: SARTPx1-N5 | *Papilio xuthus* |
| R1 | AB078929 | ORF2 | *Papilio xuthus* non-LTR retrotransposon genes for gag-like protein, reverse transcrpitase, partial and complete cds, clone: SARTPx1-N4 | *Papilio xuthus* |
| R1 | AB078928 | ORF2 | *Papilio xuthus* non-LTR retrotransposon gene for gag-like protein, reverse transcrpitase, complete and partial cds, clone: SARTPx1-3 | *Papilio xuthus* |
| R1 | KP771712 | ORF2; contains endonuclease, reverse transcriptase and RNaseH | *Blattella germanica* non-LTR retrotransposon TRAS-like 2, complete sequence | *Blattella germanica* |
| R1 | KP771711 | ORF2; contains endonuclease, reverse transcriptase and RNaseH | *Blattella germanica* non-LTR retrotransposon TRAS-like 1, complete sequence | *Blattella germanica* |
| R1 | AF015813 | R1 ORF | *Dugesiella* sp. retrotransposon R1 reverse transcriptase gene, partial cds | *Aphonopelma* sp. WDB-1998 |
| R1 | AF015489 | R1 ORF | *Dugesiella* sp. retrotransposon R1 reverse transcriptase gene, partial cds | *Aphonopelma* sp. WDB-1998 |
| R1Bm | AB182560 | non-LTR retrotransposon R1Bmks ORF2 | *Bombyx mori* genes for non-LTR retrotransposon R1Bmks ORF1 protein, non-LTR retrotransposon R1Bmks ORF2 protein, complete cds | *Bombyx mori* |
| R6 | AB090819 | ORF2 | *Anopheles gambiae* retrotransposon R6Ag3 DNA, complete sequence | *Anopheles gambiae* |
| R6 | AB090818 | ORF2 | *Anopheles gambiae* retrotransposon R6Ag2 DNA, complete sequence | *Anopheles gambiae* |
| R6 | AB090817 | ORF2 | *Anopheles gambiae* retrotransposon R6Ag1 DNA, complete sequence | *Anopheles gambiae* |
| R6 | KJ958615 | R2 | *Bacillus rossius* non-LTR retrotransposon reVIR6, partial sequence | *Bacillus rossius* |
| R6 | KJ958596 | R2 | *Bacillus rossius* non-LTR retrotransposon reBER6, partial sequence | *Bacillus rossius* |

TABLE 1-continued

| Table 1: APE-type non-LTR retrotransposon elements | | | | |
|---|---|---|---|---|
| Family | Sequence Accession | Mobile Element | Name | Organism |
| R6 | AF352480 | transposon: NLRCth1-like non-LTR retrotransposon | *Chironomus circumdatus* clone cir6 transposon NLRCth1-like non-LTR retrotransposon reverse transcriptase gene, partial cds | *Chironomus circumdatus* |
| R6 | AF373367 | transposon: non-LTR retrotransposon LINE2 | *Clelia rustica* clone CR6 non-LTR retrotransposon LINE2 reverse transcriptase pseudogene, partial sequence | *Paraphimophis rusticus* |
| R7 | AB090820 | ORF2 | *Anopheles gambiae* retrotransposon R7Ag1 DNA, complete sequence | *Anopheles gambiae* |
| R7 | AB090821 | ORF2 | *Anopheles gambiae* retrotransposon R7Ag2 DNA, complete sequence | *Anopheles gambiae* |
| R7 | KJ958622 | R2 | *Bacillus rossius* non-LTR retrotransposon trKOR7, partial sequence | *Bacillus rossius* |
| R7 | KJ958616 | R2 | *Bacillus rossius* non-LTR retrotransposon reVIR7, partial sequence | *Bacillus rossius* |
| R7 | KJ958597 | R2 | *Bacillus rossius* non-LTR retrotransposon reBER7, partial sequence | *Bacillus rossius* |
| R7 | AF352514 | transposon: NLRCth1-like non-LTR retrotransposon | *Chironomus circumdatus* clone cir7 transposon NLRCth1-like non-LTR retrotransposon reverse transcriptase pseudogene, partial sequence | *Chironomus circumdatus* |
| Rt2 | AY379084 | truncated; similar to reverse transcriptase | *Leptocheirus plumulosus* retrotransposon LpRt2, partial sequence | *Leptocheirus plumulosus* |
| Rt2 | MSQRT2RET | | *Anopheles gambiae* retrotransposon RT2, complete sequence | *Anopheles gambiae* |
| RTAg4 | AB090813 | ORF2 | *Anopheles gambiae* retrotransposon RTAg4 DNA, complete sequence | *Anopheles gambiae* |
| TRAS1 | BMOTRAS1 | DNA binding domain at AA1103-1120. | *Bombyx mori* gene, complete sequence of retrotransposon TRAS1 | *Bombyx mori* |
| TRAS3 | JX875955 | similar to reverse transcriptases | *Acyrthosiphon pisum* clone LSR1 non-LTR retrotransposon TRAS3, complete sequence | *Acyrthosiphon pisum* |
| Tx1 | AJ621359 | transposon: non-LTR retrotransposon TX1-1_Tet | *Tetraodon nigroviridis* non-LTR retrotransposon TX1-1_Tet, complete sequence | *Tetraodon nigroviridis* |
| Tx1 | AJ621360 | transposon: non-LTR retrotransposon TX1-2_Tet | *Tetraodon nigroviridis* partial non-LTR retrotransposon TX1-2_Tet | *Tetraodon nigroviridis* |
| Tx1 | AJ621361 | transposon: non-LTR retrotransposon TX1-3_Tet | *Tetraodon nigroviridis* partial non-LTR retrotransposon TX1-3_Tet | *Tetraodon nigroviridis* |
| Tx1 | AJ621362 | transposon: non-LTR retrotransposon TX1-4_Tet | *Tetraodon nigroviridis* partial non-LTR retrotransposon TX1-4_Tet | *Tetraodon nigroviridis* |
| Tx1 | DQ118004 | transposon: Tx1-like retrotransposon Tx1Aru | *Acipenser ruthenus* clone dg194 transposon Tx1-like retrotransposon Tx1Aru reverse transcriptase-like gene, partial sequence | *Acipenser ruthenus* |
| Tx1 | AB097134 | ORF2 | *Takifugu rubripes* retrotransposon KoshiFr1 DNA, complete sequence | *Takifugu rubripes* |
| Tx1 | AB090816 | ORF2 | *Anopheles gambiae* retrotransposon MinoAg1 DNA, complete sequence | *Anopheles gambiae* |
| Tx1 | AB090812 | ORF2 | *Anopheles gambiae* retrotransposon RTAg3 DNA, complete sequence | *Anopheles gambiae* |
| Waldo | AH009917 | non-LTR retrotransposon: Waldo-A | *Drosophila melanogaster* Waldo-A non-LTR retrotransposon, 5' sequence | *Drosophila melanogaster* |
| Waldo | AH009916 | non-LTR retrotransposon: Waldo-A | *Drosophila melanogaster* clone CBE9 Waldo-A non-LTR retrotransposon, 5' sequence | *Drosophila melanogaster* |
| Waldo | AH009915 | non-LTR retrotransposon: Waldo-A | *Drosophila melanogaster* Waldo-A non-LTR retrotransposon, 5' sequence | *Drosophila melanogaster* |

TABLE 1-continued

| Table 1: APE-type non-LTR retrotransposon elements | | | | |
|---|---|---|---|---|
| Family | Sequence Accession | Mobile Element | Name | Organism |
| Waldo | AH009914 | non-LTR retrotransposon: Waldo-A | *Drosophila melanogaster* Waldo-A non-LTR retrotransposon | *Drosophila melanogaster* |
| Waldo | AH009920 | non-LTR retrotransposon: Waldo-B | *Drosophila melanogaster* Waldo-B non-LTR retrotransposon, 5' sequence | *Drosophila melanogaster* |
| Waldo | AH009919 | non-LTR retrotransposon: Waldo-B | | *Drosophila melanogaster* |
| Waldo | AH009918 | non-LTR retrotransposon: Waldo-B | | *Drosophila melanogaster* |
| Waldo | AB090815 | ORF2 | *Anopheles gambiae* retrotransposon WaldoAg2 DNA, complete sequence | *Anopheles gambiae* |
| Waldo | AB090814 | ORF2 | *Anopheles gambiae* retrotransposon WaldoAg1 DNA, complete sequence | *Anopheles gambiae* |
| Waldo | AB078939 | ORF2 | *Forficula scudderi* non-LTR retrotransposon pseudogene for reverse transcriptase, clone: WaldoFs1-26 | *Forficula scudderi* |
| Waldo | AB078938 | ORF2 | *Forficula scudderi* non-LTR retrotransposon pseudogene for reverse transcriptase, clone: WaldoFs1-2 | *Forficula scudderi* |
| Waldo | AB078937 | ORF2 | *Forficula scudderi* non-LTR retrotransposon pseudogene for reverse transcriptase, clone: WaldoFs1-1 | *Forficula scudderi* |

TABLE 2

| Table 2: RLE-type non-LTR retrotransposon elements | | | | |
|---|---|---|---|---|
| Family | Accession | Mobile Element | Name/Description | Organism |
| CRE | EF067892 | | *Colletotrichum cereale* clone 9F8-1558 Ccret3 non-LTR retrotransposon, partial sequence | *Colletotrichum cereale* |
| CRE | EF067894 | | *Colletotrichum cereale* clone 9F8-2137 Ccret3 non-LTR retrotransposon, partial sequence | *Colletotrichum cereale* |
| CRE | MG028000 | non-LTR retrotransposon: Rex3 | *Characidium gomesi* voucher MNRJ20998 non-LTR retrotransposon Rex3, partial sequence | *Characidium gomesi* |
| CRE | KY566213 | non-LTR retrotransposon: Rex3 | *Characidium gomesi* non-LTR retrotransposon Rex3, partial sequence | *Characidim gomesi* |
| CRE | GU949558 | | *Kalotermes flavicollis* isolate Crete non-LTR retrotransposon R2, complete sequence; and R2 protein gene, complete cds | *Kalotermes flavicollis* |
| CRE; CRE2 | CFU19151 | poly dA tracts in 5' and 3' UTRs | *Crithidia fasciculata* retrotransposon CRE2 in mini-exon gene, putative reverse transcriptase gene, complete cds | *Crithidia fasciculata* |
| CZAR | BR000987 | pol | TPA_inf: *Capsaspora owczarzaki* DNA, non-LTR retrotransposon CoL4, complete sequence, strain: ATCC 30864 | *Capsaspora owczarzaki* |
| CZAR | BR000986 | pol | TPA_inf: *Capsaspora owczarzaki* DNA, non-LTR retrotransposon CoL3, complete sequence, strain: ATCC 30864 | *Capsaspora owczarzaki* |
| CZAR | BR000985 | pol | TPA_inf: *Capsaspora owczarzaki* DNA, non-LTR retrotransposon CoL2, complete sequence, strain: ATCC 30864 | *Capsaspora owczarzaki* |

TABLE 2-continued

Table 2: RLE-type non-LTR retrotransposon elements

| Family | Accession | Mobile Element | Name/Description | Organism |
|---|---|---|---|---|
| CZAR | BR000984 | pol | TPA_inf: *Capsaspora owczarzaki* DNA, non-LTR retrotransposon CoL1, complete sequence, strain: ATCC 30864 | *Capsaspora owczarzaki* |
| DongAG; Dong | AB097127 | rt | *Anopheles gambiae* retrotransposon DongAg DNA, partial sequence | *Anopheles gambiae* |
| EhRLE2 | AB097128 | rt | *Entamoeba histolytica* retrotransposon EhRLE2 DNA, complete sequence | *Entamoeba histolytica* |
| EhRLE3 | AB097129 | rt | *Entamoeba histolytica* retrotransposon EhRLE3 DNA, complete sequence | *Entamoeba histolytica* |
| Genie | AF440196 | endonuclease | *Giardia intestinalis* non-LTR retrotransposon GENIE 1 pol polyprotein gene, complete cds | *Giardia intestinalis* |
| Genie | BK000097 | endonuclease | TPA_exp: *Giardia intestinalis* non-LTR retrotransposon Genie 1A gene, partial sequence | *Giardia intestinalis* |
| Genie | BK000095 | endonuclease | TPA_exp: *Giardia intestinalis* non-LTR retrotransposon Genie 1 gene, partial sequence | *Giardia intestinalis* |
| Genie | BK000096 | insertion site for non-LTR retrotransposon Genie 1 | TPA_exp: *Giardia intestinalis* non-LTR retrotransposon Genie 1 target site sequence | *Giardia intestinalis* |
| Genie | AY216701 | non-experimental evidence, no additional details recorded | *Girardia tigrina* GENIE retrotransposon, complete sequence | *Girardia tigrina* |
| Genie | BK000098 | similar to endonuclease | TPA_exp: *Giardia intestinalis* non-LTR retrotransposon Genie 2 gene, complete sequence | *Giardia intestinalis* |
| GilD | AF433877 | (tca)n (SEQ ID NO: 1532) or (tga)n (SEQ ID NO: 1533), n = 2-4 | *Giardia intestinalis* inactive non-LTR retrotransposon GilD, consensus sequence | *Giardia intestinalis* |
| GilM | AF433875 | poly(dA) tract | *Giardia intestinalis* non-LTR LINE-like retrotransposon GilM, complete sequence | *Giardia intestinalis* |
| Hero | AB097132 | rt | *Danio rerio* retrotransposon HERODr DNA, complete sequence | *Danio rerio* |
| Hero | AB097130 | rt | *Takifugu rubripes* retrotransposon HEROFr DNA, complete sequence | *Takifugu rubripes* |
| HEROTn | AB097131 | rt | *Tetraodon nigroviridis* retrotransposon HEROTn DNA, complete sequence | *Tetraodon nigroviridis* |
| NeSL_3_135_68117 | FJ905846 | non-LTR retrotransposon: NeSL_3_135_68117 | *Daphnia pulex* non-LTR retrotransposon NeSL_3_135_68117, complete sequence | *Daphnia pulex* |
| NeSL; NeSL-1 | DQ099731 | target site duplication | *Caenorhabditis briggsae* transposon NeSl-1-like non-LTR retrotransposon NeSL-1Cb reverse transcriptase (pol) gene, complete cds | *Caenorhabditis briggsae* |
| PERERE-9 | BN000800 | | TPA_exp: *Schistosoma mansoni* Perere-9 non-LTR retrotransposon | *Schistosoma mansoni* |
| R2 | AF015814 | R2 | *Limulus polyphemus* retrotransposon R2, complete sequence | *Limulus polyphemus* |
| R2 | AF090145 | R2 | *Nasonia vitripennis* R2 non-LTR retrotransposable element reverse transcriptase gene, partial cds | *Nasonia vitripennis* |
| R2 | AF015818 | R2 | *Porcellio scaber* retrotransposon R2, complete sequence | *Porcellio scaber* |
| R2 | AF015815 | R2 | *Anurida maritima* retrotransposon R2, complete sequence | *Anurida maritima* |

TABLE 2-continued

Table 2: RLE-type non-LTR retrotransposon elements

| Family | Accession | Mobile Element | Name/Description | Organism |
|---|---|---|---|---|
| R2 | M16558 | R2 | *Bombyx mori* rDNA insertion element R2 (typeII), complete cds | *Bombyx mori* |
| R2 | AF015819 | R2 | *Forficula auricularia* retrotransposon R2, complete sequence. | *Forficula auricularia* |
| R2 | EU854578 | R2 | *Triops cancriformis* non-LTR retrotransposon R2 reverse transcriptase gene, complete cds | *Triops cancriformis* |
| R2 | GU949555 | R2 | *Reticulitermes lucifugus* non-LTR retrotransposon R2, complete sequence; and R2 protein gene, complete cds | *Reticulitermes lucifugus* |
| R2 | AB097123 | rt | *Ciona intestinalis* retrotransposon R2Ci-C DNA, partial sequence | *Ciona intestinalis* |
| R2 | AB097124 | rt | *Ciona intestinalis* retrotransposon R2Ci-D DNA, partial sequence | *Ciona intestinalis* |
| R2 | FJ461304 | R2 | *Rhynchosciara americana* non-LTR retrotransposon RaR2 reverse transcriptase gene, complete cds | *Rhynchosciara americana* |
| R2 | AB097121 | rt | *Ciona intestinalis* retrotransposon R2Ci-A DNA, complete sequence | *Ciona intestinalis* |
| R2 | KP657892 | R2 | *Bacillus rossius* isolate roCAP(full).9 retrotransposon R2Br reverse transcriptase gene, partial cds | *Bacillus rossius* |
| R2 | KP657890 | R2 | *Bacillus rossius* isolate roCAP(full).7 retrotransposon R2Br reverse transcriptase gene, partial cds | *Bacillus rossius* |
| R2 | KP657888 | R2 | *Bacillus rossius* isolate roCAP(full).5 retrotransposon R2Br reverse transcriptase gene, partial cds | *Bacillus rossius* |
| R2 | KP657870 | R2 | *Bacillus rossius* isolate roCAP(full).1 retrotransposon R2Br reverse transcriptase gene, partial cds | *Bacillus rossius* |
| R2 | KP657833 | R2 | *Bacillus rossius* isolate roANZ(full).13 retrotransposon R2Br reverse transcriptase gene, partial cds | *Bacillus rossius* |
| R2 | KP657832 | R2 | *Bacillus rossius* isolate roANZ(full).12 retrotransposon R2Br reverse transcriptase gene, partial cds | *Bacillus rossius* |
| R2 | KP657830 | R2 | *Bacillus rossius* isolate roANZ(full).10 retrotransposon R2Br reverse transcriptase gene, partial cds | *Bacillus rossius* |
| R2 | KP657807 | R2 | *Bacillus rossius* isolate roANZ(−101).8 retrotransposon R2Br reverse transcriptase gene, partial cds | *Bacillus rossius* |
| R2 | KP657806 | R2 | *Bacillus rossius* isolate roANZ(−101).7 retrotransposon R2Br reverse transcriptase gene, partial cds | *Bacillus rossius* |
| R2 | KP657805 | R2 | *Bacillus rossius* isolate roANZ(−101).6 retrotransposon R2Br reverse transcriptase gene, partial cds | *Bacillus rossius* |
| R2 | KP657802 | R2 | *Bacillus rossius* isolate roANZ(−101).3 retrotransposon R2Br reverse transcriptase gene, partial cds | *Bacillus rossius* |
| R2 | KP657799 | R2 | *Bacillus rossius* isolate roANZ(−101).1 retrotransposon R2Br reverse transcriptase gene, partial cds | *Bacillus rossius* |

TABLE 2-continued

Table 2: RLE-type non-LTR retrotransposon elements

| Family | Accession | Mobile Element | Name/Description | Organism |
|---|---|---|---|---|
| R2 | FJ461304 | R2 | *Rhynchosciara americana* non-LTR retrotransposon RaR2 reverse transcriptase gene, complete cds | *Rhynchosciara americana* |
| R2 | JQ082370 | polyA_signal_sequence | *Eyprepocnemis plorans* non-LTR retrotransposon R2 R2 protein gene, complete cds | *Eyprepocnemis plorans* |
| R2 | KJ958672 | R2 | *Bacillus rossius* non-LTR retrotransposon reCUR4_deg, partial sequence | *Bacillus rossius* |
| R2 | KJ958671 | R2 | *Bacillus rossius* non-LTR retrotransposon reCUR3_deg, partial sequence | *Bacillus rossius* |
| R2 | KJ958670 | R2 | *Bacillus rossius* non-LTR retrotransposon reCUR2_deg, partial sequence | *Bacillus rossius* |
| R2 | KJ958669 | R2 | *Bacillus rossius* non-LTR retrotransposon reCUR1_deg, partial sequence | *Bacillus rossius* |
| R2 | KJ958668 | R2 | *Bacillus rossius* non-LTR retrotransposon reCDF6_deg, partial sequence | *Bacillus rossius* |
| R2 | KJ958667 | R2 | *Bacillus rossius* non-LTR retrotransposon reCDF5_deg, partial sequence | *Bacillus rossius* |
| R2 | KJ958666 | R2 | *Bacillus rossius* non-LTR retrotransposon reCDF4_deg, partial sequence | *Bacillus rossius* |
| R2 | KJ958665 | R2 | *Bacillus rossius* non-LTR retrotransposon reCDF3_deg, partial sequence | *Bacillus rossius* |
| R2 | KJ958664 | R2 | *Bacillus rossius* non-LTR retrotransposon reCDF2_deg, partial sequence | *Bacillus rossius* |
| R2 | KJ958663 | R2 | *Bacillus rossius* non-LTR retrotransposon reCDF1_deg, partial sequence | *Bacillus rossius* |
| R2 | KJ958662 | R2 | *Bacillus rossius* non-LTR retrotransposon reCOM10_deg, partial sequence | *Bacillus rossius* |
| R2 | KJ958661 | R2 | *Bacillus rossius* non-LTR retrotransposon reCOM5_deg, partial sequence | *Bacillus rossius* |
| R2 | KJ958660 | R2 | *Bacillus rossius* non-LTR retrotransposon reCOM7_deg, partial sequence | *Bacillus rossius* |
| R2 | KJ958659 | R2 | *Bacillus rossius* non-LTR retrotransposon reCOM3_deg, partial sequence | *Bacillus rossius* |
| R2 | KJ958658 | R2 | *Bacillus rossius* non-LTR retrotransposon reCOM2_deg, partial sequence | *Bacillus rossius* |
| R2 | KJ958657 | R2 | *Bacillus rossius* non-LTR retrotransposon reMSN6_deg, partial sequence | *Bacillus rossius* |
| R2 | KJ958656 | R2 | *Bacillus rossius* non-LTR retrotransposon reMSN5_deg, partial sequence | *Bacillus rossius* |
| R2 | KJ958655 | R2 | *Bacillus rossius* non-LTR retrotransposon reMSN4_deg, partial sequence | *Bacillus rossius* |
| R2 | KJ958654 | R2 | *Bacillus rossius* non-LTR retrotransposon reMSN3_deg, partial sequence | *Bacillus rossius* |
| R2 | KJ958653 | R2 | *Bacillus rossius* non-LTR retrotransposon reMSN2_deg, partial sequence | *Bacillus rossius* |
| R2 | KJ958652 | R2 | *Bacillus rossius* non-LTR retrotransposon reMSN1_deg, partial sequence | *Bacillus rossius* |
| R2 | KJ958651 | R2 | *Bacillus rossius* non-LTR retrotransposon rePAT8_deg, partial sequence | *Bacillus rossius* |

TABLE 2-continued

Table 2: RLE-type non-LTR retrotransposon elements

| Family | Accession | Mobile Element | Name/Description | Organism |
|---|---|---|---|---|
| R2 | KJ958650 | R2 | *Bacillus rossius* non-LTR retrotransposon rePAT7_deg, partial sequence | *Bacillus rossius* |
| R2 | KJ958649 | R2 | *Bacillus rossius* non-LTR retrotransposon rePAT6_deg, partial sequence | *Bacillus rossius* |
| R2 | KJ958648 | R2 | *Bacillus rossius* non-LTR retrotransposon rePAT5_deg, partial sequence | *Bacillus rossius* |
| R2 | KJ958647 | R2 | *Bacillus rossius* non-LTR retrotransposon rePAT4_deg, partial sequence | *Bacillus rossius* |
| R2 | KJ958646 | R2 | *Bacillus rossius* non-LTR retrotransposon rePAT3_deg, partial sequence | *Bacillus rossius* |
| R2 | KJ958645 | R2 | *Bacillus rossius* non-LTR retrotransposon rePAT2_deg, partial sequence | *Bacillus rossius* |
| R2 | KJ958644 | R2 | *Bacillus rossius* non-LTR retrotransposon rePAT1_deg, partial sequence | *Bacillus rossius* |
| R2 | KJ958643 | R2 | *Bacillus rossius* non-LTR retrotransposon rePAT9_deg, partial sequence | *Bacillus rossius* |
| R2 | KJ958642 | R2 | *Bacillus rossius* non-LTR retrotransposon trKOR2_deg, partial sequence | *Bacillus rossius* |
| R2 | KJ958641 | R2 | *Bacillus rossius* non-LTR retrotransposon reGAB9_deg, partial sequence | *Bacillus rossius* |
| R2 | KJ958640 | R2 | *Bacillus rossius* non-LTR retrotransposon reGAB8_deg, partial sequence | *Bacillus rossius* |
| R2 | KJ958639 | R2 | *Bacillus rossius* non-LTR retrotransposon reGAB7_deg, partial sequence | *Bacillus rossius* |
| R2 | KJ958638 | R2 | *Bacillus rossius* non-LTR retrotransposon reGAB6_deg, partial sequence | *Bacillus rossius* |
| R2 | KJ958637 | R2 | *Bacillus rossius* non-LTR retrotransposon reGAB5_deg, partial sequence | *Bacillus rossius* |
| R2 | KJ958636 | R2 | *Bacillus rossius* non-LTR retrotransposon reGAB4_deg, partial sequence | *Bacillus rossius* |
| R2 | KJ958635 | R2 | *Bacillus rossius* non-LTR retrotransposon reGAB3_deg, partial sequence | *Bacillus rossius* |
| R2 | KJ958634 | R2 | *Bacillus rossius* non-LTR retrotransposon reGAB2_deg, partial sequence | *Bacillus rossius* |
| R2 | KJ958633 | R2 | *Bacillus rossius* non-LTR retrotransposon reGAB1_deg, partial sequence | *Bacillus rossius* |
| R2 | KJ958632 | R2 | *Bacillus rossius* non-LTR retrotransposon reTDS1_deg, partial sequence | *Bacillus rossius* |
| R2 | KJ958631 | R2 | *Bacillus rossius* non-LTR retrotransposon reTDS11_deg, partial sequence | *Bacillus rossius* |
| R2 | KJ958629 | R2 | *Bacillus rossius* non-LTR retrotransposon reCOM8, partial sequence | *Bacillus rossius* |
| R2 | KJ958628 | R2 | *Bacillus rossius* non-LTR retrotransposon reCOM6, partial sequence | *Bacillus rossius* |
| R2 | KJ958627 | R2 | *Bacillus rossius* non-LTR retrotransposon reCOM4, partial sequence | *Bacillus rossius* |
| R2 | KJ958626 | R2 | *Bacillus rossius* non-LTR retrotransposon reCOM1, partial sequence | *Bacillus rossius* |
| R2 | KJ958624 | R2 | *Bacillus rossius* non-LTR retrotransposon trKOR10, partial sequence | *Bacillus rossius* |

TABLE 2-continued

Table 2: RLE-type non-LTR retrotransposon elements

| Family | Accession | Mobile Element | Name/Description | Organism |
|---|---|---|---|---|
| R2 | KJ958623 | R2 | *Bacillus rossius* non-LTR retrotransposon reGAB10, partial sequence | *Bacillus rossius* |
| R2 | KJ958619 | R2 | *Bacillus rossius* non-LTR retrotransposon trKOR4, partial sequence | *Bacillus rossius* |
| R2 | KJ958618 | R2 | *Bacillus rossius* non-LTR retrotransposon trKOR3, partial sequence | *Bacillus rossius* |
| R2 | KJ958617 | R2 | *Bacillus rossius* non-LTR retrotransposon trKOR1, partial sequence | *Bacillus rossius* |
| R2 | KJ958613 | R2 | *Bacillus rossius* non-LTR retrotransposon reVIR4, partial sequence | *Bacillus rossius* |
| R2 | KJ958612 | R2 | *Bacillus rossius* non-LTR retrotransposon reVIR3, partial sequence | *Bacillus rossius* |
| R2 | KJ958611 | R2 | *Bacillus rossius* non-LTR retrotransposon reVIR2, partial sequence | *Bacillus rossius* |
| R2 | KJ958610 | R2 | *Bacillus rossius* non-LTR retrotransposon reVIR1, partial sequence | *Bacillus rossius* |
| R2 | KJ958609 | R2 | *Bacillus rossius* non-LTR retrotransposon reTDS17, partial sequence | *Bacillus rossius* |
| R2 | KJ958608 | R2 | *Bacillus rossius* non-LTR retrotransposon reTDS16, partial sequence | *Bacillus rossius* |
| R2 | KJ958607 | R2 | *Bacillus rossius* non-LTR retrotransposon reTDS15, partial sequence | *Bacillus rossius* |
| R2 | KJ958606 | R2 | *Bacillus rossius* non-LTR retrotransposon reTDS14, partial sequence | *Bacillus rossius* |
| R2 | KJ958605 | R2 | *Bacillus rossius* non-LTR retrotransposon reTDS13, partial sequence | *Bacillus rossius* |
| R2 | KJ958604 | R2 | *Bacillus rossius* non-LTR retrotransposon reTDS12, partial sequence | *Bacillus rossius* |
| R2 | KJ958603 | R2 | *Bacillus rossius* non-LTR retrotransposon reTDS7, partial sequence | *Bacillus rossius* |
| R2 | KJ958602 | R2 | *Bacillus rossius* non-LTR retrotransposon reTDS6, partial sequence | *Bacillus rossius* |
| R2 | KJ958601 | R2 | *Bacillus rossius* non-LTR retrotransposon reTDS5, partial sequence | *Bacillus rossius* |
| R2 | KJ958600 | R2 | *Bacillus rossius* non-LTR retrotransposon reTDS4, partial sequence | *Bacillus rossius* |
| R2 | KJ958599 | R2 | *Bacillus rossius* non-LTR retrotransposon reTDS3, partial sequence | *Bacillus rossius* |
| R2 | KJ958598 | R2 | *Bacillus rossius* non-LTR retrotransposon reTDS2, partial sequence | *Bacillus rossius* |
| R2 | KJ958594 | R2 | *Bacillus rossius* non-LTR retrotransposon reBER4, partial sequence | *Bacillus rossius* |
| R2 | KJ958593 | R2 | *Bacillus rossius* non-LTR retrotransposon reBER2, partial sequence | *Bacillus rossius* |
| R2 | KJ958592 | R2 | *Bacillus rossius* non-LTR retrotransposon reBER1, partial sequence | *Bacillus rossius* |
| R2 | KJ958591 | R2 | *Bacillus rossius* non-LTR retrotransposon roFOL7, partial sequence | *Bacillus rossius* |
| R2 | KJ958590 | R2 | *Bacillus rossius* non-LTR retrotransposon roFOL6, partial sequence | *Bacillus rossius* |

TABLE 2-continued

Table 2: RLE-type non-LTR retrotransposon elements

| Family | Accession | Mobile Element | Name/Description | Organism |
|---|---|---|---|---|
| R2 | KJ958589 | R2 | *Bacillus rossius* non-LTR retrotransposon roFOL5, partial sequence | *Bacillus rossius* |
| R2 | KJ958588 | R2 | *Bacillus rossius* non-LTR retrotransposon roFOL4, partial sequence | *Bacillus rossius* |
| R2 | KJ958587 | R2 | *Bacillus rossius* non-LTR retrotransposon roFOL3, partial sequence | *Bacillus rossius* |
| R2 | KJ958586 | R2 | *Bacillus rossius* non-LTR retrotransposon roFOL2, partial sequence | *Bacillus rossius* |
| R2 | KJ958585 | R2 | *Bacillus rossius* non-LTR retrotransposon roFOL1, partial sequence | *Bacillus rossius* |
| R2 | KJ958584 | R2 | *Bacillus rossius* non-LTR retrotransposon roANZ10, partial sequence | *Bacillus rossius* |
| R2 | KJ958583 | R2 | *Bacillus rossius* non-LTR retrotransposon roANZ9, partial sequence | *Bacillus rossius* |
| R2 | KJ958582 | R2 | *Bacillus rossius* non-LTR retrotransposon roANZ8, partial sequence | *Bacillus rossius* |
| R2 | KJ958581 | R2 | *Bacillus rossius* non-LTR retrotransposon roANZ7, partial sequence | *Bacillus rossius* |
| R2 | KJ958580 | R2 | *Bacillus rossius* non-LTR retrotransposon roANZ6, partial sequence | *Bacillus rossius* |
| R2 | KJ958579 | R2 | *Bacillus rossius* non-LTR retrotransposon roANZ5, partial sequence | *Bacillus rossius* |
| R2 | KJ958578 | R2 | *Bacillus rossius* non-LTR retrotransposon roANZ4, partial sequence | *Bacillus rossius* |
| R2 | KJ958577 | R2 | *Bacillus rossius* non-LTR retrotransposon roANZ3, partial sequence | *Bacillus rossius* |
| R2 | KJ958576 | R2 | *Bacillus rossius* non-LTR retrotransposon roANZ2, partial sequence | *Bacillus rossius* |
| R2 | KJ958575 | R2 | *Bacillus rossius* non-LTR retrotransposon roANZ1, partial sequence | *Bacillus rossius* |
| R2 | KJ958574 | R2 | *Bacillus rossius* non-LTR retrotransposon roCAP9, partial sequence | *Bacillus rossius* |
| R2 | KJ958573 | R2 | *Bacillus rossius* non-LTR retrotransposon roCAP8, partial sequence | *Bacillus rossius* |
| R2 | KJ958572 | R2 | *Bacillus rossius* non-LTR retrotransposon roCAP7, partial sequence | *Bacillus rossius* |
| R2 | KJ958571 | R2 | *Bacillus rossius* non-LTR retrotransposon roCAP6, partial sequence | *Bacillus rossius* |
| R2 | KJ958570 | R2 | *Bacillus rossius* non-LTR retrotransposon roCAP5, partial sequence | *Bacillus rossius* |
| R2 | KJ958569 | R2 | *Bacillus rossius* non-LTR retrotransposon roCAP4, partial sequence | *Bacillus rossius* |
| R2 | KJ958568 | R2 | *Bacillus rossius* non-LTR retrotransposon roCAP3, partial sequence | *Bacillus rossius* |
| R2 | KJ958567 | R2 | *Bacillus rossius* non-LTR retrotransposon roCAP2, partial sequence | *Bacillus rossius* |
| R2 | KJ958566 | R2 | *Bacillus rossius* non-LTR retrotransposon roCAP1, partial sequence | *Bacillus rossius* |
| R2 | KJ958565 | R2 | *Bacillus rossius* non-LTR retrotransposon roCAP10, partial sequence | *Bacillus rossius* |

TABLE 2-continued

Table 2: RLE-type non-LTR retrotransposon elements

| Family | Accession | Mobile Element | Name/Description | Organism |
|---|---|---|---|---|
| R2 | JN937654 | R2 | *Lepidurus apus lubbocki* isolate lu8a 28S ribosomal RNA gene, partial sequence; and non-LTR retrotransposon psR2Ll, complete sequence | *Lepidurus apus lubbocki* |
| R2 | JN937653 | R2 | *Lepidurus apus lubbocki* isolate lu7a 28S ribosomal RNA gene, partial sequence; and non-LTR retrotransposon psR2Ll, complete sequence | *Lepidurus apus lubbocki* |
| R2 | JN937652 | R2 | *Lepidurus apus lubbocki* isolate lu2a 28S ribosomal RNA gene, partial sequence; and non-LTR retrotransposon psR2Ll, complete sequence | *Lepidurus apus lubbocki* |
| R2 | JN937651 | R2 | *Lepidurus apus lubbocki* isolate b7c7 28S ribosomal RNA gene, partial sequence; and non-LTR retrotransposon psR2Ll, complete sequence | *Lepidurus apus lubbocki* |
| R2 | JN937650 | R2 | *Lepidurus apus lubbocki* isolate b6c4 28S ribosomal RNA gene, partial sequence; and non-LTR retrotransposon psR2Ll, complete sequence | *Lepidurus apus lubbocki* |
| R2 | JN937649 | R2 | *Lepidurus apus lubbocki* isolate lu5a 28S ribosomal RNA gene, partial sequence; and non-LTR retrotransposon psR2Ll, complete sequence | *Lepidurus apus lubbocki* |
| R2 | JN937648 | R2 | *Lepidurus apus lubbocki* isolate lu1a 28S ribosomal RNA gene, partial sequence; and non-LTR retrotransposon psR2Ll, complete sequence | *Lepidurus apus lubbocki* |
| R2 | JN937647 | R2 | *Lepidurus apus lubbocki* isolate b6c5 28S ribosomal RNA gene, partial sequence; and non-LTR retrotransposon psR2Ll, complete sequence | *Lepidurus apus lubbocki* |
| R2 | JN937646 | R2 | *Lepidurus apus lubbocki* isolate b6c6 28S ribosomal RNA gene, partial sequence; and non-LTR retrotransposon psR2Ll, complete sequence | *Lepidurus apus lubbocki* |
| R2 | JN937645 | R2 | *Lepidurus apus lubbocki* isolate lu4a 28S ribosomal RNA gene, partial sequence; and non-LTR retrotransposon psR2Ll, complete sequence | *Lepidurus apus lubbocki* |
| R2 | JN937644 | R2 | *Lepidurus apus lubbocki* isolate lu3a 28S ribosomal RNA gene, partial sequence; and non-LTR retrotransposon psR2Ll, complete sequence | *Lepidurus apus lubbocki* |
| R2 | JN937643 | R2 | *Lepidurus apus lubbocki* isolate b6c3 28S ribosomal RNA gene, partial sequence; and non-LTR retrotransposon psR2Ll, complete sequence | *Lepidurus apus lubbocki* |
| R2 | JN937642 | R2 | *Lepidurus apus lubbocki* isolate lu6a 28S ribosomal RNA gene, partial sequence; and non-LTR retrotransposon psR2Ll, complete sequence | *Lepidurus apus lubbocki* |
| R2 | JN937641 | R2 | *Lepidurus apus lubbocki* isolate LM5h2 28S ribosomal RNA gene, partial sequence; and non-LTR retrotransposon R2Ll, complete sequence | *Lepidurus apus lubbocki* |
| R2 | JN937640 | R2 | *Lepidurus apus lubbocki* isolate LM2h5 28S ribosomal RNA gene, partial sequence; and non-LTR retrotransposon R2Ll, complete sequence | *Lepidurus apus lubbocki* |

TABLE 2-continued

Table 2: RLE-type non-LTR retrotransposon elements

| Family | Accession | Mobile Element | Name/Description | Organism |
|---|---|---|---|---|
| R2 | JN937639 | R2 | *Lepidurus apus lubbocki* isolate LM2h4 28S ribosomal RNA gene, partial sequence; and non-LTR retrotransposon R2Ll, complete sequence | *Lepidurus apus lubbocki* |
| R2 | JN937638 | R2 | *Lepidurus apus lubbocki* isolate LM5h5 28S ribosomal RNA gene, partial sequence; and non-LTR retrotransposon R2Ll, complete sequence | *Lepidurus apus lubbocki* |
| R2 | JN937637 | R2 | *Lepidurus apus lubbocki* isolate LM5h4 28S ribosomal RNA gene, partial sequence; and non-LTR retrotransposon R2Ll, complete sequence | *Lepidurus apus lubbocki* |
| R2 | JN937636 | R2 | *Lepidurus apus lubbocki* isolate LM5h3 28S ribosomal RNA gene, partial sequence; and non-LTR retrotransposon R2Ll, complete sequence | *Lepidurus apus lubbocki* |
| R2 | JN937635 | R2 | *Lepidurus apus lubbocki* isolate LM5h1 28S ribosomal RNA gene, partial sequence; and non-LTR retrotransposon R2Ll, complete sequence | *Lepidurus apus lubbocki* |
| R2 | JN937634 | R2 | *Lepidurus apus lubbocki* isolate LM2h3 28S ribosomal RNA gene, partial sequence; and non-LTR retrotransposon R2Ll, complete sequence | *Lepidurus apus lubbocki* |
| R2 | JN937633 | R2 | *Lepidurus apus lubbocki* isolate LM2h2 28S ribosomal RNA gene, partial sequence; and non-LTR retrotransposon R2Ll, complete sequence | *Lepidurus apus lubbocki* |
| R2 | JN937632 | R2 | *Lepidurus apus lubbocki* isolate LM2h1 28S ribosomal RNA gene, partial sequence; and non-LTR retrotransposon R2Ll, complete sequence | *Lepidurus apus lubbocki* |
| R2 | JN937631 | R2 | *Lepidurus arcticus* isolate T6 28S ribosomal RNA gene, partial sequence; and non-LTR retrotransposon R2La, complete sequence | *Lepidurus arcticus* |
| R2 | JN937630 | R2 | *Lepidurus arcticus* isolate T5 28S ribosomal RNA gene, partial sequence; and non-LTR retrotransposon R2La, complete sequence | *Lepidurus arcticus* |
| R2 | JN937629 | R2 | *Lepidurus arcticus* isolate T4 28S ribosomal RNA gene, partial sequence; and non-LTR retrotransposon R2La, complete sequence | *Lepidurus arcticus* |
| R2 | JN937628 | R2 | *Lepidurus arcticus* isolate T3 28S ribosomal RNA gene, partial sequence; and non-LTR retrotransposon R2La, complete sequence | *Lepidurus arcticus* |
| R2 | JN937627 | R2 | *Lepidurus arcticus* isolate T2 28S ribosomal RNA gene, partial sequence; and non-LTR retrotransposon R2La, complete sequence | *Lepidurus arcticus* |
| R2 | JN937626 | R2 | *Lepidurus arcticus* isolate T1 28S ribosomal RNA gene, partial sequence; and non-LTR retrotransposon R2La, complete sequence | *Lepidurus arcticus* |
| R2 | JN937625 | R2 | *Lepidurus arcticus* isolate V4 28S ribosomal RNA gene, partial sequence; and non-LTR retrotransposon R2La, complete sequence | *Lepidurus arcticus* |

TABLE 2-continued

| Table 2: RLE-type non-LTR retrotransposon elements | | | | |
|---|---|---|---|---|
| Family | Accession | Mobile Element | Name/Description | Organism |
| R2 | JN937624 | R2 | *Lepidurus arcticus* isolate V3 28S ribosomal RNA gene, partial sequence; and non-LTR retrotransposon R2La, complete sequence | *Lepidurus arcticus* |
| R2 | JN937623 | R2 | *Lepidurus arcticus* isolate V2 28S ribosomal RNA gene, partial sequence; and non-LTR retrotransposon R2La, complete sequence | *Lepidurus arcticus* |
| R2 | JN937622 | R2 | *Lepidurus arcticus* isolate V1 28S ribosomal RNA gene, partial sequence; and non-LTR retrotransposon R2La, complete sequence | *Lepidurus arcticus* |
| R2 | JN937615 | R2 | *Lepidurus couesii* isolate D3a7f 28S ribosomal RNA gene, partial sequence; and non-LTR retrotransposon R2LcB, complete sequence | *Lepidurus couesii* |
| R2 | JN937614 | R2 | *Lepidurus couesii* isolate D3a5f 28S ribosomal RNA gene, partial sequence; and non-LTR retrotransposon R2LcB, complete sequence | *Lepidurus couesii* |
| R2 | JN937613 | R2 | *Lepidurus couesii* isolate D3a4f 28S ribosomal RNA gene, partial sequence; and non-LTR retrotransposon R2LcB, complete sequence | *Lepidurus couesii* |
| R2 | JN937612 | R2 | *Lepidurus couesii* isolate D3a3f 28S ribosomal RNA gene, partial sequence; and non-LTR retrotransposon R2LcB, complete sequence | *Lepidurus couesii* |
| R2 | JN937611 | R2 | *Lepidurus couesii* isolate D3a2f 28S ribosomal RNA gene, partial sequence; and non-LTR retrotransposon R2LcB, complete sequence | *Lepidurus couesii* |
| R2 | JN937610 | R2 | *Lepidurus couesii* isolate D3_8 28S ribosomal RNA gene, partial sequence; and non-LTR retrotransposon R2LcB, complete sequence | *Lepidurus couesii* |
| R2 | JN937609 | R2 | *Lepidurus couesii* isolate D3_7 28S ribosomal RNA gene, partial sequence; and non-LTR retrotransposon R2LcB, complete sequence | *Lepidurus couesii* |
| R2 | JN937608 | R2 | *Lepidurus couesii* isolate D3_6 28S ribosomal RNA gene, partial sequence; and non-LTR retrotransposon R2LcB, complete sequence | *Lepidurus couesii* |
| R2 | JN937607 | R2 | *Lepidurus couesii* isolate D3_5 28S ribosomal RNA gene, partial sequence; and non-LTR retrotransposon R2LcB, complete sequence | *Lepidurus couesii* |
| R2 | JN937606 | R2 | *Lepidurus couesii* isolate D3_4 28S ribosomal RNA gene, partial sequence; and non-LTR retrotransposon R2LcB, complete sequence | *Lepidurus couesii* |
| R2 | JN937605 | R2 | *Lepidurus couesii* isolate D3_3 28S ribosomal RNA gene, partial sequence; and non-LTR retrotransposon R2LcB, complete sequence | *Lepidurus couesii* |
| R2 | JN937604 | R2 | *Lepidurus couesii* isolate D3_2 28S ribosomal RNA gene, partial sequence; and non-LTR retrotransposon R2LcB, complete sequence | *Lepidurus couesii* |

TABLE 2-continued

Table 2: RLE-type non-LTR retrotransposon elements

| Family | Accession | Mobile Element | Name/Description | Organism |
|---|---|---|---|---|
| R2 | JN937603 | R2 | *Lepidurus couesii* isolate D3_1 28S ribosomal RNA gene, partial sequence; and non-LTR retrotransposon R2LcB, complete sequence | *Lepidurus couesii* |
| R2 | JN937602 | R2 | *Lepidurus couesii* isolate C2_5 28S ribosomal RNA gene, partial sequence; and non-LTR retrotransposon R2LcA, complete sequence | *Lepidurus couesii* |
| R2 | JN937601 | R2 | *Lepidurus couesii* isolate LcoC2r1_5 28S ribosomal RNA gene, partial sequence; and non-LTR retrotransposon R2LcA, complete sequence | *Lepidurus couesii* |
| R2 | JN937600 | R2 | *Lepidurus couesii* isolate LcoC2r1_6 28S ribosomal RNA gene, partial sequence; and non-LTR retrotransposon R2LcA, complete sequence | *Lepidurus couesii* |
| R2 | JN937599 | R2 | *Lepidurus couesii* isolate C2_8 28S ribosomal RNA gene, partial sequence; and non-LTR retrotransposon R2LcA, complete sequence | *Lepidurus couesii* |
| R2 | JN937598 | R2 | *Lepidurus couesii* isolate C2_4 28S ribosomal RNA gene, partial sequence; and non-LTR retrotransposon R2LcA, complete sequence | *Lepidurus couesii* |
| R2 | JN937597 | R2 | *Lepidurus couesii* isolate C2_9 28S ribosomal RNA gene, partial sequence; and non-LTR retrotransposon R2LcA, complete sequence | *Lepidurus couesii* |
| R2 | JN937596 | R2 | *Lepidurus couesii* isolate C2_7 28S ribosomal RNA gene, partial sequence; and non-LTR retrotransposon R2LcA, complete sequence | *Lepidurus couesii* |
| R2 | JN937595 | R2 | *Lepidurus couesii* isolate C2_6 28S ribosomal RNA gene, partial sequence; and non-LTR retrotransposon R2LcA, complete sequence | *Lepidurus couesii* |
| R2 | JN937594 | R2 | *Lepidurus couesii* isolate C2_3 28S ribosomal RNA gene, partial sequence; and non-LTR retrotransposon R2LcA, complete sequence | *Lepidurus couesii* |
| R2 | JN937593 | R2 | *Lepidurus couesii* isolate C2_2 28S ribosomal RNA gene, partial sequence; and non-LTR retrotransposon R2LcA, complete sequence | *Lepidurus couesii* |
| R2 | JN937592 | R2 | *Lepidurus couesii* isolate C2_1 28S ribosomal RNA gene, partial sequence; and non-LTR retrotransposon R2LcA, complete sequence | *Lepidurus couesii* |
| R2 | AF015822 | R2 ORF | *Tenebrio molitor* retrotransposon R2 reverse transcriptase gene, partial cds | *Tenebrio molitor* |
| R2 | AF015817 | R2 ORF | *Tenebrio molitor* retrotransposon R2 reverse transcriptase gene, partial cds | *Tenebrio molitor* |
| R2 | AF015816 | R2 ORF | *Hippodamia convergens* retrotransposon R2 reverse transcriptase gene, partial cds | *Hippodamia convergens* |
| R2 | KP657866 | retrotransposon: R2Br | *Bacillus rossius* isolate roCAP(−714).5 retrotransposon R2Br reverse transcriptase gene, partial cds | *Bacillus rossius* |

TABLE 2-continued

Table 2: RLE-type non-LTR retrotransposon elements

| Family | Accession | Mobile Element | Name/Description | Organism |
|---|---|---|---|---|
| R2 | KP657865 | retrotransposon: R2Br | *Bacillus rossius* isolate roCAP(−714).4 retrotransposon R2Br reverse transcriptase gene, partial cds | *Bacillus rossius* |
| R2 | KP657863 | retrotransposon: R2Br | *Bacillus rossius* isolate roCAP(−714).2 retrotransposon R2Br reverse transcriptase gene, partial cds | *Bacillus rossius* |
| R2 | KP657862 | retrotransposon: R2Br | *Bacillus rossius* isolate roCAP(−714).1 retrotransposon R2Br reverse transcriptase gene, partial cds | *Bacillus rossius* |
| R2 | KP657861 | retrotransposon: R2Br | *Bacillus rossius* isolate roCAP(−1297).9 retrotransposon R2Br reverse transcriptase gene, partial cds | *Bacillus rossius* |
| R2 | KP657860 | retrotransposon: R2Br | *Bacillus rossius* isolate roCAP(−1297).8 retrotransposon R2Br reverse transcriptase gene, partial cds | *Bacillus rossius* |
| R2 | KP657859 | retrotransposon: R2Br | *Bacillus rossius* isolate roCAP(−1297).7 retrotransposon R2Br reverse transcriptase gene, partial cds | *Bacillus rossius* |
| R2 | KP657858 | retrotransposon: R2Br | *Bacillus rossius* isolate roCAP(−1297).6 retrotransposon R2Br reverse transcriptase gene, partial cds | *Bacillus rossius* |
| R2 | KP657857 | retrotransposon: R2Br | *Bacillus rossius* isolate roCAP(−1297).5 retrotransposon R2Br reverse transcriptase gene, partial cds | *Bacillus rossius* |
| R2 | KP657856 | retrotransposon: R2Br | *Bacillus rossius* isolate roCAP(−1297).4 retrotransposon R2Br reverse transcriptase gene, partial cds | *Bacillus rossius* |
| R2 | KP657855 | retrotransposon: R2Br | *Bacillus rossius* isolate roCAP(−1297).3 retrotransposon R2Br reverse transcriptase gene, partial cds | *Bacillus rossius* |
| R2 | KP657854 | retrotransposon: R2Br | *Bacillus rossius* isolate roCAP(−1297).2 retrotransposon R2Br reverse transcriptase gene, partial cds | *Bacillus rossius* |
| R2 | KP657853 | retrotransposon: R2Br | *Bacillus rossius* isolate roCAP(−1297).10 retrotransposon R2Br reverse transcriptase gene, partial cds | *Bacillus rossius* |
| R2 | KP657852 | retrotransposon: R2Br | *Bacillus rossius* isolate roCAP(−1297).1 retrotransposon R2Br reverse transcriptase gene, partial cds | *Bacillus rossius* |
| R2 | KP657851 | retrotransposon: R2Br | *Bacillus rossius* isolate roCAP(−1172).9 retrotransposon R2Br reverse transcriptase gene, partial cds | *Bacillus rossius* |
| R2 | KP657850 | retrotransposon: R2Br | *Bacillus rossius* isolate roCAP(−1172).8 retrotransposon R2Br reverse transcriptase gene, partial cds | *Bacillus rossius* |
| R2 | KP657849 | retrotransposon: R2Br | *Bacillus rossius* isolate roCAP(−1172).7 retrotransposon R2Br reverse transcriptase gene, partial cds | *Bacillus rossius* |
| R2 | KP657848 | retrotransposon: R2Br | *Bacillus rossius* isolate roCAP(−1172).6 retrotransposon R2Br reverse transcriptase gene, partial cds | *Bacillus rossius* |
| R2 | KP657847 | retrotransposon: R2Br | *Bacillus rossius* isolate roCAP(−1172).5 retrotransposon R2Br reverse transcriptase gene, partial cds | *Bacillus rossius* |
| R2 | KP657846 | retrotransposon: R2Br | *Bacillus rossius* isolate roCAP(−1172).4 retrotransposon R2Br reverse transcriptase gene, partial cds | *Bacillus rossius* |

TABLE 2-continued

Table 2: RLE-type non-LTR retrotransposon elements

| Family | Accession | Mobile Element | Name/Description | Organism |
|---|---|---|---|---|
| R2 | KP657845 | retrotransposon: R2Br | *Bacillus rossius* isolate roCAP(−1172).3 retrotransposon R2Br reverse transcriptase gene, partial cds | *Bacillus rossius* |
| R2 | KP657844 | retrotransposon: R2Br | *Bacillus rossius* isolate roCAP(−1172).2 retrotransposon R2Br reverse transcriptase gene, partial cds | *Bacillus rossius* |
| R2 | KP657843 | retrotransposon: R2Br | *Bacillus rossius* isolate roCAP(−1172).10 retrotransposon R2Br reverse transcriptase gene, partial cds | *Bacillus rossius* |
| R2 | KP657842 | retrotransposon: R2Br | *Bacillus rossius* isolate roCAP(−1172).1 retrotransposon R2Br reverse transcriptase gene, partial cds | *Bacillus rossius* |
| R2 | KP657824 | retrotransposon: R2Br | *Bacillus rossius* isolate roANZ(−1062).5 retrotransposon R2Br reverse transcriptase gene, partial cds | *Bacillus rossius* |
| R2 | KP657823 | retrotransposon: R2Br | *Bacillus rossius* isolate roANZ(−1062).4 retrotransposon R2Br reverse transcriptase gene, partial cds | *Bacillus rossius* |
| R2 | KP657822 | retrotransposon: R2Br | *Bacillus rossius* isolate roANZ(−1062).3 retrotransposon R2Br reverse transcriptase gene, partial cds | *Bacillus rossius* |
| R2 | KP657820 | retrotransposon: R2Br | *Bacillus rossius* isolate roANZ(−1062).2 retrotransposon R2Br reverse transcriptase gene, partial cds | *Bacillus rossius* |
| R2 | KP657816 | retrotransposon: R2Br | *Bacillus rossius* isolate roANZ(−1062).16 retrotransposon R2Br reverse transcriptase gene, partial cds | *Bacillus rossius* |
| R2 | KP657814 | retrotransposon: R2Br | *Bacillus rossius* isolate roANZ(−1062).14 retrotransposon R2Br reverse transcriptase gene, partial cds | *Bacillus rossius* |
| R2 | KP657810 | retrotransposon: R2Br | *Bacillus rossius* isolate roANZ(−1062).10 retrotransposon R2Br reverse transcriptase gene, partial cds | *Bacillus rossius* |
| R2 | KP657809 | retrotransposon: R2Br | *Bacillus rossius* isolate roANZ(−1062).1 retrotransposon R2Br reverse transcriptase gene, partial cds | *Bacillus rossius* |
| R2 | KP657759 | retrotransposon: R2Br | *Bacillus rossius* isolate rePAT(−1297).8 retrotransposon R2Br reverse transcriptase gene, partial cds | *Bacillus rossius* |
| R2 | KP657757 | retrotransposon: R2Br | *Bacillus rossius* isolate rePAT(−1297).6 retrotransposon R2Br reverse transcriptase gene, partial cds | *Bacillus rossius* |
| R2 | KP657751 | retrotransposon: R2Br | *Bacillus rossius* isolate rePAT(−1297).1 retrotransposon R2Br reverse transcriptase gene, partial cds | *Bacillus rossius* |
| R2 | AB097125 | rt | *Ciona savignyi* retrotransposon R2Cs-D DNA, partial sequence | *Ciona savignyi* |
| R2 | AB097124 | rt | *Ciona intestinalis* retrotransposon R2Ci-D DNA, partial sequence | *Ciona intestinalis* |
| R2 | AB097123 | rt | *Ciona intestinalis* retrotransposon R2Ci-C DNA, partial sequence | *Ciona intestinalis* |
| R2 | AB097121 | rt | *Ciona intestinalis* retrotransposon R2Ci-A DNA, complete sequence | *Ciona intestinalis* |
| R2 | AB201417 | rt | *Triops longicaudatus* non-LTR retrotransposon R2Tl gene for reverse transcriptase, partial cds | *Triops longicaudatus* |

TABLE 2-continued

Table 2: RLE-type non-LTR retrotransposon elements

| Family | Accession | Mobile Element | Name/Description | Organism |
|---|---|---|---|---|
| R2 | AB201416 | rt | *Procambarus clarkii* non-LTR retrotransposon R2Pc gene for reverse transcriptase, partial cds | *Procambarus clarkii* |
| R2 | AB201415 | rt | *Hasarius adansoni* non-LTR retrotransposon R2Ha gene for reverse transcriptase, partial cds | *Hasarius adansoni* |
| R2 | AB201414 | rt | *Metacrinus rotundus* non-LTR retrotransposon R2Mr gene for reverse transcriptase, partial cds | *Metacrinus rotundus* |
| R2 | AB201413 | rt | *Mauremys reevesii* non-LTR retrotransposon R2Cr-B2 gene for reverse transcriptase, partial cds | *Mauremys reevesii* |
| R2 | AB201412 | rt | *Mauremys reevesii* non-LTR retrotransposon R2Cr-B1 gene for reverse transcriptase, partial cds | *Mauremys reevesii* |
| R2 | AB201411 | rt | *Mauremys reevesii* non-LTR retrotransposon R2Cr-A gene for reverse transcriptase, partial cds | *Mauremys reevesii* |
| R2 | AB201410 | rt | *Oryzias latipes* non-LTR retrotransposon R2Ol-A gene for reverse transcriptase, partial cds | *Oryzias latipes* |
| R2 | AB201409 | rt | *Tanichthys albonubes* non-LTR retrotransposon R2Ta gene for reverse transcriptase, partial cds | *Tanichthys albonubes* |
| R2 | AB201408 | rt | *Eptatretus burgeri* non-LTR retrotransposon R2Eb gene for reverse transcriptase, partial cds | *Eptatretus burgeri* |
| R2 | DQ099732 | transposon: R2-like non-LTR retrotransposon R2Ag | *Aedes aegypti* transposon R2-like non-LTR retrotransposon R2Ag reverse transcriptase (pol) gene, partial cds | *Aedes aegypti* |
| R2 | DQ099728 | transposon: R2-like non-LTR retrotransposon R2Ag_B | *Aedes aegypti* transposon R2-like non-LTR retrotransposon R2Ag_B reverse transcriptase (pol) gene, partial cds | *Aedes aegypti* |
| R2 | GU949559 | | *Kalotermes flavicollis* isolate Livorno non-LTR retrotransposon R2, complete sequence; and R2 protein gene, complete cds | *Kalotermes flavicollis* |
| R2 | GU949557 | | *Reticulitermes balkanensis* non-LTR retrotransposon R2, partial sequence; and R2 protein gene, partial cds | *Reticulitermes balkanensis* |
| R2 | GU949556 | | *Reticulitermes grassei* non-LTR retrotransposon R2, partial sequence; and R2 protein gene, partial cds | *Reticulitermes grassei* |
| R2 | GU949554 | | *Reticulitermes urbis* non-LTR retrotransposon R2, complete sequence; and R2 protein gene, complete cds | *Reticulitermes urbis* |
| R2 | AF412214 | | *Schistosoma japonicum* clone S10A non-LTR retrotransposon SjR2-like, partial sequence | *Schistosoma japonicum* |
| R2 | AF015685 | | *Drosophila mercatorum* R2 retrotransposon reverse transcriptase domain protein gene, complete cds | *Drosophila mercatorum* |
| R2 | KJ958674 | | *Bacillus rossius* retrotransposon R2Br, complete sequence | *Bacillus rossius* |
| R2 | AF015814 | R2 | *Limulus polyphemus* retrotransposon R2, complete sequence | *Limulus polyphemus* |

TABLE 2-continued

Table 2: RLE-type non-LTR retrotransposon elements

| Family | Accession | Mobile Element | Name/Description | Organism |
|---|---|---|---|---|
| R2 | M16558 | R2 | *Bombyx mori* rDNA insertion element R2 (typeII), complete cds. | *Bombyx mori* |
| R2 | GQ398057 | R9Av | *Adineta vaga* copy 1 non-LTR retrotransposon R9, complete sequence; and disrupted 28S ribosomal RNA gene, partial sequence | *Adineta vaga* |
| R2Bm | AB076841 | R2 | *Bombyx mori* non-LTR retrotransposon R2Bm gene for reverse transcriptase, complete cds and 28S rRNA | *Bombyx mori* |
| R2Ci-B | AB097122 | rt | *Ciona intestinalis* retrotransposon R2Ci-B DNA, complete sequence | *Ciona intestinalis* |
| R2Dr | AB097126 | rt | *Danio rerio* retrotransposon R2Dr DNA, complete sequence | *Danio rerio* |
| R4 | AH003588 | | *Parascaris equorum* transposon non-LTR retrotransposable element R4 reverse transcriptase gene, partial cds | *Parascaris equorum* |
| R4 | ALU29445 | R4 | *Ascaris lumbricoides* site-specific non-LTR retrotransposable element R4 in 26S rDNA, complete sequence | *Ascaris lumbricoides* |
| R4 | L08889 | R4 Dong | *Bombyx mori* reverse transcriptase gene, complete cds | *Bombyx mori* |
| R4 | DQ836390 | MalR4-5 | *Maculinea alcon* R4-like non-LTR retrotransposon R4-5 reverse transcriptase (RT) pseudogene, partial sequence | *Phengaris alcon* |
| R4 | DQ836385 | MnaR4-3 | *Maculinea nausithous* R4-like non-LTR retrotransposon R4-3 reverse transcriptase (RT) pseudogene, partial sequence | *Phengaris nausithous* |
| R4 | DQ836386 | MnaR4-4 | *Maculinea nausithous* R4-like non-LTR retrotransposon R4-4 reverse transcriptase (RT) pseudogene, partial sequence | *Phengaris nausithous* |
| R4 | DQ836387 | MnaR4-7 | *Maculinea nausithous* R4-like non-LTR retrotransposon R4-7 reverse transcriptase (RT) pseudogene, partial sequence | *Phengaris nausithous* |
| R4 | DQ836388 | MnaR4-8 | *Maculinea nausithous* R4-like non-LTR retrotransposon R4-8 reverse transcriptase (RT) pseudogene, partial sequence | *Phengaris nausithous* |
| R4 | DQ836389 | MnaR4-9 | *Maculinea nausithous* R4-like non-LTR retrotransposon R4-9 reverse transcriptase (RT) pseudogene, partial sequence | *Phengaris nausithous* |
| R4 | DQ836379 | MteR4-1 | *Maculinea teleius* R4-like non-LTR retrotransposon R4-1 reverse transcriptase (RT) pseudogene, partial sequence | *Phengaris teleius* |
| R4 | DQ836384 | MteR4-10 | *Maculinea teleius* R4-like non-LTR retrotransposon R4-10 reverse transcriptase (RT) pseudogene, partial sequence | *Phengaris teleius* |
| R4 | DQ836367 | MteR4-2 | *Maculinea teleius* R4-like non-LTR retrotransposon R4-2 reverse transcriptase (RT) gene, partial cds | *Phengaris teleius* |
| R4 | DQ836380 | MteR4-3 | *Maculinea teleius* R4-like non-LTR retrotransposon R4-3 reverse transcriptase (RT) pseudogene, partial sequence | *Phengaris teleius* |
| R4 | DQ836381 | MteR4-4 | *Maculinea teleius* R4-like non-LTR retrotransposon R4-4 reverse transcriptase (RT) pseudogene, partial sequence | *Phengaris teleius* |
| R4 | DQ836382 | MteR4-6 | *Maculinea teleius* R4-like non-LTR retrotransposon R4-6 reverse transcriptase (RT) pseudogene, partial sequence | *Phengaris teleius* |

TABLE 2-continued

Table 2: RLE-type non-LTR retrotransposon elements

| Family | Accession | Mobile Element | Name/Description | Organism |
|---|---|---|---|---|
| R4 | DQ836383 | MteR4-8 | *Maculinea teleius* R4-like non-LTR retrotransposon R4-8 reverse transcriptase (RT) pseudogene, partial sequence | *Phengaris teleius* |
| R4 | DQ836374 | transposon: R4-like non-LTR retrotransposon R4-1 | *Maculinea alcon* R4-like non-LTR retrotransposon R4-1 reverse transcriptase (RT) gene, partial cds | *Phengaris alcon* |
| R4 | DQ836373 | transposon: R4-like non-LTR retrotransposon R4-1 | *Maculinea nausithous* R4-like non-LTR retrotransposon R4-1 reverse transcriptase (RT) gene, partial cds | *Phengaris nausithous* |
| R4 | DQ836375 | transposon: R4-like non-LTR retrotransposon R4-2 | *Maculinea alcon* R4-like non-LTR retrotransposon R4-2 reverse transcriptase (RT) gene, partial cds | *Phengaris alcon* |
| R4 | DQ836376 | transposon: R4-like non-LTR retrotransposon R4-3 | *Maculinea alcon* R4-like non-LTR retrotransposon R4-3 reverse transcriptase (RT) gene, partial cds | *Phengaris alcon* |
| R4 | DQ836377 | transposon: R4-like non-LTR retrotransposon R4-4 | *Maculinea alcon* R4-like non-LTR retrotransposon R4-4 reverse transcriptase (RT) gene, partial cds | *Phengaris alcon* |
| R4 | DQ836371 | transposon: R4-like non-LTR retrotransposon R4-5 | *Maculinea nausithous* R4-like non-LTR retrotransposon R4-5 reverse transcriptase (RT) gene, partial cds | *Phengaris nausithous* |
| R4 | DQ836368 | transposon: R4-like non-LTR retrotransposon R4-5 | *Maculinea teleius* R4-like non-LTR retrotransposon R4-5 reverse transcriptase (RT) gene, partial cds | *Phengaris teleius* |
| R4 | DQ836378 | transposon: R4-like non-LTR retrotransposon R4-6 | *Maculinea alcon* R4-like non-LTR retrotransposon R4-6 reverse transcriptase (RT) gene, partial cds | *Phengaris alcon* |
| R4 | DQ836372 | transposon: R4-like non-LTR retrotransposon R4-6 | *Maculinea nausithous* R4-like non-LTR retrotransposon R4-6 reverse transcriptase (RT) gene, partial cds | *Phengaris nausithous* |
| R4 | DQ836369 | transposon: R4-like non-LTR retrotransposon R4-7 | *Maculinea teleius* R4-like non-LTR retrotransposon R4-7 reverse transcriptase (RT) gene, partial cds | *Phengaris teleius* |
| R4 | DQ836370 | transposon: R4-like non-LTR retrotransposon R4-9 | *Maculinea teleius* R4-like non-LTR retrotransposon R4-9 reverse transcriptase (RT) gene, partial cds | *Phengaris teleius* |
| R4 | AF286191 | transposon: retrotransposon Rex6 | *Xiphophorus maculatus* retrotransposon Rex6 reverse transcriptase pseudogene, partial sequence | *Xiphophorus maculatus* |
| R5 | KJ958673 | R2 | *Bacillus rossius* non-LTR retrotransposon reCUR5_deg, partial sequence | *Bacillus rossius* |
| R5 | KJ958620 | R2 | *Bacillus rossius* non-LTR retrotransposon trKOR5, partial sequence | *Bacillus rossius* |
| R5 | KJ958614 | R2 | *Bacillus rossius* non-LTR retrotransposon reVIR5, partial sequence | *Bacillus rossius* |
| R5 | KJ958595 | R2 | *Bacillus rossius* non-LTR retrotransposon reBER5, partial sequence | *Bacillus rossius* |

TABLE 2-continued

Table 2: RLE-type non-LTR retrotransposon elements

| Family | Accession | Mobile Element | Name/Description | Organism |
|---|---|---|---|---|
| R5 | AJ006560 | transposon: Amer5 non-LTR retrotransposon | *Anopheles merus* Amer5 non-LTR retrotransposon encoding reverse transcriptase, partial | *Anopheles merus* |
| R5 | AF352479 | transposon: NLRCth1-like non-LTR retrotransposon | *Chironomus circumdatus* clone cir5 transposon NLRCth1-like non-LTR retrotransposon reverse transcriptase gene, partial cds | *Chironomus circumdatus* |
| R5 | AF352454 | transposon: NLRCth1-like non-LTR retrotransposon | *Chironomus alpestris* clone dor50 transposon NLRCth1-like non-LTR retrotransposon reverse transcriptase gene, partial cds | *Chironomus alpestris* |
| R5 | AF352404 | transposon: NLRCth1-like non-LTR retrotransposon | *Chironomus luridus* clone lur5 transposon NLRCth1-like non-LTR retrotransposon reverse transcriptase gene, partial cds | *Chironomus luridus* |
| R8 | FR852798 | poly(A) tail | *Beta vulgaris* subsp. *vulgaris* LINE-type retrotransposon Belline2_3 | *Beta vulgaris* subsp. *vulgaris* |
| R8 | KJ958630 | R2 | *Bacillus rossius* non-LTR retrotransposon reVIR8_deg, partial sequence | *Bacillus rossius* |
| R8 | KJ958621 | R2 | *Bacillus rossius* non-LTR retrotransposon trKOR8, partial sequence | *Bacillus rossius* |
| R8 | KP001560 | rex3-RT pseudogene_Contig ILU_TR8 | *Iberochondrostoma lusitanicum* clone tr8a non-LTR retrotransposon Rex3, complete sequence | *Iberochondrostoma lusitanicum* |
| R8 | FR852885 | right terminal repeat | *Beta vulgaris* subsp. *vulgaris* LINE-type retrotransposon BNR114 (Belline1_114) | *Beta vulgaris* subsp. *vulgaris* |
| R8 | FR852856 | right terminal repeat | *Beta vulgaris* subsp. *vulgarius* LINE-type retrotransposon BNR45 (Belline1_45) | *Beta vulgaris* subsp. *vulgaris* |
| R8 | FR852844 | right terminal repeat | *Beta vulgaris* subsp. *vulgarius* LINE-type retrotransposon BNR22 (Belline1_22) | *Beta vulgaris* subsp. *vulgaris* |
| R8 | FR852836 | right terminal repeat | *Beta vulgaris* subsp. *vulgarius* LINE-type retrotransposon Belline17_6 | *Beta vulgaris* subsp. *vulgaris* |
| R8 | FR852834 | right terminal repeat | *Beta vulgaris* subsp. *vulgarius* LINE-type retrotransposon Belline17_4 | *Beta vulgaris* subsp. *vulgaris* |
| R8 | FR852831 | right terminal repeat | *Beta vulgaris* subsp. *vulgarius* LINE-type retrotransposon Belline17_1 | *Beta vulgaris* subsp. *vulgaris* |
| R8 | FR852829 | right terminal repeat | *Beta vulgaris* subsp. *vulgarius* LINE-type retrotransposon Belline16_2 | *Beta vulgaris* subsp. *vulgaris* |
| R8 | FR852827 | right terminal repeat | *Beta vulgaris* subsp. *vulgarius* LINE-type retrotransposon Belline15_3 | *Beta vulgaris* subsp. *vulgaris* |
| R8 | FR852819 | right terminal repeat | *Beta vulgaris* subsp. *vulgarius* LINE-type retrotransposon Belline12_2 | *Beta vulgaris* subsp. *vulgaris* |
| R8 | FR852813 | right terminal repeat | *Beta vulgaris* subsp. *vulgarius* LINE-type retrotransposon Belline9_5 | *Beta vulgaris* subsp. *vulgaris* |

TABLE 2-continued

| Table 2: RLE-type non-LTR retrotransposon elements | | | | |
|---|---|---|---|---|
| Family | Accession | Mobile Element | Name/Description | Organism |
| R8 | FR852807 | right terminal repeat | *Beta vulgaris* subsp. *vulgarius* LINE-type retrotransposon Belline8_1 | *Beta vulgaris* subsp. *vulgaris* |
| R8 | FR852806 | right terminal repeat | *Beta vulgaris* subsp. *vulgarius* LINE-type retrotransposon Belline7_18 | *Beta vulgaris* subsp. *vulgaris* |
| R8 | FR852799 | right terminal repeat | *Beta vulgaris* subsp. *vulgarius* LINE-type retrotransposon Belline2_4 | *Beta vulgaris* subsp. *vulgaris* |
| R8 | FR852795 | right terminal repeat | *Beta vulgaris* subsp. *vulgarius* LINE-type retrotransposon BNR19 (Belline1_19) | *Beta vulgaris* subsp. *vulgaris* |
| R8 | AF352481 | transposon: NLRCth1-like non-LTR retrotransposon | *Chironomus circumdatus* clone cir8 transposon NLRCth1-like non-LTR retrotransposon reverse transcriptase gene, partial cds | *Chironomus circumdatus* |
| R8; R5 | FR852861 | right terminal repeat | *Beta vulgaris* subsp. *vulgaris* LINE-type retrotransposon BNR59 (Belline1_59) | *Beta vulgaris* subsp. *vulgaris* |
| R8; R5 | FR852857 | right terminal repeat | *Beta vulgaris* subsp. *vulgaris* LINE-type retrotransposon BNR51 (Belline1_51) | *Beta vulgaris* subsp. *vulgaris* |
| R8; R7 | FR852866 | right terminal repeat | *Beta vulgaris* subsp. *vulgaris* LINE-type retrotransposon BNR76 (Belline1_76) | *Beta vulgaris* subsp. *vulgaris* |
| R8; R7 | FR852838 | right terminal repeat | *Beta vulgaris* subsp. *vulgaris* LINE-type retrotransposon BNR7 (Belline1_7) | *Beta vulgaris* subsp. *vulgaris* |
| R8; R7 | AF352455 | transposon: NLRCth1-like non-LTR retrotransposon | *Chironomus alpestris* clone dor70 note identical sequence found in dor80 transposon NLRCth1-like non-LTR retrotransposon reverse transcriptase gene, partial cds | *Chironomus alpestris* |
| R8; R9 | FR852878 | right terminal repeat | *Beta vulgaris* subsp. *vulgaris* LINE-type retrotransposon BNR96 (Belline1_96) | *Beta vulgaris* subsp. *vulgaris* |
| R9 | KJ958625 | R2 | *Bacillus rossius* non-LTR retrotransposon trKOR9, partial sequence | *Bacillus rossius* |
| Rex6 | AJ293547 | en | *Oreochromis niloticus* Rex6 retrotransposon partial en pseudogene for endonuclease, clone rex6-Oni-3 | *Oreochromis niloticus* |
| Rex6 | AJ293546 | en | *Oreochromis niloticus* Rex6 retrotransposon partial en pseudogene for endonuclease, clone rex6-Oni-2 | *Oreochromis niloticus* |
| Rex6 | AJ293545 | en | *Oreochromis niloticus* Rex6 retrotransposon partial en pseudogene for endonuclease, clone rex6-Oni-1 | *Oreochromis niloticus* |
| Rex6 | AJ293517 | en | *Xiphophorus maculatus* Rex6 retrotransposon partial en pseudogene for endonuclease, clone Rex6-Xma-6 | *Xiphophorus maculatus* |
| Rex6 | AJ293516 | en | *Xiphophorus maculatus* Rex6 retrotransposon partial en pseudogene for endonuclease, clone Rex6-Xma-5 | *Xiphophorus maculatus* |
| Rex6 | AJ293515 | en | *Xiphophorus maculatus* Rex6 retrotransposon partial en pseudogene for endonuclease, clone Rex6-Xma-4 | *Xiphophorus maculatus* |

TABLE 2-continued

| Table 2: RLE-type non-LTR retrotransposon elements | | | | |
|---|---|---|---|---|
| Family | Accession | Mobile Element | Name/Description | Organism |
| Rex6 | AJ293514 | en | *Xiphophorus maculatus* Rex6 retrotransposon partial en pseudogene for endonuclease, clone Rex6-Xma-3 | *Xiphophorus maculatus* |
| Rex6 | AJ293513 | en | *Xiphophorus maculatus* Rex6 retrotransposon partial en pseudogene for endonuclease, clone Rex6-Xma-2 | *Xiphophorus maculatus* |
| Rex6 | AJ293512 | en | *Xiphophorus maculatus* Rex6 retrotransposon partial en pseudogene for endonuclease, clone Rex6-Xma-1 | *Xiphophorus maculatus* |
| Rex6 | AJ293538 | en | *Poecilia formosa* Rex6 retrotransposon partial en pseudogene for endonuclease, clone rex6-Pfo-6 | *Poecilia formosa* |
| Rex6 | AJ293537 | en | *Poecilia formosa* Rex6 retrotransposon partial en pseudogene for endonuclease, clone rex6-Pfo-5 | *Poecilia formosa* |
| Rex6 | AJ293536 | en | *Poecilia formosa* Rex6 retrotransposon partial en pseudogene for endonuclease, clone rex6-Pfo-4 | *Poecilia formosa* |
| Rex6 | AJ293535 | en | *Poecilia formosa* Rex6 retrotransposon partial en pseudogene for endonuclease, clone rex6-Pfo-3 | *Poecilia formosa* |
| Rex6 | AJ293534 | en | *Poecilia formosa* Rex6 retrotransposon partial en pseudogene for endonuclease, clone rex6-Pfo-2 | *Poecilia formosa* |
| Rex6 | AJ293533 | en | *Poecilia formosa* Rex6 retrotransposon partial en pseudogene for endonuclease, clone rex6-Pfo-1 | *Poecilia formosa* |
| Rex6 | AJ293526 | en | *Poeciliopsis gracilis* Rex6 retrotransposon partial en pseudogene for endonuclease, clone rex6-Pgr-4 | *Poeciliopsis gracilis* |
| Rex6 | AJ293525 | en | *Poeciliopsis gracilis* Rex6 retrotransposon partial en pseudogene for endonuclease, clone rex6-Pgr-3 | *Poeciliopsis gracilis* |
| Rex6 | AJ293524 | en | *Poeciliopsis gracilis* Rex6 retrotransposon partial en pseudogene for endonuclease, clone rex6-Pgr-2 | *Poeciliopsis gracilis* |
| Rex6 | AJ293523 | en | *Poeciliopsis gracilis* Rex6 retrotransposon partial en pseudogene for endonuclease, clone rex6-Pgr-1 | *Poeciliopsis gracilis* |
| Rex6 | AJ293522 | en | *Oryzias latipes* Rex6 retrotransposon partial en pseudogene for endonuclease, clone rex6-Ola-5 | *Oryzias latipes* |
| Rex6 | AJ293521 | en | *Oryzias latipes* Rex6 retrotransposon partial en pseudogene for endonuclease, clone Rex6-Ola-4 | *Oryzias latipes* |
| Rex6 | AJ293520 | en | *Oryzias latipes* Rex6 retrotransposon partial en pseudogene for endonuclease, clone Rex6-Ola-3 | *Oryzias latipes* |
| Rex6 | AJ293519 | en | *Oryzias latipes* Rex6 retrotransposon partial en pseudogene for endonuclease, clone Rex6-Ola-2 | *Oryzias latipes* |
| Rex6 | AJ293518 | en | *Oryzias latipes* Rex6 retrotransposon partial en pseudogene for endonuclease, clone Rex6-Ola-1 | *Oryzias latipes* |
| Rex6 | AJ293549 | en | *Cichlasoma labridens* Rex6 retrotransposon partial en pseudogene for endonuclease, clone rex6-Cla-2 | *Herichthys labridens* |

TABLE 2-continued

Table 2: RLE-type non-LTR retrotransposon elements

| Family | Accession | Mobile Element | Name/Description | Organism |
|---|---|---|---|---|
| Rex6 | AJ293548 | en | *Cichlasoma labridens* Rex6 retrotransposon partial en pseudogene for endonuclease, clone rex6-Cla-1 | *Herichthys labridens* |
| Rex6 | AJ293544 | en | *Heterandria bimaculata* Rex6 retrotransposon partial en pseudogene for endonuclease, clone rex6-Hbi-6 | *Pseudoxiphophorus bimaculatus* |
| Rex6 | AJ293543 | en | *Heterandria bimaculata* Rex6 retrotransposon partial en pseudogene for endonuclease, clone rex6-Hbi-5 | *Pseudoxiphophorus bimaculatus* |
| Rex6 | AJ293542 | en | *Heterandria bimaculata* Rex6 retrotransposon partial en pseudogene for endonuclease, clone rex6-Hbi-4 | *Pseudoxiphophorus bimaculatus* |
| Rex6 | AJ293541 | en | *Heterandria bimaculata* Rex6 retrotransposon partial en pseudogene for endonuclease, clone rex6-Hbi-3 | *Pseudoxiphophorus bimaculatus* |
| Rex6 | AJ293540 | en | *Heterandria bimaculata* Rex6 retrotransposon partial en pseudogene for endonuclease, clone rex6-Hbi-2 | *Pseudoxiphophorus bimaculatus* |
| Rex6 | AJ293539 | en | *Heterandria bimaculata* Rex6 retrotransposon partial en pseudogene for endonuclease, clone rex6-Hbi-1 | *Pseudoxiphophorus bimaculatus* |
| Rex6 | AJ293532 | en | *Gambusia affinis* Rex6 retrotransposon partial en pseudogene for endonuclease, clone rex6-Gaf-5 | *Gambusia affinis* |
| Rex6 | AJ293531 | en | *Gambusia affinis* Rex6 retrotransposon partial en pseudogene for endonuclease, clone rex6-Gaf-5 | *Gambusia affinis* |
| Rex6 | AJ293530 | en | *Gambusia affinis* Rex6 retrotransposon partial en pseudogene for endonuclease, clone rex6-Gaf-4 | *Gambusia affinis* |
| Rex6 | AJ293529 | en | *Gambusia affinis* Rex6 retrotransposon partial en pseudogene for endonuclease, clone rex6-Gaf-3 | *Gambusia affinis* |
| Rex6 | AJ293528 | en | *Gambusia affinis* Rex6 retrotransposon partial en pseudogene for endonuclease, clone rex6-Gaf-2 | *Gambusia affinis* |
| Rex6 | AJ293527 | en | *Gambusia affinis* Rex6 retrotransposon partial en pseudogene for endonuclease, clone rex6-Gaf-1 | *Gambusia affinis* |
| Rex6 | JX576459 | non-LTR retrotransposon: Rex6 | *Symphysodon discus* isolate i non-LTR retrotransposon Rex6, partial sequence | *Symphysodon discus* |
| Rex6 | JX576458 | non-LTR retrotransposon: Rex6 | *Symphysodon discus* isolate h non-LTR retrotransposon Rex6, partial sequence | *Symphysodon discus* |
| Rex6 | JX576457 | non-LTR retrotransposon: Rex6 | *Symphysodon discus* isolate g non-LTR retrotransposon Rex6, partial sequence | *Symphysodon discus* |
| Rex6 | JX576456 | non-LTR retrotransposon: Rex6 | *Symphysodon discus* isolate f non-LTR retrotransposon Rex6, partial sequence | *Symphysodon discus* |
| Rex6 | JX576455 | non-LTR retrotransposon: Rex6 | *Symphysodon discus* isolate e non-LTR retrotransposon Rex6, partial sequence | *Symphysodon discus* |
| Rex6 | JX576454 | non-LTR retrotransposon: Rex6 | *Symphysodon discus* isolate d non-LTR retrotransposon Rex6, partial sequence | *Symphysodon discus* |
| Rex6 | JX576453 | non-LTR retrotransposon: Rex6 | *Symphysodon discus* isolate c non-LTR retrotransposon Rex6, partial sequence | *Symphysodon discus* |
| Rex6 | JX576452 | non-LTR retrotransposon: Rex6 | *Symphysodon discus* isolate b non-LTR retrotransposon Rex6, partial sequence | *Symphysodon discus* |

TABLE 2-continued

| Table 2: RLE-type non-LTR retrotransposon elements | | | | |
|---|---|---|---|---|
| Family | Accession | Mobile Element | Name/Description | Organism |
| Rex6 | JX576451 | non-LTR retrotransposon: Rex6 | *Symphysodon discus* isolate a non-LTR retrotransposon Rex6, partial sequence | *Symphysodon discus* |
| Rex6 | JX576450 | non-LTR retrotransposon: Rex6 | *Symphysodon discus* isolate z8 non-LTR retrotransposon Rex6, partial sequence | *Symphysodon discus* |
| Rex6 | JX576449 | non-LTR retrotransposon: Rex6 | *Symphysodon discus* isolate z7 non-LTR retrotransposon Rex6, partial sequence | *Symphysodon discus* |
| Rex6 | JX576448 | non-LTR retrotransposon: Rex6 | *Symphysodon discus* isolate z6 non-LTR retrotransposon Rex6, partial sequence | *Symphysodon discus* |
| Rex6 | JX576447 | non-LTR retrotransposon: Rex6 | *Symphysodon discus* isolate z5 non-LTR retrotransposon Rex6, partial sequence | *Symphysodon discus* |
| Rex6 | JX576446 | non-LTR retrotransposon: Rex6 | *Symphysodon discus* isolate z4 non-LTR retrotransposon Rex6, partial sequence | *Symphysodon discus* |
| Rex6 | JX576445 | non-LTR retrotransposon: Rex6 | *Symphysodon discus* isolate z3 non-LTR retrotransposon Rex6, partial sequence | *Symphysodon discus* |
| Rex6 | JX576444 | non-LTR retrotransposon: Rex6 | *Symphysodon discus* isolate z2 non-LTR retrotransposon Rex6, partial sequence | *Symphysodon discus* |
| Rex6 | JX576443 | non-LTR retrotransposon: Rex6 | *Symphysodon discus* isolate z1 non-LTR retrotransposon Rex6, partial sequence | *Symphysodon discus* |
| Rex6 | JX576442 | non-LTR retrotransposon: Rex6 | *Symphysodon discus* isolate z non-LTR retrotransposon Rex6, partial sequence | *Symphysodon discus* |
| Rex6 | JX576441 | non-LTR retrotransposon: Rex6 | *Symphysodon discus* isolate x non-LTR retrotransposon Rex6, partial sequence | *Symphysodon discus* |
| Rex6 | JX576440 | non-LTR retrotransposon: Rex6 | *Symphysodon discus* isolate v non-LTR retrotransposon Rex6, partial sequence | *Symphysodon discus* |
| Rex6 | JX576439 | non-LTR retrotransposon: Rex6 | *Symphysodon discus* isolate u non-LTR retrotransposon Rex6, partial sequence | *Symphysodon discus* |
| Rex6 | JX576438 | non-LTR retrotransposon: Rex6 | *Symphysodon discus* isolate t non-LTR retrotransposon Rex6, partial sequence | *Symphysodon discus* |
| Rex6 | JX576437 | non-LTR retrotransposon: Rex6 | *Symphysodon discus* isolate s non-LTR retrotransposon Rex6, partial sequence | *Symphysodon discus* |
| Rex6 | JX576436 | non-LTR retrotransposon: Rex6 | *Symphysodon discus* isolate r non-LTR retrotransposon Rex6, partial sequence | *Symphysodon discus* |
| Rex6 | JX576435 | non-LTR retrotransposon: Rex6 | *Symphysodon discus* isolate q non-LTR retrotransposon Rex6, partial sequence | *Symphysodon discus* |
| Rex6 | JX576434 | non-LTR retrotransposon: Rex6 | *Symphysodon discus* isolate p non-LTR retrotransposon Rex6, partial sequence | *Symphysodon discus* |
| Rex6 | JX576433 | non-LTR retrotransposon: Rex6 | *Symphysodon discus* isolate o non-LTR retrotransposon Rex6, partial sequence | *Symphysodon discus* |
| Rex6 | JX576432 | non-LTR retrotransposon: Rex6 | *Symphysodon discus* isolate n non-LTR retrotransposon Rex6, partial sequence | *Symphysodon discus* |
| Rex6 | JX576431 | non-LTR retrotransposon: Rex6 | *Symphysodon discus* isolate m non-LTR retrotransposon Rex6, partial sequence | *Symphysodon discus* |
| Rex6 | JX576430 | non-LTR retrotransposon: Rex6 | *Symphysodon discus* isolate l non-LTR retrotransposon Rex6, partial sequence | *Symphysodon discus* |
| Rex6 | JX576429 | non-LTR retrotransposon: Rex6 | *Symphysodon discus* isolate k non-LTR retrotransposon Rex6, partial sequence | *Symphysodon discus* |
| Rex6 | JX576428 | non-LTR retrotransposon: Rex6 | *Symphysodon discus* isolate j non-LTR retrotransposon Rex6, partial sequence | *Symphysodon discus* |
| Rex6 | JX576427 | non-LTR retrotransposon: Rex6 | *Pterophyllum scalare* clone e non-LTR retrotransposon Rex6, partial sequence | *Pterophyllum scalare* |

TABLE 2-continued

| Table 2: RLE-type non-LTR retrotransposon elements | | | | |
|---|---|---|---|---|
| Family | Accession | Mobile Element | Name/Description | Organism |
| Rex6 | JX576426 | non-LTR retrotransposon: Rex6 | *Pterophyllum scalare* clone d non-LTR retrotransposon Rex6, partial sequence | *Pterophyllum scalare* |
| Rex6 | JX576425 | non-LTR retrotransposon: Rex6 | *Pterophyllum scalare* clone c non-LTR retrotransposon Rex6, partial sequence | *Pterophyllum scalare* |
| Rex6 | JX576424 | non-LTR retrotransposon: Rex6 | *Pterophyllum scalare* clone b non-LTR retrotransposon Rex6, partial sequence | *Pterophyllum scalare* |
| Rex6 | JX576423 | non-LTR retrotransposon: Rex6 | *Pterophyllum scalare* clone a non-LTR retrotransposon Rex6, partial sequence | *Pterophyllum scalare* |
| Rex6 | JX576422 | non-LTR retrotransposon: Rex6 | *Geophagus proximus* clone g non-LTR retrotransposon Rex6, partial sequence | *Geophagus proximus* |
| Rex6 | JX576421 | non-LTR retrotransposon: Rex6 | *Geophagus proximus* clone f non-LTR retrotransposon Rex6, partial sequence | *Geophagus proximus* |
| Rex6 | JX576420 | non-LTR retrotransposon: Rex6 | *Geophagus proximus* clone e non-LTR retrotransposon Rex6, partial sequence | *Geophagus proximus* |
| Rex6 | JX576419 | non-LTR retrotransposon: Rex6 | *Geophagus proximus* clone d non-LTR retrotransposon Rex6, partial sequence | *Geophagus proximus* |
| Rex6 | JX576418 | non-LTR retrotransposon: Rex6 | *Geophagus proximus* clone c non-LTR retrotransposon Rex6, partial sequence | *Geophagus proximus* |
| Rex6 | JX576417 | non-LTR retrotransposon: Rex6 | *Geophagus proximus* clone b non-LTR retrotransposon Rex6, partial sequence | *Geophagus proximus* |
| Rex6 | JX576416 | non-LTR retrotransposon: Rex6 | *Geophagus proximus* clone a non-LTR retrotransposon Rex6, partial sequence | *Geophagus proximus* |
| Rex6 | JX576415 | non-LTR retrotransposon: Rex6 | *Astronotus ocellatus* clone g non-LTR retrotransposon Rex6, partial sequence | *Astronotus ocellatus* |
| Rex6 | JX576414 | non-LTR retrotransposon: Rex6 | *Astronotus ocellatus* clone f non-LTR retrotransposon Rex6, partial sequence | *Astronotus ocellatus* |
| Rex6 | JX576413 | non-LTR retrotransposon: Rex6 | *Astronotus ocellatus* clone e non-LTR retrotransposon Rex6, partial sequence | *Astronotus ocellatus* |
| Rex6 | JX576412 | non-LTR retrotransposon: Rex6 | *Astronotus ocellatus* clone d non-LTR retrotransposon Rex6, partial sequence | *Astronotus ocellatus* |
| Rex6 | JX576411 | non-LTR retrotransposon: Rex6 | *Astronotus ocellatus* clone c non-LTR retrotransposon Rex6, partial sequence | *Astronotus ocellatus* |
| Rex6 | JX576410 | non-LTR retrotransposon: Rex6 | *Astronotus ocellatus* clone b non-LTR retrotransposon Rex6, partial sequence | *Astronotus ocellatus* |
| Rex6 | JX576409 | non-LTR retrotransposon: Rex6 | *Astronotus ocellatus* clone a non-LTR retrotransposon Rex6, partial sequence | *Astronotus ocellatus* |
| Rex6 | JX576408 | non-LTR retrotransposon: Rex6 | *Cichla monoculus* clone h non-LTR retrotransposon Rex6, partial sequence | *Cichla monoculus* |
| Rex6 | JX576407 | non-LTR retrotransposon: Rex6 | *Cichla monoculus* clone g non-LTR retrotransposon Rex6, partial sequence | *Cichla monoculus* |
| Rex6 | JX576406 | non-LTR retrotransposon: Rex6 | *Cichla monoculus* clone f non-LTR retrotransposon Rex6, partial sequence | *Cichla monoculus* |
| Rex6 | JX576405 | non-LTR retrotransposon: Rex6 | *Cichla monoculus* clone e non-LTR retrotransposon Rex6, partial sequence | *Cichla monoculus* |
| Rex6 | JX576404 | non-LTR retrotransposon: Rex6 | *Cichla monoculus* clone d non-LTR retrotransposon Rex6, partial sequence | *Cichla monoculus* |
| Rex6 | JX576403 | non-LTR retrotransposon: Rex6 | *Cichla monoculus* clone c non-LTR retrotransposon Rex6, partial sequence | *Cichla monoculus* |
| Rex6 | JX576402 | non-LTR retrotransposon: Rex6 | *Cichla monoculus* clone b non-LTR retrotransposon Rex6, partial sequence | *Cichla monoculus* |

TABLE 2-continued

Table 2: RLE-type non-LTR retrotransposon elements

| Family | Accession | Mobile Element | Name/Description | Organism |
|---|---|---|---|---|
| Rex6 | JX576401 | non-LTR retrotransposon: Rex6 | *Cichla monoculus* clone a non-LTR retrotransposon Rex6, partial sequence | *Cichla monoculus* |
| Rex6 | KF131853 | non-LTR retrotransposon: Rex6 | *Pterophyllum scalare* clone z7 non-LTR retrotransposon Rex6, partial sequence | *Pterophyllum scalare* |
| Rex6 | KF131852 | non-LTR retrotransposon: Rex6 | *Pterophyllum scalare* clone z6 non-LTR retrotransposon Rex6, partial sequence | *Pterophyllum scalare* |
| Rex6 | KF131851 | non-LTR retrotransposon: Rex6 | *Pterophyllum scalare* clone z5 non-LTR retrotransposon Rex6, partial sequence | *Pterophyllum scalare* |
| Rex6 | KF131850 | non-LTR retrotransposon: Rex6 | *Pterophyllum scalare* clone z4 non-LTR retrotransposon Rex6, partial sequence | *Pterophyllum scalare* |
| Rex6 | KF131849 | non-LTR retrotransposon: Rex6 | *Pterophyllum scalare* clone z3 non-LTR retrotransposon Rex6, partial sequence | *Pterophyllum scalare* |
| Rex6 | KF131848 | non-LTR retrotransposon: Rex6 | *Pterophyllum scalare* clone z2 non-LTR retrotransposon Rex6, partial sequence | *Pterophyllum scalare* |
| Rex6 | KF131847 | non-LTR retrotransposon: Rex6 | *Pterophyllum scalare* clone z1 non-LTR retrotransposon Rex6, partial sequence | *Pterophyllum scalare* |
| Rex6 | KF131846 | non-LTR retrotransposon: Rex6 | *Pterophyllum scalare* clone z non-LTR retrotransposon Rex6, partial sequence | *Pterophyllum scalare* |
| Rex6 | KF131845 | non-LTR retrotransposon: Rex6 | *Pterophyllum scalare* clone x non-LTR retrotransposon Rex6, partial sequence | *Pterophyllum scalare* |
| Rex6 | KF131844 | non-LTR retrotransposon: Rex6 | *Pterophyllum scalare* clone v non-LTR retrotransposon Rex6, partial sequence | *Pterophyllum scalare* |
| Rex6 | KF131843 | non-LTR retrotransposon: Rex6 | *Pterophyllum scalare* clone u non-LTR retrotransposon Rex6, partial sequence | *Pterophyllum scalare* |
| Rex6 | KF131842 | non-LTR retrotransposon: Rex6 | *Pterophyllum scalare* clone t non-LTR retrotransposon Rex6, partial sequence | *Pterophyllum scalare* |
| Rex6 | KF131841 | non-LTR retrotransposon: Rex6 | *Pterophyllum scalare* clone s non-LTR retrotransposon Rex6, partial sequence | *Pterophyllum scalare* |
| Rex6 | KF131840 | non-LTR retrotransposon: Rex6 | *Pterophyllum scalare* clone r non-LTR retrotransposon Rex6, partial sequence | *Pterophyllum scalare* |
| Rex6 | KF131839 | non-LTR retrotransposon: Rex6 | *Pterophyllum scalare* clone q non-LTR retrotransposon Rex6, partial sequence | *Pterophyllum scalare* |
| Rex6 | KF131838 | non-LTR retrotransposon: Rex6 | *Pterophyllum scalare* clone p non-LTR retrotransposon Rex6, partial sequence | *Pterophyllum scalare* |
| Rex6 | KF131837 | non-LTR retrotransposon: Rex6 | *Pterophyllum scalare* clone n non-LTR retrotransposon Rex6, partial sequence | *Pterophyllum scalare* |
| Rex6 | KF131836 | non-LTR retrotransposon: Rex6 | *Pterophyllum scalare* clone m non-LTR retrotransposon Rex6, partial sequence | *Pterophyllum scalare* |
| Rex6 | KF131835 | non-LTR retrotransposon: Rex6 | *Pterophyllum scalare* clone l non-LTR retrotransposon Rex6, partial sequence | *Pterophyllum scalare* |
| Rex6 | KF131834 | non-LTR retrotransposon: Rex6 | *Pterophyllum scalare* clone k non-LTR retrotransposon Rex6, partial sequence | *Pterophyllum scalare* |
| Rex6 | KF131833 | non-LTR retrotransposon: Rex6 | *Pterophyllum scalare* clone j non-LTR retrotransposon Rex6, partial sequence | *Pterophyllum scalare* |
| Rex6 | KF131832 | non-LTR retrotransposon: Rex6 | *Pterophyllum scalare* clone i non-LTR retrotransposon Rex6, partial sequence | *Pterophyllum scalare* |
| Rex6 | KF131831 | non-LTR retrotransposon: Rex6 | *Pterophyllum scalare* clone h non-LTR retrotransposon Rex6, partial sequence | *Pterophyllum scalare* |
| Rex6 | KF131830 | non-LTR retrotransposon: Rex6 | *Pterophyllum scalare* clone g non-LTR retrotransposon Rex6, partial sequence | *Pterophyllum scalare* |

TABLE 2-continued

Table 2: RLE-type non-LTR retrotransposon elements

| Family | Accession | Mobile Element | Name/Description | Organism |
|---|---|---|---|---|
| Rex6 | KF131829 | non-LTR retrotransposon: Rex6 | *Pterophyllum scalare* clone f non-LTR retrotransposon Rex6, partial sequence | *Pterophyllum scalare* |
| Rex6 | KF131828 | non-LTR retrotransposon: Rex6 | *Geophagus proximus* clone z6 non-LTR retrotransposon Rex6, partial sequence | *Geophagus proximus* |
| Rex6 | KF131827 | non-LTR retrotransposon: Rex6 | *Geophagus proximus* clone z5 non-LTR retrotransposon Rex6, partial sequence | *Geophagus proximus* |
| Rex6 | KF131826 | non-LTR retrotransposon: Rex6 | *Geophagus proximus* clone z4 non-LTR retrotransposon Rex6, partial sequence | *Geophagus proximus* |
| Rex6 | KF131825 | non-LTR retrotransposon: Rex6 | *Geophagus proximus* clone z3 non-LTR retrotransposon Rex6, partial sequence | *Geophagus proximus* |
| Rex6 | KF131824 | non-LTR retrotransposon: Rex6 | *Geophagus proximus* clone z2 non-LTR retrotransposon Rex6, partial sequence | *Geophagus proximus* |
| Rex6 | KF131823 | non-LTR retrotransposon: Rex6 | *Geophagus proximus* clone z1 non-LTR retrotransposon Rex6, partial sequence | *Geophagus proximus* |
| Rex6 | KF131822 | non-LTR retrotransposon: Rex6 | *Geophagus proximus* clone z non-LTR retrotransposon Rex6, partial sequence | *Geophagus proximus* |
| Rex6 | KF131821 | non-LTR retrotransposon: Rex6 | *Geophagus proximus* clone x non-LTR retrotransposon Rex6, partial sequence | *Geophagus proximus* |
| Rex6 | KF131820 | non-LTR retrotransposon: Rex6 | *Geophagus proximus* clone v non-LTR retrotransposon Rex6, partial sequence | *Geophagus proximus* |
| Rex6 | KF131819 | non-LTR retrotransposon: Rex6 | *Geophagus proximus* clone u non-LTR retrotransposon Rex6, partial sequence | *Geophagus proximus* |
| Rex6 | KF131818 | non-LTR retrotransposon: Rex6 | *Geophagus proximus* clone t non-LTR retrotransposon Rex6, partial sequence | *Geophagus proximus* |
| Rex6 | KF131817 | non-LTR retrotransposon: Rex6 | *Geophagus proximus* clone s non-LTR retrotransposon Rex6, partial sequence | *Geophagus proximus* |
| Rex6 | KF131816 | non-LTR retrotransposon: Rex6 | *Geophagus proximus* clone r non-LTR retrotransposon Rex6, partial sequence | *Geophagus proximus* |
| Rex6 | KF131815 | non-LTR retrotransposon: Rex6 | *Geophagus proximus* clone q non-LTR retrotransposon Rex6, partial sequence | *Geophagus proximus* |
| Rex6 | KF131814 | non-LTR retrotransposon: Rex6 | *Geophagus proximus* clone p non-LTR retrotransposon Rex6, partial sequence | *Geophagus proximus* |
| Rex6 | KF131813 | non-LTR retrotransposon: Rex6 | *Geophagus proximus* clone o non-LTR retrotransposon Rex6, partial sequence | *Geophagus proximus* |
| Rex6 | KF131812 | non-LTR retrotransposon: Rex6 | *Geophagus proximus* clone n non-LTR retrotransposon Rex6, partial sequence | *Geophagus proximus* |
| Rex6 | KF131811 | non-LTR retrotransposon: Rex6 | *Geophagus proximus* clone m non-LTR retrotransposon Rex6, partial sequence | *Geophagus proximus* |
| Rex6 | KF131810 | non-LTR retrotransposon: Rex6 | *Geophagus proximus* clone l non-LTR retrotransposon Rex6, partial sequence | *Geophagus proximus* |
| Rex6 | KF131809 | non-LTR retrotransposon: Rex6 | *Geophagus proximus* clone k non-LTR retrotransposon Rex6, partial sequence | *Geophagus proximus* |
| Rex6 | KF131808 | non-LTR retrotransposon: Rex6 | *Geophagus proximus* clone j non-LTR retrotransposon Rex6, partial sequence | *Geophagus proximus* |
| Rex6 | KF131807 | non-LTR retrotransposon: Rex6 | *Geophagus proximus* clone i non-LTR retrotransposon Rex6, partial sequence | *Geophagus proximus* |
| Rex6 | KF131806 | non-LTR retrotransposon: Rex6 | *Geophagus proximus* clone h non-LTR retrotransposon Rex6, partial sequence | *Geophagus proximus* |
| Rex6 | KF131805 | non-LTR retrotransposon: Rex6 | *Astronotus ocellatus* clone z10 non-LTR retrotransposon Rex6, partial sequence | *Astronotus ocellatus* |

TABLE 2-continued

Table 2: RLE-type non-LTR retrotransposon elements

| Family | Accession | Mobile Element | Name/Description | Organism |
|---|---|---|---|---|
| Rex6 | KF131804 | non-LTR retrotransposon: Rex6 | *Astronotus ocellatus* clone z9 non-LTR retrotransposon Rex6, partial sequence | *Astronotus ocellatus* |
| Rex6 | KF131803 | non-LTR retrotransposon: Rex6 | *Astronotus ocellatus* clone z8 non-LTR retrotransposon Rex6, partial sequence | *Astronotus ocellatus* |
| Rex6 | KF131802 | non-LTR retrotransposon: Rex6 | *Astronotus ocellatus* clone z7 non-LTR retrotransposon Rex6, partial sequence | *Astronotus ocellatus* |
| Rex6 | KF131801 | non-LTR retrotransposon: Rex6 | *Astronotus ocellatus* clone z6 non-LTR retrotransposon Rex6, partial sequence | *Astronotus ocellatus* |
| Rex6 | KF131800 | non-LTR retrotransposon: Rex6 | *Astronotus ocellatus* clone z5 non-LTR retrotransposon Rex6, partial sequence | *Astronotus ocellatus* |
| Rex6 | KF131799 | non-LTR retrotransposon: Rex6 | *Astronotus ocellatus* clone z4 non-LTR retrotransposon Rex6, partial sequence | *Astronotus ocellatus* |
| Rex6 | KF131798 | non-LTR retrotransposon: Rex6 | *Astronotus ocellatus* clone z3 non-LTR retrotransposon Rex6, partial sequence | *Astronotus ocellatus* |
| Rex6 | KF131797 | non-LTR retrotransposon: Rex6 | *Astronotus ocellatus* clone z2 non-LTR retrotransposon Rex6, partial sequence | *Astronotus ocellatus* |
| Rex6 | KF131796 | non-LTR retrotransposon: Rex6 | *Astronotus ocellatus* clone z1 non-LTR retrotransposon Rex6, partial sequence | *Astronotus ocellatus* |
| Rex6 | KF131795 | non-LTR retrotransposon: Rex6 | *Astronotus ocellatus* clone z non-LTR retrotransposon Rex6, partial sequence | *Astronotus ocellatus* |
| Rex6 | KF131794 | non-LTR retrotransposon: Rex6 | *Astronotus ocellatus* clone x non-LTR retrotransposon Rex6, partial sequence | *Astronotus ocellatus* |
| Rex6 | KF131793 | non-LTR retrotransposon: Rex6 | *Astronotus ocellatus* clone v non-LTR retrotransposon Rex6, partial sequence | *Astronotus ocellatus* |
| Rex6 | KF131792 | non-LTR retrotransposon: Rex6 | *Astronotus ocellatus* clone u non-LTR retrotransposon Rex6, partial sequence | *Astronotus ocellatus* |
| Rex6 | KF131791 | non-LTR retrotransposon: Rex6 | *Astronotus ocellatus* clone t non-LTR retrotransposon Rex6, partial sequence | *Astronotus ocellatus* |
| Rex6 | KF131790 | non-LTR retrotransposon: Rex6 | *Astronotus ocellatus* clone s non-LTR retrotransposon Rex6, partial sequence | *Astronotus ocellatus* |
| Rex6 | KF131789 | non-LTR retrotransposon: Rex6 | *Astronotus ocellatus* clone r non-LTR retrotransposon Rex6, partial sequence | *Astronotus ocellatus* |
| Rex6 | KF131788 | non-LTR retrotransposon: Rex6 | *Astronotus ocellatus* clone q non-LTR retrotransposon Rex6, partial sequence | *Astronotus ocellatus* |
| Rex6 | KF131787 | non-LTR retrotransposon: Rex6 | *Astronotus ocellatus* clone p non-LTR retrotransposon Rex6, partial sequence | *Astronotus ocellatus* |
| Rex6 | KF131786 | non-LTR retrotransposon: Rex6 | *Astronotus ocellatus* clone o non-LTR retrotransposon Rex6, partial sequence | *Astronotus ocellatus* |
| Rex6 | KF131785 | non-LTR retrotransposon: Rex6 | *Astronotus ocellatus* clone n non-LTR retrotransposon Rex6, partial sequence | *Astronotus ocellatus* |
| Rex6 | KF131784 | non-LTR retrotransposon: Rex6 | *Astronotus ocellatus* clone m non-LTR retrotransposon Rex6, partial sequence | *Astronotus ocellatus* |
| Rex6 | KF131783 | non-LTR retrotransposon: Rex6 | *Astronotus ocellatus* clone l non-LTR retrotransposon Rex6, partial sequence | *Astronotus ocellatus* |
| Rex6 | KF131782 | non-LTR retrotransposon: Rex6 | *Astronotus ocellatus* clone k non-LTR retrotransposon Rex6, partial sequence | *Astronotus ocellatus* |
| Rex6 | KF131781 | non-LTR retrotransposon: Rex6 | *Astronotus ocellatus* clone j non-LTR retrotransposon Rex6, partial sequence | *Astronotus ocellatus* |
| Rex6 | KF131780 | non-LTR retrotransposon: Rex6 | *Astronotus ocellatus* clone i non-LTR retrotransposon Rex6, partial sequence | *Astronotus ocellatus* |

TABLE 2-continued

Table 2: RLE-type non-LTR retrotransposon elements

| Family | Accession | Mobile Element | Name/Description | Organism |
|---|---|---|---|---|
| Rex6 | KF131779 | non-LTR retrotransposon: Rex6 | *Astronotus ocellatus* clone h non-LTR retrotransposon Rex6, partial sequence | *Astronotus ocellatus* |
| Rex6 | KF131778 | non-LTR retrotransposon: Rex6 | *Cichla monoculus* clone z6 non-LTR retrotransposon Rex6, partial sequence | *Cichla monoculus* |
| Rex6 | KF131777 | non-LTR retrotransposon: Rex6 | *Cichla monoculus* clone z5 non-LTR retrotransposon Rex6, partial sequence | *Cichla monoculus* |
| Rex6 | KF131776 | non-LTR retrotransposon: Rex6 | *Cichla monoculus* clone z4 non-LTR retrotransposon Rex6, partial sequence | *Cichla monoculus* |
| Rex6 | KF131775 | non-LTR retrotransposon: Rex6 | *Cichla monoculus* clone z3 non-LTR retrotransposon Rex6, partial sequence | *Cichla monoculus* |
| Rex6 | KF131774 | non-LTR retrotransposon: Rex6 | *Cichla monoculus* clone z2 non-LTR retrotransposon Rex6, partial sequence | *Cichla monoculus* |
| Rex6 | KF131773 | non-LTR retrotransposon: Rex6 | *Cichla monoculus* clone z1 non-LTR retrotransposon Rex6, partial sequence | *Cichla monoculus* |
| Rex6 | KF131772 | non-LTR retrotransposon: Rex6 | *Cichla monoculus* clone z non-LTR retrotransposon Rex6, partial sequence | *Cichla monoculus* |
| Rex6 | KF131771 | non-LTR retrotransposon: Rex6 | *Cichla monoculus* clone x non-LTR retrotransposon Rex6, partial sequence | *Cichla monoculus* |
| Rex6 | KF131770 | non-LTR retrotransposon: Rex6 | *Cichla monoculus* clone v non-LTR retrotransposon Rex6, partial sequence | *Cichla monoculus* |
| Rex6 | KF131769 | non-LTR retrotransposon: Rex6 | *Cichla monoculus* clone u non-LTR retrotransposon Rex6, partial sequence | *Cichla monoculus* |
| Rex6 | KF131768 | non-LTR retrotransposon: Rex6 | *Cichla monoculus* clone t non-LTR retrotransposon Rex6, partial sequence | *Cichla monoculus* |
| Rex6 | KF131767 | non-LTR retrotransposon: Rex6 | *Cichla monoculus* clone s non-LTR retrotransposon Rex6, partial sequence | *Cichla monoculus* |
| Rex6 | KF131766 | non-LTR retrotransposon: Rex6 | *Cichla monoculus* clone r non-LTR retrotransposon Rex6, partial sequence | *Cichla monoculus* |
| Rex6 | KF131765 | non-LTR retrotransposon: Rex6 | *Cichla monoculus* clone q non-LTR retrotransposon Rex6, partial sequence | *Cichla monoculus* |
| Rex6 | KF131764 | non-LTR retrotransposon: Rex6 | *Cichla monoculus* clone p non-LTR retrotransposon Rex6, partial sequence | *Cichla monoculus* |
| Rex6 | KF131763 | non-LTR retrotransposon: Rex6 | *Cichla monoculus* clone o non-LTR retrotransposon Rex6, partial sequence | *Cichla monoculus* |
| Rex6 | KF131762 | non-LTR retrotransposon: Rex6 | *Cichla monoculus* clone n non-LTR retrotransposon Rex6, partial sequence | *Cichla monoculus* |
| Rex6 | KF131761 | non-LTR retrotransposon: Rex6 | *Cichla monoculus* clone m non-LTR retrotransposon Rex6, partial sequence | *Cichla monoculus* |
| Rex6 | KF131760 | non-LTR retrotransposon: Rex6 | *Cichla monoculus* clone l non-LTR retrotransposon Rex6, partial sequence | *Cichla monoculus* |
| Rex6 | KF131759 | non-LTR retrotransposon: Rex6 | *Cichla monoculus* clone k non-LTR retrotransposon Rex6, partial sequence | *Cichla monoculus* |
| Rex6 | KF131758 | non-LTR retrotransposon: Rex6 | *Cichla monoculus* clone j non-LTR retrotransposon Rex6, partial sequence | *Cichla monoculus* |
| Rex6 | KF131757 | non-LTR retrotransposon: Rex6 | *Cichla monoculus* clone i non-LTR retrotransposon Rex6, partial sequence | *Cichla monoculus* |
| SLACS | JN608782 | non-LTR retrotransposon: SLACS-like | *Silene latifolia* isolate Y-46 non-LTR retrotransposon SLACS-like, partial sequence | *Silene latifolia* |
| SLACS | JN608781 | non-LTR retrotransposon: SLACS-like | *Silene latifolia* isolate Y-45 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608780 | non-LTR retrotransposon: SLACS-like | *Silene latifolia* isolate Y-41 non-LTR retrotransposon SLACS-like, partial sequence | *Silene latifolia* |
| SLACS | JN608779 | non-LTR retrotransposon: SLACS-like | *Silene latifolia* isolate Y-40 non-LTR retrotransposon SLACS-like, partial sequence | *Silene latifolia* |
| SLACS | JN608778 | non-LTR retrotransposon: SLACS-like | *Silene latifolia* isolate Y-38 non-LTR retrotransposon SLACS-like, partial sequence | *Silene latifolia* |
| SLACS | JN608777 | non-LTR retrotransposon: SLACS-like | *Silene latifolia* isolate Y-37 non-LTR retrotransposon SLACS-like, partial sequence | *Silene latifolia* |
| SLACS | JN608776 | non-LTR retrotransposon: SLACS-like | *Silene latifolia* isolate Y-36 non-LTR retrotransposon SLACS-like, partial sequence | *Silene latifolia* |
| SLACS | JN608775 | non-LTR retrotransposon: SLACS-like | *Silene latifolia* isolate Y-35 non-LTR retrotransposon SLACS-like, partial sequence | *Silene latifolia* |
| SLACS | JN608774 | non-LTR retrotransposon: SLACS-like | *Silene latifolia* isolate Y-34 non-LTR retrotransposon SLACS-like, partial sequence | *Silene latifolia* |
| SLACS | JN608773 | non-LTR retrotransposon: SLACS-like | *Silene latifolia* isolate Y-33 non-LTR retrotransposon SLACS-like, partial sequence | *Silene latifolia* |
| SLACS | JN608772 | non-LTR retrotransposon: SLACS-like | *Silene latifolia* isolate Y-32 non-LTR retrotransposon SLACS-like, partial sequence | *Silene latifolia* |
| SLACS | JN608771 | non-LTR retrotransposon: SLACS-like | *Silene latifolia* isolate Y-30 non-LTR retrotransposon SLACS-like, partial sequence | *Silene latifolia* |
| SLACS | JN608770 | non-LTR retrotransposon: SLACS-like | *Silene latifolia* isolate Y-29 non-LTR retrotransposon SLACS-like, partial sequence | *Silene latifolia* |
| SLACS | JN608769 | non-LTR retrotransposon: SLACS-like | *Silene latifolia* isolate Y-28 non-LTR retrotransposon SLACS-like, partial sequence | *Silene latifolia* |
| SLACS | JN608768 | non-LTR retrotransposon: SLACS-like | *Silene latifolia* isolate Y-27 non-LTR retrotransposon SLACS-like, partial sequence | *Silene latifolia* |
| SLACS | JN608767 | non-LTR retrotransposon: SLACS-like | *Silene latifolia* isolate Y-26 non-LTR retrotransposon SLACS-like, partial sequence | *Silene latifolia* |
| SLACS | JN608766 | non-LTR retrotransposon: SLACS-like | *Silene latifolia* isolate Y-25 non-LTR retrotransposon SLACS-like, partial sequence | *Silene latifolia* |
| SLACS | JN608765 | non-LTR retrotransposon: SLACS-like | *Silene latifolia* isolate Y-24 non-LTR retrotransposon SLACS-like, partial sequence | *Silene latifolia* |
| SLACS | JN608764 | non-LTR retrotransposon: SLACS-like | *Silene latifolia* isolate Y-23 non-LTR retrotransposon SLACS-like, partial sequence | *Silene latifolia* |
| SLACS | JN608763 | non-LTR retrotransposon: SLACS-like | *Silene latifolia* isolate Y-22 non-LTR retrotransposon SLACS-like, partial sequence | *Silene latifolia* |
| SLACS | JN608762 | non-LTR retrotransposon: SLACS-like | *Silene latifolia* isolate Y-20 non-LTR retrotransposon SLACS-like, partial sequence | *Silene latifolia* |
| SLACS | JN608761 | non-LTR retrotransposon: SLACS-like | *Silene latifolia* isolate Y-19 non-LTR retrotransposon SLACS-like, partial sequence | *Silene latifolia* |
| SLACS | JN608760 | non-LTR retrotransposon: SLACS-like | *Silene latifolia* isolate Y-18 non-LTR retrotransposon SLACS-like, partial sequence | *Silene latifolia* |
| SLACS | JN608759 | non-LTR retrotransposon: SLACS-like | *Silene latifolia* isolate Y-17 non-LTR retrotransposon SLACS-like, partial sequence | *Silene latifolia* |
| SLACS | JN608758 | non-LTR retrotransposon: SLACS-like | *Silene latifolia* isolate Y-16 non-LTR retrotransposon SLACS-like, partial sequence | *Silene latifolia* |
| SLACS | JN608757 | non-LTR retrotransposon: SLACS-like | *Silene latifolia* isolate Y-13 non-LTR retrotransposon SLACS-like, partial sequence | *Silene latifolia* |
| SLACS | JN608756 | non-LTR retrotransposon: SLACS-like | *Silene latifolia* isolate Y-12 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608755 | non-LTR retrotransposon: SLACS-like | *Silene latifolia* isolate Y-11 non-LTR retrotransposon SLACS-like, partial sequence | *Silene latifolia* |
| SLACS | JN608754 | non-LTR retrotransposon: SLACS-like | *Silene latifolia* isolate Y-10 non-LTR retrotransposon SLACS-like, partial sequence | *Silene latifolia* |
| SLACS | JN608753 | non-LTR retrotransposon: SLACS-like | *Silene latifolia* isolate Y-08 non-LTR retrotransposon SLACS-like, partial sequence | *Silene latifolia* |
| SLACS | JN608752 | non-LTR retrotransposon: SLACS-like | *Silene latifolia* isolate Y-07 non-LTR retrotransposon SLACS-like, partial sequence | *Silene latifolia* |
| SLACS | JN608751 | non-LTR retrotransposon: SLACS-like | *Silene latifolia* isolate Y-06 non-LTR retrotransposon SLACS-like, partial sequence | *Silene latifolia* |
| SLACS | JN608750 | non-LTR retrotransposon: SLACS-like | *Silene latifolia* isolate Y-05 non-LTR retrotransposon SLACS-like, partial sequence | *Silene latifolia* |
| SLACS | JN608749 | non-LTR retrotransposon: SLACS-like | *Silene latifolia* isolate Y-04 non-LTR retrotransposon SLACS-like, partial sequence | *Silene latifolia* |
| SLACS | JN608748 | non-LTR retrotransposon: SLACS-like | *Silene latifolia* isolate Y-03 non-LTR retrotransposon SLACS-like, partial sequence | *Silene latifolia* |
| SLACS | JN608747 | non-LTR retrotransposon: SLACS-like | *Silene latifolia* isolate Y-01 non-LTR retrotransposon SLACS-like, partial sequence | *Silene latifolia* |
| SLACS | JN608746 | non-LTR retrotransposon: SLACS-like | *Silene latifolia* isolate X-83 non-LTR retrotransposon SLACS-like, partial sequence | *Silene latifolia* |
| SLACS | JN608745 | non-LTR retrotransposon: SLACS-like | *Silene latifolia* isolate X-81 non-LTR retrotransposon SLACS-like, partial sequence | *Silene latifolia* |
| SLACS | JN608744 | non-LTR retrotransposon: SLACS-like | *Silene latifolia* isolate X-80 non-LTR retrotransposon SLACS-like, partial sequence | *Silene latifolia* |
| SLACS | JN608743 | non-LTR retrotransposon: SLACS-like | *Silene latifolia* isolate X-79 non-LTR retrotransposon SLACS-like, partial sequence | *Silene latifolia* |
| SLACS | JN608742 | non-LTR retrotransposon: SLACS-like | *Silene latifolia* isolate X-78 non-LTR retrotransposon SLACS-like, partial sequence | *Silene latifolia* |
| SLACS | JN608741 | non-LTR retrotransposon: SLACS-like | *Silene latifolia* isolate X-76 non-LTR retrotransposon SLACS-like, partial sequence | *Silene latifolia* |
| SLACS | JN608740 | non-LTR retrotransposon: SLACS-like | *Silene latifolia* isolate X-75 non-LTR retrotransposon SLACS-like, partial sequence | *Silene latifolia* |
| SLACS | JN608739 | non-LTR retrotransposon: SLACS-like | *Silene latifolia* isolate X-74 non-LTR retrotransposon SLACS-like, partial sequence | *Silene latifolia* |
| SLACS | JN608738 | non-LTR retrotransposon: SLACS-like | *Silene latifolia* isolate X-66 non-LTR retrotransposon SLACS-like, partial sequence | *Silene latifolia* |
| SLACS | JN608737 | non-LTR retrotransposon: SLACS-like | *Silene latifolia* isolate X-65 non-LTR retrotransposon SLACS-like, partial sequence | *Silene latifolia* |
| SLACS | JN608736 | non-LTR retrotransposon: SLACS-like | *Silene latifolia* isolate X-62 non-LTR retrotransposon SLACS-like, partial sequence | *Silene latifolia* |
| SLACS | JN608735 | non-LTR retrotransposon: SLACS-like | *Silene latifolia* isolate X-61 non-LTR retrotransposon SLACS-like, partial sequence | *Silene latifolia* |
| SLACS | JN608734 | non-LTR retrotransposon: SLACS-like | *Silene latifolia* isolate X-60 non-LTR retrotransposon SLACS-like, partial sequence | *Silene latifolia* |
| SLACS | JN608733 | non-LTR retrotransposon: SLACS-like | *Silene latifolia* isolate X-59 non-LTR retrotransposon SLACS-like, partial sequence | *Silene latifolia* |
| SLACS | JN608732 | non-LTR retrotransposon: SLACS-like | *Silene latifolia* isolate X-57 non-LTR retrotransposon SLACS-like, partial sequence | *Silene latifolia* |
| SLACS | JN608731 | non-LTR retrotransposon: SLACS-like | *Silene latifolia* isolate X-49 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608730 | non-LTR retrotransposon: SLACS-like | *Silene latifolia* isolate X-41 non-LTR retrotransposon SLACS-like, partial sequence | *Silene latifolia* |
| SLACS | JN608729 | non-LTR retrotransposon: SLACS-like | *Silene latifolia* isolate X-28 non-LTR retrotransposon SLACS-like, partial sequence | *Silene latifolia* |
| SLACS | JN608728 | non-LTR retrotransposon: SLACS-like | *Silene latifolia* isolate X-27 non-LTR retrotransposon SLACS-like, partial sequence | *Silene latifolia* |
| SLACS | JN608727 | non-LTR retrotransposon: SLACS-like | *Silene latifolia* isolate X-23 non-LTR retrotransposon SLACS-like, partial sequence | *Silene latifolia* |
| SLACS | JN608726 | non-LTR retrotransposon: SLACS-like | *Silene latifolia* isolate X-21 non-LTR retrotransposon SLACS-like, partial sequence | *Silene latifolia* |
| SLACS | JN608725 | non-LTR retrotransposon: SLACS-like | *Silene latifolia* isolate X-14 non-LTR retrotransposon SLACS-like, partial sequence | *Silene latifolia* |
| SLACS | JN608724 | non-LTR retrotransposon: SLACS-like | *Silene latifolia* isolate X-11 non-LTR retrotransposon SLACS-like, partial sequence | *Silene latifolia* |
| SLACS | JN608723 | non-LTR retrotransposon: SLACS-like | *Silene latifolia* isolate X-07 non-LTR retrotransposon SLACS-like, partial sequence | *Silene latifolia* |
| SLACS | JN608722 | non-LTR retrotransposon: SLACS-like | *Silene latifolia* isolate X-06 non-LTR retrotransposon SLACS-like, partial sequence | *Silene latifolia* |
| SLACS | JN608721 | non-LTR retrotransposon: SLACS-like | *Silene latifolia* isolate X-05 non-LTR retrotransposon SLACS-like, partial sequence | *Silene latifolia* |
| SLACS | JN608720 | non-LTR retrotransposon: SLACS-like | *Silene latifolia* isolate X-03 non-LTR retrotransposon SLACS-like, partial sequence | *Silene latifolia* |
| SLACS | JN608719 | non-LTR retrotransposon: SLACS-like | *Silene latifolia* isolate X-01 non-LTR retrotransposon SLACS-like, partial sequence | *Silene latifolia* |
| SLACS | JN608718 | non-LTR retrotransposon: SLACS-like | *Silene latifolia* isolate mG40 non-LTR retrotransposon SLACS-like, partial sequence | *Silene latifolia* |
| SLACS | JN608717 | non-LTR retrotransposon: SLACS-like | *Silene latifolia* isolate mG39 non-LTR retrotransposon SLACS-like, partial sequence | *Silene latifolia* |
| SLACS | JN608716 | non-LTR retrotransposon: SLACS-like | *Silene latifolia* isolate mG38 non-LTR retrotransposon SLACS-like, partial sequence | *Silene latifolia* |
| SLACS | JN608715 | non-LTR retrotransposon: SLACS-like | *Silene latifolia* isolate mG37 non-LTR retrotransposon SLACS-like, partial sequence | *Silene latifolia* |
| SLACS | JN608714 | non-LTR retrotransposon: SLACS-like | *Silene latifolia* isolate mG36 non-LTR retrotransposon SLACS-like, partial sequence | *Silene latifolia* |
| SLACS | JN608713 | non-LTR retrotransposon: SLACS-like | *Silene latifolia* isolate mG35 non-LTR retrotransposon SLACS-like, partial sequence | *Silene latifolia* |
| SLACS | JN608712 | non-LTR retrotransposon: SLACS-like | *Silene latifolia* isolate mG34 non-LTR retrotransposon SLACS-like, partial sequence | *Silene latifolia* |
| SLACS | JN608711 | non-LTR retrotransposon: SLACS-like | *Silene latifolia* isolate mG33 non-LTR retrotransposon SLACS-like, partial sequence | *Silene latifolia* |
| SLACS | JN608710 | non-LTR retrotransposon: SLACS-like | *Silene latifolia* isolate mG32 non-LTR retrotransposon SLACS-like, partial sequence | *Silene latifolia* |
| SLACS | JN608709 | non-LTR retrotransposon: SLACS-like | *Silene latifolia* isolate mG31 non-LTR retrotransposon SLACS-like, partial sequence | *Silene latifolia* |
| SLACS | JN608708 | non-LTR retrotransposon: SLACS-like | *Silene latifolia* isolate mG30 non-LTR retrotransposon SLACS-like, partial sequence | *Silene latifolia* |
| SLACS | JN608707 | non-LTR retrotransposon: SLACS-like | *Silene latifolia* isolate mG29 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608706 | non-LTR retrotransposon: SLACS-like | *Silene latifolia* isolate mG28 non-LTR retrotransposon SLACS-like, partial sequence | *Silene latifolia* |
| SLACS | JN608705 | non-LTR retrotransposon: SLACS-like | *Silene latifolia* isolate mG27 non-LTR retrotransposon SLACS-like, partial sequence | *Silene latifolia* |
| SLACS | JN608704 | non-LTR retrotransposon: SLACS-like | *Silene latifolia* isolate mG26 non-LTR retrotransposon SLACS-like, partial sequence | *Silene latifolia* |
| SLACS | JN608703 | non-LTR retrotransposon: SLACS-like | *Silene latifolia* isolate mG25 non-LTR retrotransposon SLACS-like, partial sequence | *Silene latifolia* |
| SLACS | JN608702 | non-LTR retrotransposon: SLACS-like | *Silene latifolia* isolate mG24 non-LTR retrotransposon SLACS-like, partial sequence | *Silene latifolia* |
| SLACS | JN608701 | non-LTR retrotransposon: SLACS-like | *Silene latifolia* isolate mG23 non-LTR retrotransposon SLACS-like, partial sequence | *Silene latifolia* |
| SLACS | JN608700 | non-LTR retrotransposon: SLACS-like | *Silene latifolia* isolate mG22 non-LTR retrotransposon SLACS-like, partial sequence | *Silene latifolia* |
| SLACS | JN608699 | non-LTR retrotransposon: SLACS-like | *Silene latifolia* isolate mG21 non-LTR retrotransposon SLACS-like, partial sequence | *Silene latifolia* |
| SLACS | JN608698 | non-LTR retrotransposon: SLACS-like | *Silene latifolia* isolate mG20 non-LTR retrotransposon SLACS-like, partial sequence | *Silene latifolia* |
| SLACS | JN608697 | non-LTR retrotransposon: SLACS-like | *Silene latifolia* isolate mG19 non-LTR retrotransposon SLACS-like, partial sequence | *Silene latifolia* |
| SLACS | JN608696 | non-LTR retrotransposon: SLACS-like | *Silene latifolia* isolate mG18 non-LTR retrotransposon SLACS-like, partial sequence | *Silene latifolia* |
| SLACS | JN608695 | non-LTR retrotransposon: SLACS-like | *Silene latifolia* isolate mG17 non-LTR retrotransposon SLACS-like, partial sequence | *Silene latifolia* |
| SLACS | JN608694 | non-LTR retrotransposon: SLACS-like | *Silene latifolia* isolate mG16 non-LTR retrotransposon SLACS-like, partial sequence | *Silene latifolia* |
| SLACS | JN608693 | non-LTR retrotransposon: SLACS-like | *Silene latifolia* isolate mG14 non-LTR retrotransposon SLACS-like, partial sequence | *Silene latifolia* |
| SLACS | JN608692 | non-LTR retrotransposon: SLACS-like | *Silene latifolia* isolate mG13 non-LTR retrotransposon SLACS-like, partial sequence | *Silene latifolia* |
| SLACS | JN608691 | non-LTR retrotransposon: SLACS-like | *Silene latifolia* isolate mG12 non-LTR retrotransposon SLACS-like, partial sequence | *Silene latifolia* |
| SLACS | JN608690 | non-LTR retrotransposon: SLACS-like | *Silene latifolia* isolate mG11 non-LTR retrotransposon SLACS-like, partial sequence | *Silene latifolia* |
| SLACS | JN608689 | non-LTR retrotransposon: SLACS-like | *Silene latifolia* isolate mG10 non-LTR retrotransposon SLACS-like, partial sequence | *Silene latifolia* |
| SLACS | JN608688 | non-LTR retrotransposon: SLACS-like | *Silene latifolia* isolate mG09 non-LTR retrotransposon SLACS-like, partial sequence | *Silene latifolia* |
| SLACS | JN608687 | non-LTR retrotransposon: SLACS-like | *Silene latifolia* isolate mG08 non-LTR retrotransposon SLACS-like, partial sequence | *Silene latifolia* |
| SLACS | JN608686 | non-LTR retrotransposon: SLACS-like | *Silene latifolia* isolate mG07 non-LTR retrotransposon SLACS-like, partial sequence | *Silene latifolia* |
| SLACS | JN608685 | non-LTR retrotransposon: SLACS-like | *Silene latifolia* isolate mG06 non-LTR retrotransposon SLACS-like, partial sequence | *Silene latifolia* |
| SLACS | JN608684 | non-LTR retrotransposon: SLACS-like | *Silene latifolia* isolate mG05 non-LTR retrotransposon SLACS-like, partial sequence | *Silene latifolia* |
| SLACS | JN608683 | non-LTR retrotransposon: SLACS-like | *Silene latifolia* isolate mG04 non-LTR retrotransposon SLACS-like, partial sequence | *Silene latifolia* |
| SLACS | JN608682 | non-LTR retrotransposon: SLACS-like | *Silene latifolia* isolate mG03 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608681 | non-LTR retrotransposon: SLACS-like | *Silene latifolia* isolate mG02 non-LTR retrotransposon SLACS-like, partial sequence | *Silene latifolia* |
| SLACS | JN608680 | non-LTR retrotransposon: SLACS-like | *Silene latifolia* isolate mG01 non-LTR retrotransposon SLACS-like, partial sequence | *Silene latifolia* |
| SLACS | JN608679 | non-LTR retrotransposon: SLACS-like | *Silene latifolia* isolate fG40 non-LTR retrotransposon SLACS-like, partial sequence | *Silene latifolia* |
| SLACS | JN608678 | non-LTR retrotransposon: SLACS-like | *Silene latifolia* isolate fG39 non-LTR retrotransposon SLACS-like, partial sequence | *Silene latifolia* |
| SLACS | JN608677 | non-LTR retrotransposon: SLACS-like | *Silene latifolia* isolate fG38 non-LTR retrotransposon SLACS-like, partial sequence | *Silene latifolia* |
| SLACS | JN608676 | non-LTR retrotransposon: SLACS-like | *Silene latifolia* isolate fG37 non-LTR retrotransposon SLACS-like, partial sequence | *Silene latifolia* |
| SLACS | JN608675 | non-LTR retrotransposon: SLACS-like | *Silene latifolia* isolate fG36 non-LTR retrotransposon SLACS-like, partial sequence | *Silene latifolia* |
| SLACS | JN608674 | non-LTR retrotransposon: SLACS-like | *Silene latifolia* isolate fG35 non-LTR retrotransposon SLACS-like, partial sequence | *Silene latifolia* |
| SLACS | JN608673 | non-LTR retrotransposon: SLACS-like | *Silene latifolia* isolate fG34 non-LTR retrotransposon SLACS-like, partial sequence | *Silene latifolia* |
| SLACS | JN608672 | non-LTR retrotransposon: SLACS-like | *Silene latifolia* isolate fG33 non-LTR retrotransposon SLACS-like, partial sequence | *Silene latifolia* |
| SLACS | JN608671 | non-LTR retrotransposon: SLACS-like | *Silene latifolia* isolate fG32 non-LTR retrotransposon SLACS-like, partial sequence | *Silene latifolia* |
| SLACS | JN608670 | non-LTR retrotransposon: SLACS-like | *Silene latifolia* isolate fG31 non-LTR retrotransposon SLACS-like, partial sequence | *Silene latifolia* |
| SLACS | JN608669 | non-LTR retrotransposon: SLACS-like | *Silene latifolia* isolate fG30 non-LTR retrotransposon SLACS-like, partial sequence | *Silene latifolia* |
| SLACS | JN608668 | non-LTR retrotransposon: SLACS-like | *Silene latifolia* isolate fG29 non-LTR retrotransposon SLACS-like, partial sequence | *Silene latifolia* |
| SLACS | JN608667 | non-LTR retrotransposon: SLACS-like | *Silene latifolia* isolate fG28 non-LTR retrotransposon SLACS-like, partial sequence | *Silene latifolia* |
| SLACS | JN608666 | non-LTR retrotransposon: SLACS-like | *Silene latifolia* isolate fG27 non-LTR retrotransposon SLACS-like, partial sequence | *Silene latifolia* |
| SLACS | JN608665 | non-LTR retrotransposon: SLACS-like | *Silene latifolia* isolate fG26 non-LTR retrotransposon SLACS-like, partial sequence | *Silene latifolia* |
| SLACS | JN608664 | non-LTR retrotransposon: SLACS-like | *Silene latifolia* isolate fG25 non-LTR retrotransposon SLACS-like, partial sequence | *Silene latifolia* |
| SLACS | JN608663 | non-LTR retrotransposon: SLACS-like | *Silene latifolia* isolate fG24 non-LTR retrotransposon SLACS-like, partial sequence | *Silene latifolia* |
| SLACS | JN608662 | non-LTR retrotransposon: SLACS-like | *Silene latifolia* isolate fG23 non-LTR retrotransposon SLACS-like, partial sequence | *Silene latifolia* |
| SLACS | JN608661 | non-LTR retrotransposon: SLACS-like | *Silene latifolia* isolate fG22 non-LTR retrotransposon SLACS-like, partial sequence | *Silene latifolia* |
| SLACS | JN608660 | non-LTR retrotransposon: SLACS-like | *Silene latifolia* isolate fG21 non-LTR retrotransposon SLACS-like, partial sequence | *Silene latifolia* |
| SLACS | JN608659 | non-LTR retrotransposon: SLACS-like | *Silene latifolia* isolate fG20 non-LTR retrotransposon SLACS-like, partial sequence | *Silene latifolia* |
| SLACS | JN608658 | non-LTR retrotransposon: SLACS-like | *Silene latifolia* isolate fG19 non-LTR retrotransposon SLACS-like, partial sequence | *Silene latifolia* |
| SLACS | JN608657 | non-LTR retrotransposon: SLACS-like | *Silene latifolia* isolate fG18 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608656 | non-LTR retrotransposon: SLACS-like | *Silene latifolia* isolate fG17 non-LTR retrotransposon SLACS-like, partial sequence | *Silene latifolia* |
| SLACS | JN608655 | non-LTR retrotransposon: SLACS-like | *Silene latifolia* isolate fG16 non-LTR retrotransposon SLACS-like, partial sequence | *Silene latifolia* |
| SLACS | JN608654 | non-LTR retrotransposon: SLACS-like | *Silene latifolia* isolate fG15 non-LTR retrotransposon SLACS-like, partial sequence | *Silene latifolia* |
| SLACS | JN608653 | non-LTR retrotransposon: SLACS-like | *Silene latifolia* isolate fG14 non-LTR retrotransposon SLACS-like, partial sequence | *Silene latifolia* |
| SLACS | JN608652 | non-LTR retrotransposon: SLACS-like | *Silene latifolia* isolate fG13 non-LTR retrotransposon SLACS-like, partial sequence | *Silene latifolia* |
| SLACS | JN608651 | non-LTR retrotransposon: SLACS-like | *Silene latifolia* isolate fG11 non-LTR retrotransposon SLACS-like, partial sequence | *Silene latifolia* |
| SLACS | JN608650 | non-LTR retrotransposon: SLACS-like | *Silene latifolia* isolate fG10 non-LTR retrotransposon SLACS-like, partial sequence | *Silene latifolia* |
| SLACS | JN608649 | non-LTR retrotransposon: SLACS-like | *Silene latifolia* isolate fG09 non-LTR retrotransposon SLACS-like, partial sequence | *Silene latifolia* |
| SLACS | JN608648 | non-LTR retrotransposon: SLACS-like | *Silene latifolia* isolate fG08 non-LTR retrotransposon SLACS-like, partial sequence | *Silene latifolia* |
| SLACS | JN608647 | non-LTR retrotransposon: SLACS-like | *Silene latifolia* isolate fG07 non-LTR retrotransposon SLACS-like, partial sequence | *Silene latifolia* |
| SLACS | JN608646 | non-LTR retrotransposon: SLACS-like | *Silene latifolia* isolate fG06 non-LTR retrotransposon SLACS-like, partial sequence | *Silene latifolia* |
| SLACS | JN608645 | non-LTR retrotransposon: SLACS-like | *Silene latifolia* isolate fG05 non-LTR retrotransposon SLACS-like, partial sequence | *Silene latifolia* |
| SLACS | JN608644 | non-LTR retrotransposon: SLACS-like | *Silene latifolia* isolate fG03 non-LTR retrotransposon SLACS-like, partial sequence | *Silene latifolia* |
| SLACS | JN608643 | non-LTR retrotransposon: SLACS-like | *Silene latifolia* isolate fG02 non-LTR retrotransposon SLACS-like, partial sequence | *Silene latifolia* |
| SLACS | JN608642 | non-LTR retrotransposon: SLACS-like | *Silene latifolia* isolate fG01 non-LTR retrotransposon SLACS-like, partial sequence | *Silene latifolia* |
| SLACS | JN608641 | non-LTR retrotransposon: SLACS-like | *Silene latifolia* isolate A-47 non-LTR retrotransposon SLACS-like, partial sequence | *Silene latifolia* |
| SLACS | JN608640 | non-LTR retrotransposon: SLACS-like | *Silene latifolia* isolate A-46 non-LTR retrotransposon SLACS-like, partial sequence | *Silene latifolia* |
| SLACS | JN608639 | non-LTR retrotransposon: SLACS-like | *Silene latifolia* isolate A-45 non-LTR retrotransposon SLACS-like, partial sequence | *Silene latifolia* |
| SLACS | JN608638 | non-LTR retrotransposon: SLACS-like | *Silene latifolia* isolate A-44 non-LTR retrotransposon SLACS-like, partial sequence | *Silene latifolia* |
| SLACS | JN608637 | non-LTR retrotransposon: SLACS-like | *Silene latifolia* isolate A-42 non-LTR retrotransposon SLACS-like, partial sequence | *Silene latifolia* |
| SLACS | JN608636 | non-LTR retrotransposon: SLACS-like | *Silene latifolia* isolate A-41 non-LTR retrotransposon SLACS-like, partial sequence | *Silene latifolia* |
| SLACS | JN608635 | non-LTR retrotransposon: SLACS-like | *Silene latifolia* isolate A-40 non-LTR retrotransposon SLACS-like, partial sequence | *Silene latifolia* |
| SLACS | JN608634 | non-LTR retrotransposon: SLACS-like | *Silene latifolia* isolate A-37 non-LTR retrotransposon SLACS-like, partial sequence | *Silene latifolia* |
| SLACS | JN608633 | non-LTR retrotransposon: SLACS-like | *Silene latifolia* isolate A-36 non-LTR retrotransposon SLACS-like, partial sequence | *Silene latifolia* |
| SLACS | JN608632 | non-LTR retrotransposon: SLACS-like | *Silene latifolia* isolate A-35 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608631 | non-LTR retrotransposon: SLACS-like | *Silene latifolia* isolate A-34 non-LTR retrotransposon SLACS-like, partial sequence | *Silene latifolia* |
| SLACS | JN608630 | non-LTR retrotransposon: SLACS-like | *Silene latifolia* isolate A-33 non-LTR retrotransposon SLACS-like, partial sequence | *Silene latifolia* |
| SLACS | JN608629 | non-LTR retrotransposon: SLACS-like | *Silene latifolia* isolate A-32 non-LTR retrotransposon SLACS-like, partial sequence | *Silene latifolia* |
| SLACS | JN608628 | non-LTR retrotransposon: SLACS-like | *Silene latifolia* isolate A-31 non-LTR retrotransposon SLACS-like, partial sequence | *Silene latifolia* |
| SLACS | JN608627 | non-LTR retrotransposon: SLACS-like | *Silene latifolia* isolate A-26 non-LTR retrotransposon SLACS-like, partial sequence | *Silene latifolia* |
| SLACS | JN608626 | non-LTR retrotransposon: SLACS-like | *Silene latifolia* isolate A-24 non-LTR retrotransposon SLACS-like, partial sequence | *Silene latifolia* |
| SLACS | JN608625 | non-LTR retrotransposon: SLACS-like | *Silene latifolia* isolate A-23 non-LTR retrotransposon SLACS-like, partial sequence | *Silene latifolia* |
| SLACS | JN608624 | non-LTR retrotransposon: SLACS-like | *Silene latifolia* isolate A-22 non-LTR retrotransposon SLACS-like, partial sequence | *Silene latifolia* |
| SLACS | JN608623 | non-LTR retrotransposon: SLACS-like | *Silene latifolia* isolate A-21 non-LTR retrotransposon SLACS-like, partial sequence | *Silene latifolia* |
| SLACS | JN608622 | non-LTR retrotransposon: SLACS-like | *Silene latifolia* isolate A-20 non-LTR retrotransposon SLACS-like, partial sequence | *Silene latifolia* |
| SLACS | JN608621 | non-LTR retrotransposon: SLACS-like | *Silene latifolia* isolate A-19 non-LTR retrotransposon SLACS-like, partial sequence | *Silene latifolia* |
| SLACS | JN608620 | non-LTR retrotransposon: SLACS-like | *Silene latifolia* isolate A-18 non-LTR retrotransposon SLACS-like, partial sequence | *Silene latifolia* |
| SLACS | JN608619 | non-LTR retrotransposon: SLACS-like | *Silene latifolia* isolate A-17 non-LTR retrotransposon SLACS-like, partial sequence | *Silene latifolia* |
| SLACS | JN608618 | non-LTR retrotransposon: SLACS-like | *Silene latifolia* isolate A-16 non-LTR retrotransposon SLACS-like, partial sequence | *Silene latifolia* |
| SLACS | JN608617 | non-LTR retrotransposon: SLACS-like | *Silene latifolia* isolate A-15 non-LTR retrotransposon SLACS-like, partial sequence | *Silene latifolia* |
| SLACS | JN608616 | non-LTR retrotransposon: SLACS-like | *Silene latifolia* isolate A-14 non-LTR retrotransposon SLACS-like, partial sequence | *Silene latifolia* |
| SLACS | JN608615 | non-LTR retrotransposon: SLACS-like | *Silene latifolia* isolate A-13 non-LTR retrotransposon SLACS-like, partial sequence | *Silene latifolia* |
| SLACS | JN608614 | non-LTR retrotransposon: SLACS-like | *Silene latifolia* isolate A-12 non-LTR retrotransposon SLACS-like, partial sequence | *Silene latifolia* |
| SLACS | JN608613 | non-LTR retrotransposon: SLACS-like | *Silene latifolia* isolate A-11 non-LTR retrotransposon SLACS-like, partial sequence | *Silene latifolia* |
| SLACS | JN608612 | non-LTR retrotransposon: SLACS-like | *Silene latifolia* isolate A-10 non-LTR retrotransposon SLACS-like, partial sequence | *Silene latifolia* |
| SLACS | JN608611 | non-LTR retrotransposon: SLACS-like | *Silene latifolia* isolate A-09 non-LTR retrotransposon SLACS-like, partial sequence | *Silene latifolia* |
| SLACS | JN608610 | non-LTR retrotransposon: SLACS-like | *Silene latifolia* isolate A-08 non-LTR retrotransposon SLACS-like, partial sequence | *Silene latifolia* |
| SLACS | JN608609 | non-LTR retrotransposon: SLACS-like | *Silene latifolia* isolate A-06 non-LTR retrotransposon SLACS-like, partial sequence | *Silene latifolia* |
| SLACS | JN608608 | non-LTR retrotransposon: SLACS-like | *Silene latifolia* isolate A-05 non-LTR retrotransposon SLACS-like, partial sequence | *Silene latifolia* |
| SLACS | JN608607 | non-LTR retrotransposon: SLACS-like | *Silene latifolia* isolate A-03 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608606 | non-LTR retrotransposon: SLACS-like | *Silene latifolia* isolate A-01 non-LTR retrotransposon SLACS-like, partial sequence | *Silene latifolia* |
| SLACS | JN608236 | non-LTR retrotransposon: SLACS-like | *Silene latifolia* isolate mR40 non-LTR retrotransposon SLACS-like, partial sequence | *Silene latifolia* |
| SLACS | JN608235 | non-LTR retrotransposon: SLACS-like | *Silene latifolia* isolate mR39 non-LTR retrotransposon SLACS-like, partial sequence | *Silene latifolia* |
| SLACS | JN608234 | non-LTR retrotransposon: SLACS-like | *Silene latifolia* isolate mR38 non-LTR retrotransposon SLACS-like, partial sequence | *Silene latifolia* |
| SLACS | JN608233 | non-LTR retrotransposon: SLACS-like | *Silene latifolia* isolate mR35 non-LTR retrotransposon SLACS-like, partial sequence | *Silene latifolia* |
| SLACS | JN608232 | non-LTR retrotransposon: SLACS-like | *Silene latifolia* isolate mR32 non-LTR retrotransposon SLACS-like, partial sequence | *Silene latifolia* |
| SLACS | JN608231 | non-LTR retrotransposon: SLACS-like | *Silene latifolia* isolate mR29 non-LTR retrotransposon SLACS-like, partial sequence | *Silene latifolia* |
| SLACS | JN608230 | non-LTR retrotransposon: SLACS-like | *Silene latifolia* isolate mR26 non-LTR retrotransposon SLACS-like, partial sequence | *Silene latifolia* |
| SLACS | JN608229 | non-LTR retrotransposon: SLACS-like | *Silene latifolia* isolate mR25 non-LTR retrotransposon SLACS-like, partial sequence | *Silene latifolia* |
| SLACS | JN608228 | non-LTR retrotransposon: SLACS-like | *Silene latifolia* isolate mR18 non-LTR retrotransposon SLACS-like, partial sequence | *Silene latifolia* |
| SLACS | JN608227 | non-LTR retrotransposon: SLACS-like | *Silene latifolia* isolate mR17 non-LTR retrotransposon SLACS-like, partial sequence | *Silene latifolia* |
| SLACS | JN608226 | non-LTR retrotransposon: SLACS-like | *Silene latifolia* isolate mR14 non-LTR retrotransposon SLACS-like, partial sequence | *Silene latifolia* |
| SLACS | JN608225 | non-LTR retrotransposon: SLACS-like | *Silene latifolia* isolate mR13 non-LTR retrotransposon SLACS-like, partial sequence | *Silene latifolia* |
| SLACS | JN608224 | non-LTR retrotransposon: SLACS-like | *Silene latifolia* isolate mR12 non-LTR retrotransposon SLACS-like, partial sequence | *Silene latifolia* |
| SLACS | JN608223 | non-LTR retrotransposon: SLACS-like | *Silene latifolia* isolate mR11 non-LTR retrotransposon SLACS-like, partial sequence | *Silene latifolia* |
| SLACS | JN608222 | non-LTR retrotransposon: SLACS-like | *Silene latifolia* isolate mR09 non-LTR retrotransposon SLACS-like, partial sequence | *Silene latifolia* |
| SLACS | JN608221 | non-LTR retrotransposon: SLACS-like | *Silene latifolia* isolate mR08 non-LTR retrotransposon SLACS-like, partial sequence | *Silene latifolia* |
| SLACS | JN608220 | non-LTR retrotransposon: SLACS-like | *Silene latifolia* isolate mR07 non-LTR retrotransposon SLACS-like, partial sequence | *Silene latifolia* |
| SLACS | JN608219 | non-LTR retrotransposon: SLACS-like | *Silene latifolia* isolate mR06 non-LTR retrotransposon SLACS-like, partial sequence | *Silene latifolia* |
| SLACS | JN608218 | non-LTR retrotransposon: SLACS-like | *Silene latifolia* isolate mR05 non-LTR retrotransposon SLACS-like, partial sequence | *Silene latifolia* |
| SLACS | JN608217 | non-LTR retrotransposon: SLACS-like | *Silene latifolia* isolate mR04 non-LTR retrotransposon SLACS-like, partial sequence | *Silene latifolia* |
| SLACS | JN608216 | non-LTR retrotransposon: SLACS-like | *Silene latifolia* isolate mR03 non-LTR retrotransposon SLACS-like, partial sequence | *Silene latifolia* |
| SLACS | JN608215 | non-LTR retrotransposon: SLACS-like | *Silene latifolia* isolate mR02 non-LTR retrotransposon SLACS-like, partial sequence | *Silene latifolia* |
| SLACS | JN608214 | non-LTR retrotransposon: SLACS-like | *Silene latifolia* isolate mR01 non-LTR retrotransposon SLACS-like, partial sequence | *Silene latifolia* |
| SLACS | JN608213 | non-LTR retrotransposon: SLACS-like | *Silene latifolia* isolate mL40 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608212 | non-LTR retrotransposon: SLACS-like | *Silene latifolia* isolate mL39 non-LTR retrotransposon SLACS-like, partial sequence | *Silene latifolia* |
| SLACS | JN608211 | non-LTR retrotransposon: SLACS-like | *Silene latifolia* isolate mL37 non-LTR retrotransposon SLACS-like, partial sequence | *Silene latifolia* |
| SLACS | JN608210 | non-LTR retrotransposon: SLACS-like | *Silene latifolia* isolate mL36 non-LTR retrotransposon SLACS-like, partial sequence | *Silene latifolia* |
| SLACS | JN608209 | non-LTR retrotransposon: SLACS-like | *Silene latifolia* isolate mL35 non-LTR retrotransposon SLACS-like, partial sequence | *Silene latifolia* |
| SLACS | JN608208 | non-LTR retrotransposon: SLACS-like | *Silene latifolia* isolate mL34 non-LTR retrotransposon SLACS-like, partial sequence | *Silene latifolia* |
| SLACS | JN608207 | non-LTR retrotransposon: SLACS-like | *Silene latifolia* isolate mL33 non-LTR retrotransposon SLACS-like, partial sequence | *Silene latifolia* |
| SLACS | JN608206 | non-LTR retrotransposon: SLACS-like | *Silene latifolia* isolate mL32 non-LTR retrotransposon SLACS-like, partial sequence | *Silene latifolia* |
| SLACS | JN608205 | non-LTR retrotransposon: SLACS-like | *Silene latifolia* isolate mL31 non-LTR retrotransposon SLACS-like, partial sequence | *Silene latifolia* |
| SLACS | JN608204 | non-LTR retrotransposon: SLACS-like | *Silene latifolia* isolate mL28 non-LTR retrotransposon SLACS-like, partial sequence | *Silene latifolia* |
| SLACS | JN608203 | non-LTR retrotransposon: SLACS-like | *Silene latifolia* isolate mL27 non-LTR retrotransposon SLACS-like, partial sequence | *Silene latifolia* |
| SLACS | JN608202 | non-LTR retrotransposon: SLACS-like | *Silene latifolia* isolate mL25 non-LTR retrotransposon SLACS-like, partial sequence | *Silene latifolia* |
| SLACS | JN608201 | non-LTR retrotransposon: SLACS-like | *Silene latifolia* isolate mL24 non-LTR retrotransposon SLACS-like, partial sequence | *Silene latifolia* |
| SLACS | JN608200 | non-LTR retrotransposon: SLACS-like | *Silene latifolia* isolate mL23 non-LTR retrotransposon SLACS-like, partial sequence | *Silene latifolia* |
| SLACS | JN608199 | non-LTR retrotransposon: SLACS-like | *Silene latifolia* isolate mL19 non-LTR retrotransposon SLACS-like, partial sequence | *Silene latifolia* |
| SLACS | JN608198 | non-LTR retrotransposon: SLACS-like | *Silene latifolia* isolate mL16 non-LTR retrotransposon SLACS-like, partial sequence | *Silene latifolia* |
| SLACS | JN608197 | non-LTR retrotransposon: SLACS-like | *Silene latifolia* isolate mL13 non-LTR retrotransposon SLACS-like, partial sequence | *Silene latifolia* |
| SLACS | JN608196 | non-LTR retrotransposon: SLACS-like | *Silene latifolia* isolate mL12 non-LTR retrotransposon SLACS-like, partial sequence | *Silene latifolia* |
| SLACS | JN608195 | non-LTR retrotransposon: SLACS-like | *Silene latifolia* isolate mL11 non-LTR retrotransposon SLACS-like, partial sequence | *Silene latifolia* |
| SLACS | JN608194 | non-LTR retrotransposon: SLACS-like | *Silene latifolia* isolate mL10 non-LTR retrotransposon SLACS-like, partial sequence | *Silene latifolia* |
| SLACS | JN608193 | non-LTR retrotransposon: SLACS-like | *Silene latifolia* isolate mL07 non-LTR retrotransposon SLACS-like, partial sequence | *Silene latifolia* |
| SLACS | JN608192 | non-LTR retrotransposon: SLACS-like | *Silene latifolia* isolate mL04 non-LTR retrotransposon SLACS-like, partial sequence | *Silene latifolia* |
| SLACS | JN608191 | non-LTR retrotransposon: SLACS-like | *Silene latifolia* isolate mL03 non-LTR retrotransposon SLACS-like, partial sequence | *Silene latifolia* |
| SLACS | JN608190 | non-LTR retrotransposon: SLACS-like | *Silene latifolia* isolate mL02 non-LTR retrotransposon SLACS-like, partial sequence | *Silene latifolia* |
| SLACS | JN608189 | non-LTR retrotransposon: SLACS-like | *Silene latifolia* isolate mL01 non-LTR retrotransposon SLACS-like, partial sequence | *Silene latifolia* |
| SLACS | JN608188 | non-LTR retrotransposon: SLACS-like | *Silene latifolia* isolate mF40 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608187 | non-LTR retrotransposon: SLACS-like | *Silene latifolia* isolate mF39 non-LTR retrotransposon SLACS-like, partial sequence | *Silene latifolia* |
| SLACS | JN608186 | non-LTR retrotransposon: SLACS-like | *Silene latifolia* isolate mF38 non-LTR retrotransposon SLACS-like, partial sequence | *Silene latifolia* |
| SLACS | JN608185 | non-LTR retrotransposon: SLACS-like | *Silene latifolia* isolate mF37 non-LTR retrotransposon SLACS-like, partial sequence | *Silene latifolia* |
| SLACS | JN608184 | non-LTR retrotransposon: SLACS-like | *Silene latifolia* isolate mF36 non-LTR retrotransposon SLACS-like, partial sequence | *Silene latifolia* |
| SLACS | JN608183 | non-LTR retrotransposon: SLACS-like | *Silene latifolia* isolate mF35 non-LTR retrotransposon SLACS-like, partial sequence | *Silene latifolia* |
| SLACS | JN608182 | non-LTR retrotransposon: SLACS-like | *Silene latifolia* isolate mF33 non-LTR retrotransposon SLACS-like, partial sequence | *Silene latifolia* |
| SLACS | JN608181 | non-LTR retrotransposon: SLACS-like | *Silene latifolia* isolate mF32 non-LTR retrotransposon SLACS-like, partial sequence | *Silene latifolia* |
| SLACS | JN608180 | non-LTR retrotransposon: SLACS-like | *Silene latifolia* isolate mF31 non-LTR retrotransposon SLACS-like, partial sequence | *Silene latifolia* |
| SLACS | JN608179 | non-LTR retrotransposon: SLACS-like | *Silene latifolia* isolate mF30 non-LTR retrotransposon SLACS-like, partial sequence | *Silene latifolia* |
| SLACS | JN608178 | non-LTR retrotransposon: SLACS-like | *Silene latifolia* isolate mF29 non-LTR retrotransposon SLACS-like, partial sequence | *Silene latifolia* |
| SLACS | JN608177 | non-LTR retrotransposon: SLACS-like | *Silene latifolia* isolate mF28 non-LTR retrotransposon SLACS-like, partial sequence | *Silene latifolia* |
| SLACS | JN608176 | non-LTR retrotransposon: SLACS-like | *Silene latifolia* isolate mF27 non-LTR retrotransposon SLACS-like, partial sequence | *Silene latifolia* |
| SLACS | JN608175 | non-LTR retrotransposon: SLACS-like | *Silene latifolia* isolate mF26 non-LTR retrotransposon SLACS-like, partial sequence | *Silene latifolia* |
| SLACS | JN608174 | non-LTR retrotransposon: SLACS-like | *Silene latifolia* isolate mF25 non-LTR retrotransposon SLACS-like, partial sequence | *Silene latifolia* |
| SLACS | JN608173 | non-LTR retrotransposon: SLACS-like | *Silene latifolia* isolate mF23 non-LTR retrotransposon SLACS-like, partial sequence | *Silene latifolia* |
| SLACS | JN608172 | non-LTR retrotransposon: SLACS-like | *Silene latifolia* isolate mF22 non-LTR retrotransposon SLACS-like, partial sequence | *Silene latifolia* |
| SLACS | JN608171 | non-LTR retrotransposon: SLACS-like | *Silene latifolia* isolate mF21 non-LTR retrotransposon SLACS-like, partial sequence | *Silene latifolia* |
| SLACS | JN608170 | non-LTR retrotransposon: SLACS-like | *Silene latifolia* isolate mF20 non-LTR retrotransposon SLACS-like, partial sequence | *Silene latifolia* |
| SLACS | JN608169 | non-LTR retrotransposon: SLACS-like | *Silene latifolia* isolate mF19 non-LTR retrotransposon SLACS-like, partial sequence | *Silene latifolia* |
| SLACS | JN608168 | non-LTR retrotransposon: SLACS-like | *Silene latifolia* isolate mF18 non-LTR retrotransposon SLACS-like, partial sequence | *Silene latifolia* |
| SLACS | JN608167 | non-LTR retrotransposon: SLACS-like | *Silene latifolia* isolate mF17 non-LTR retrotransposon SLACS-like, partial sequence | *Silene latifolia* |
| SLACS | JN608166 | non-LTR retrotransposon: SLACS-like | *Silene latifolia* isolate mF16 non-LTR retrotransposon SLACS-like, partial sequence | *Silene latifolia* |
| SLACS | JN608165 | non-LTR retrotransposon: SLACS-like | *Silene latifolia* isolate mF15 non-LTR retrotransposon SLACS-like, partial sequence | *Silene latifolia* |
| SLACS | JN608164 | non-LTR retrotransposon: SLACS-like | *Silene latifolia* isolate mF14 non-LTR retrotransposon SLACS-like, partial sequence | *Silene latifolia* |
| SLACS | JN608163 | non-LTR retrotransposon: SLACS-like | *Silene latifolia* isolate mF13 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608162 | non-LTR retrotransposon: SLACS-like | *Silene latifolia* isolate mF11 non-LTR retrotransposon SLACS-like, partial sequence | *Silene latifolia* |
| SLACS | JN608161 | non-LTR retrotransposon: SLACS-like | *Silene latifolia* isolate mF10 non-LTR retrotransposon SLACS-like, partial sequence | *Silene latifolia* |
| SLACS | JN608160 | non-LTR retrotransposon: SLACS-like | *Silene latifolia* isolate mF09 non-LTR retrotransposon SLACS-like, partial sequence | *Silene latifolia* |
| SLACS | JN608159 | non-LTR retrotransposon: SLACS-like | *Silene latifolia* isolate mF08 non-LTR retrotransposon SLACS-like, partial sequence | *Silene latifolia* |
| SLACS | JN608158 | non-LTR retrotransposon: SLACS-like | *Silene latifolia* isolate mF07 non-LTR retrotransposon SLACS-like, partial sequence | *Silene latifolia* |
| SLACS | JN608157 | non-LTR retrotransposon: SLACS-like | *Silene latifolia* isolate mF06 non-LTR retrotransposon SLACS-like, partial sequence | *Silene latifolia* |
| SLACS | JN608156 | non-LTR retrotransposon: SLACS-like | *Silene latifolia* isolate mF05 non-LTR retrotransposon SLACS-like, partial sequence | *Silene latifolia* |
| SLACS | JN608155 | non-LTR retrotransposon: SLACS-like | *Silene latifolia* isolate mF04 non-LTR retrotransposon SLACS-like, partial sequence | *Silene latifolia* |
| SLACS | JN608154 | non-LTR retrotransposon: SLACS-like | *Silene latifolia* isolate mF03 non-LTR retrotransposon SLACS-like, partial sequence | *Silene latifolia* |
| SLACS | JN608153 | non-LTR retrotransposon: SLACS-like | *Silene latifolia* isolate mF02 non-LTR retrotransposon SLACS-like, partial sequence | *Silene latifolia* |
| SLACS | JN608152 | non-LTR retrotransposon: SLACS-like | *Silene latifolia* isolate mF01 non-LTR retrotransposon SLACS-like, partial sequence | *Silene latifolia* |
| SLACS | JN608151 | non-LTR retrotransposon: SLACS-like | *Silene latifolia* isolate fR40 non-LTR retrotransposon SLACS-like, partial sequence | *Silene latifolia* |
| SLACS | JN608150 | non-LTR retrotransposon: SLACS-like | *Silene latifolia* isolate fR39 non-LTR retrotransposon SLACS-like, partial sequence | *Silene latifolia* |
| SLACS | JN608149 | non-LTR retrotransposon: SLACS-like | *Silene latifolia* isolate fR38 non-LTR retrotransposon SLACS-like, partial sequence | *Silene latifolia* |
| SLACS | JN608148 | non-LTR retrotransposon: SLACS-like | *Silene latifolia* isolate fR37 non-LTR retrotransposon SLACS-like, partial sequence | *Silene latifolia* |
| SLACS | JN608147 | non-LTR retrotransposon: SLACS-like | *Silene latifolia* isolate fR36 non-LTR retrotransposon SLACS-like, partial sequence | *Silene latifolia* |
| SLACS | JN608146 | non-LTR retrotransposon: SLACS-like | *Silene latifolia* isolate fR35 non-LTR retrotransposon SLACS-like, partial sequence | *Silene latifolia* |
| SLACS | JN608145 | non-LTR retrotransposon: SLACS-like | *Silene latifolia* isolate fR34 non-LTR retrotransposon SLACS-like, partial sequence | *Silene latifolia* |
| SLACS | JN608144 | non-LTR retrotransposon: SLACS-like | *Silene latifolia* isolate fR33 non-LTR retrotransposon SLACS-like, partial sequence | *Silene latifolia* |
| SLACS | JN608143 | non-LTR retrotransposon: SLACS-like | *Silene latifolia* isolate fR32 non-LTR retrotransposon SLACS-like, partial sequence | *Silene latifolia* |
| SLACS | JN608142 | non-LTR retrotransposon: SLACS-like | *Silene latifolia* isolate fR31 non-LTR retrotransposon SLACS-like, partial sequence | *Silene latifolia* |
| SLACS | JN608141 | non-LTR retrotransposon: SLACS-like | *Silene latifolia* isolate fR30 non-LTR retrotransposon SLACS-like, partial sequence | *Silene latifolia* |
| SLACS | JN608140 | non-LTR retrotransposon: SLACS-like | *Silene latifolia* isolate fR29 non-LTR retrotransposon SLACS-like, partial sequence | *Silene latifolia* |
| SLACS | JN608139 | non-LTR retrotransposon: SLACS-like | *Silene latifolia* isolate fR28 non-LTR retrotransposon SLACS-like, partial sequence | *Silene latifolia* |
| SLACS | JN608138 | non-LTR retrotransposon: SLACS-like | *Silene latifolia* isolate fR27 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608137 | non-LTR retrotransposon: SLACS-like | *Silene latifolia* isolate fR26 non-LTR retrotransposon SLACS-like, partial sequence | *Silene latifolia* |
| SLACS | JN608136 | non-LTR retrotransposon: SLACS-like | *Silene latifolia* isolate fR25 non-LTR retrotransposon SLACS-like, partial sequence | *Silene latifolia* |
| SLACS | JN608135 | non-LTR retrotransposon: SLACS-like | *Silene latifolia* isolate fR24 non-LTR retrotransposon SLACS-like, partial sequence | *Silene latifolia* |
| SLACS | JN608134 | non-LTR retrotransposon: SLACS-like | *Silene latifolia* isolate fR23 non-LTR retrotransposon SLACS-like, partial sequence | *Silene latifolia* |
| SLACS | JN608133 | non-LTR retrotransposon: SLACS-like | *Silene latifolia* isolate fR22 non-LTR retrotransposon SLACS-like, partial sequence | *Silene latifolia* |
| SLACS | JN608132 | non-LTR retrotransposon: SLACS-like | *Silene latifolia* isolate fR21 non-LTR retrotransposon SLACS-like, partial sequence | *Silene latifolia* |
| SLACS | JN608131 | non-LTR retrotransposon: SLACS-like | *Silene latifolia* isolate fR20 non-LTR retrotransposon SLACS-like, partial sequence | *Silene latifolia* |
| SLACS | JN608130 | non-LTR retrotransposon: SLACS-like | *Silene latifolia* isolate fR19 non-LTR retrotransposon SLACS-like, partial sequence | *Silene latifolia* |
| SLACS | JN608129 | non-LTR retrotransposon: SLACS-like | *Silene latifolia* isolate fR18 non-LTR retrotransposon SLACS-like, partial sequence | *Silene latifolia* |
| SLACS | JN608128 | non-LTR retrotransposon: SLACS-like | *Silene latifolia* isolate fR17 non-LTR retrotransposon SLACS-like, partial sequence | *Silene latifolia* |
| SLACS | JN608127 | non-LTR retrotransposon: SLACS-like | *Silene latifolia* isolate fR16 non-LTR retrotransposon SLACS-like, partial sequence | *Silene latifolia* |
| SLACS | JN608126 | non-LTR retrotransposon: SLACS-like | *Silene latifolia* isolate fR15 non-LTR retrotransposon SLACS-like, partial sequence | *Silene latifolia* |
| SLACS | JN608125 | non-LTR retrotransposon: SLACS-like | *Silene latifolia* isolate fR14 non-LTR retrotransposon SLACS-like, partial sequence | *Silene latifolia* |
| SLACS | JN608124 | non-LTR retrotransposon: SLACS-like | *Silene latifolia* isolate fR13 non-LTR retrotransposon SLACS-like, partial sequence | *Silene latifolia* |
| SLACS | JN608123 | non-LTR retrotransposon: SLACS-like | *Silene latifolia* isolate fR12 non-LTR retrotransposon SLACS-like, partial sequence | *Silene latifolia* |
| SLACS | JN608122 | non-LTR retrotransposon: SLACS-like | *Silene latifolia* isolate fR11 non-LTR retrotransposon SLACS-like, partial sequence | *Silene latifolia* |
| SLACS | JN608121 | non-LTR retrotransposon: SLACS-like | *Silene latifolia* isolate fR09 non-LTR retrotransposon SLACS-like, partial sequence | *Silene latifolia* |
| SLACS | JN608120 | non-LTR retrotransposon: SLACS-like | *Silene latifolia* isolate fR08 non-LTR retrotransposon SLACS-like, partial sequence | *Silene latifolia* |
| SLACS | JN608119 | non-LTR retrotransposon: SLACS-like | *Silene latifolia* isolate fR07 non-LTR retrotransposon SLACS-like, partial sequence | *Silene latifolia* |
| SLACS | JN608118 | non-LTR retrotransposon: SLACS-like | *Silene latifolia* isolate fR05 non-LTR retrotransposon SLACS-like, partial sequence | *Silene latifolia* |
| SLACS | JN608117 | non-LTR retrotransposon: SLACS-like | *Silene latifolia* isolate fR04 non-LTR retrotransposon SLACS-like, partial sequence | *Silene latifolia* |
| SLACS | JN608116 | non-LTR retrotransposon: SLACS-like | *Silene latifolia* isolate fR03 non-LTR retrotransposon SLACS-like, partial sequence | *Silene latifolia* |
| SLACS | JN608115 | non-LTR retrotransposon: SLACS-like | *Silene latifolia* isolate fR02 non-LTR retrotransposon SLACS-like, partial sequence | *Silene latifolia* |
| SLACS | JN608114 | non-LTR retrotransposon: SLACS-like | *Silene latifolia* isolate fR01 non-LTR retrotransposon SLACS-like, partial sequence | *Silene latifolia* |
| SLACS | JN608113 | non-LTR retrotransposon: SLACS-like | *Silene latifolia* isolate fL40 non-LTR retrotransposon SLACS-like, partial sequence | *Silene latifolia* |

TABLE 2-continued

| Table 2: RLE-type non-LTR retrotransposon elements | | | | |
|---|---|---|---|---|
| Family | Accession | Mobile Element | Name/Description | Organism |
| SLACS | JN608112 | non-LTR retrotransposon: SLACS-like | *Silene latifolia* isolate fL39 non-LTR retrotransposon SLACS-like, partial sequence | *Silene latifolia* |
| SLACS | JN608111 | non-LTR retrotransposon: SLACS-like | *Silene latifolia* isolate fL38 non-LTR retrotransposon SLACS-like, partial sequence | *Silene latifolia* |
| SLACS | JN608110 | non-LTR retrotransposon: SLACS-like | *Silene latifolia* isolate fL37 non-LTR retrotransposon SLACS-like, partial sequence | *Silene latifolia* |
| SLACS | JN608109 | non-LTR retrotransposon: SLACS-like | *Silene latifolia* isolate fL36 non-LTR retrotransposon SLACS-like, partial sequence | *Silene latifolia* |
| SLACS | JN608108 | non-LTR retrotransposon: SLACS-like | *Silene latifolia* isolate fL35 non-LTR retrotransposon SLACS-like, partial sequence | *Silene latifolia* |
| SLACS | JN608107 | non-LTR retrotransposon: SLACS-like | *Silene latifolia* isolate fL34 non-LTR retrotransposon SLACS-like, partial sequence | *Silene latifolia* |
| SLACS | JN608106 | non-LTR retrotransposon: SLACS-like | *Silene latifolia* isolate fL33 non-LTR retrotransposon SLACS-like, partial sequence | *Silene latifolia* |
| SLACS | JN608105 | non-LTR retrotransposon: SLACS-like | *Silene latifolia* isolate fL32 non-LTR retrotransposon SLACS-like, partial sequence | *Silene latifolia* |
| SLACS | JN608104 | non-LTR retrotransposon: SLACS-like | *Silene latifolia* isolate fL31 non-LTR retrotransposon SLACS-like, partial sequence | *Silene latifolia* |
| SLACS | JN608103 | non-LTR retrotransposon: SLACS-like | *Silene latifolia* isolate fL30 non-LTR retrotransposon SLACS-like, partial sequence | *Silene latifolia* |
| SLACS | JN608102 | non-LTR retrotransposon: SLACS-like | *Silene latifolia* isolate fL29 non-LTR retrotransposon SLACS-like, partial sequence | *Silene latifolia* |
| SLACS | JN608101 | non-LTR retrotransposon: SLACS-like | *Silene latifolia* isolate fL28 non-LTR retrotransposon SLACS-like, partial sequence | *Silene latifolia* |
| SLACS | JN608100 | non-LTR retrotransposon: SLACS-like | *Silene latifolia* isolate fL27 non-LTR retrotransposon SLACS-like, partial sequence | *Silene latifolia* |
| SLACS | JN608099 | non-LTR retrotransposon: SLACS-like | *Silene latifolia* isolate fL26 non-LTR retrotransposon SLACS-like, partial sequence | *Silene latifolia* |
| SLACS | JN608098 | non-LTR retrotransposon: SLACS-like | *Silene latifolia* isolate fL25 non-LTR retrotransposon SLACS-like, partial sequence | *Silene latifolia* |
| SLACS | JN608097 | non-LTR retrotransposon: SLACS-like | *Silene latifolia* isolate fL24 non-LTR retrotransposon SLACS-like, partial sequence | *Silene latifolia* |
| SLACS | JN608096 | non-LTR retrotransposon: SLACS-like | *Silene latifolia* isolate fL23 non-LTR retrotransposon SLACS-like, partial sequence | *Silene latifolia* |
| SLACS | JN608095 | non-LTR retrotransposon: SLACS-like | *Silene latifolia* isolate fL22 non-LTR retrotransposon SLACS-like, partial sequence | *Silene latifolia* |
| SLACS | JN608094 | non-LTR retrotransposon: SLACS-like | *Silene latifolia* isolate fL20 non-LTR retrotransposon SLACS-like, partial sequence | *Silene latifolia* |
| SLACS | JN608093 | non-LTR retrotransposon: SLACS-like | *Silene latifolia* isolate fL19 non-LTR retrotransposon SLACS-like, partial sequence | *Silene latifolia* |
| SLACS | JN608092 | non-LTR retrotransposon: SLACS-like | *Silene latifolia* isolate fL18 non-LTR retrotransposon SLACS-like, partial sequence | *Silene latifolia* |
| SLACS | JN608091 | non-LTR retrotransposon: SLACS-like | *Silene latifolia* isolate fL17 non-LTR retrotransposon SLACS-like, partial sequence | *Silene latifolia* |
| SLACS | JN608090 | non-LTR retrotransposon: SLACS-like | *Silene latifolia* isolate fL16 non-LTR retrotransposon SLACS-like, partial sequence | *Silene latifolia* |
| SLACS | JN608089 | non-LTR retrotransposon: SLACS-like | *Silene latifolia* isolate fL15 non-LTR retrotransposon SLACS-like, partial sequence | *Silene latifolia* |
| SLACS | JN608088 | non-LTR retrotransposon: SLACS-like | *Silene latifolia* isolate fL14 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608087 | non-LTR retrotransposon: SLACS-like | *Silene latifolia* isolate fL13 non-LTR retrotransposon SLACS-like, partial sequence | *Silene latifolia* |
| SLACS | JN608086 | non-LTR retrotransposon: SLACS-like | *Silene latifolia* isolate fL12 non-LTR retrotransposon SLACS-like, partial sequence | *Silene latifolia* |
| SLACS | JN608085 | non-LTR retrotransposon: SLACS-like | *Silene latifolia* isolate fL11 non-LTR retrotransposon SLACS-like, partial sequence | *Silene latifolia* |
| SLACS | JN608084 | non-LTR retrotransposon: SLACS-like | *Silene latifolia* isolate fL10 non-LTR retrotransposon SLACS-like, partial sequence | *Silene latifolia* |
| SLACS | JN608083 | non-LTR retrotransposon: SLACS-like | *Silene latifolia* isolate fL09 non-LTR retrotransposon SLACS-like, partial sequence | *Silene latifolia* |
| SLACS | JN608082 | non-LTR retrotransposon: SLACS-like | *Silene latifolia* isolate fL07 non-LTR retrotransposon SLACS-like, partial sequence | *Silene latifolia* |
| SLACS | JN608081 | non-LTR retrotransposon: SLACS-like | *Silene latifolia* isolate fL06 non-LTR retrotransposon SLACS-like, partial sequence | *Silene latifolia* |
| SLACS | JN608080 | non-LTR retrotransposon: SLACS-like | *Silene latifolia* isolate fL05 non-LTR retrotransposon SLACS-like, partial sequence | *Silene latifolia* |
| SLACS | JN608079 | non-LTR retrotransposon: SLACS-like | *Silene latifolia* isolate fL04 non-LTR retrotransposon SLACS-like, partial sequence | *Silene latifolia* |
| SLACS | JN608078 | non-LTR retrotransposon: SLACS-like | *Silene latifolia* isolate fL03 non-LTR retrotransposon SLACS-like, partial sequence | *Silene latifolia* |
| SLACS | JN608077 | non-LTR retrotransposon: SLACS-like | *Silene latifolia* isolate fL01 non-LTR retrotransposon SLACS-like, partial sequence | *Silene latifolia* |
| SLACS | JN608076 | non-LTR retrotransposon: SLACS-like | *Silene latifolia* isolate fF40 non-LTR retrotransposon SLACS-like, partial sequence | *Silene latifolia* |
| SLACS | JN608075 | non-LTR retrotransposon: SLACS-like | *Silene latifolia* isolate fF39 non-LTR retrotransposon SLACS-like, partial sequence | *Silene latifolia* |
| SLACS | JN608074 | non-LTR retrotransposon: SLACS-like | *Silene latifolia* isolate fF38 non-LTR retrotransposon SLACS-like, partial sequence | *Silene latifolia* |
| SLACS | JN608073 | non-LTR retrotransposon: SLACS-like | *Silene latifolia* isolate fF37 non-LTR retrotransposon SLACS-like, partial sequence | *Silene latifolia* |
| SLACS | JN608072 | non-LTR retrotransposon: SLACS-like | *Silene latifolia* isolate fF36 non-LTR retrotransposon SLACS-like, partial sequence | *Silene latifolia* |
| SLACS | JN608071 | non-LTR retrotransposon: SLACS-like | *Silene latifolia* isolate fF35 non-LTR retrotransposon SLACS-like, partial sequence | *Silene latifolia* |
| SLACS | JN608070 | non-LTR retrotransposon: SLACS-like | *Silene latifolia* isolate fF34 non-LTR retrotransposon SLACS-like, partial sequence | *Silene latifolia* |
| SLACS | JN608069 | non-LTR retrotransposon: SLACS-like | *Silene latifolia* isolate fF33 non-LTR retrotransposon SLACS-like, partial sequence | *Silene latifolia* |
| SLACS | JN608068 | non-LTR retrotransposon: SLACS-like | *Silene latifolia* isolate fF32 non-LTR retrotransposon SLACS-like, partial sequence | *Silene latifolia* |
| SLACS | JN608067 | non-LTR retrotransposon: SLACS-like | *Silene latifolia* isolate fF31 non-LTR retrotransposon SLACS-like, partial sequence | *Silene latifolia* |
| SLACS | JN608066 | non-LTR retrotransposon: SLACS-like | *Silene latifolia* isolate fF30 non-LTR retrotransposon SLACS-like, partial sequence | *Silene latifolia* |
| SLACS | JN608065 | non-LTR retrotransposon: SLACS-like | *Silene latifolia* isolate fF29 non-LTR retrotransposon SLACS-like, partial sequence | *Silene latifolia* |
| SLACS | JN608064 | non-LTR retrotransposon: SLACS-like | *Silene latifolia* isolate fF28 non-LTR retrotransposon SLACS-like, partial sequence | *Silene latifolia* |
| SLACS | JN608063 | non-LTR retrotransposon: SLACS-like | *Silene latifolia* isolate fF27 non-LTR retrotransposon SLACS-like, partial sequence | *Silene latifolia* |

TABLE 2-continued

Table 2: RLE-type non-LTR retrotransposon elements

| Family | Accession | Mobile Element | Name/Description | Organism |
|---|---|---|---|---|
| SLACS | JN608062 | non-LTR retrotransposon: SLACS-like | *Silene latifolia* isolate fF26 non-LTR retrotransposon SLACS-like, partial sequence | *Silene latifolia* |
| SLACS | JN608061 | non-LTR retrotransposon: SLACS-like | *Silene latifolia* isolate fF24 non-LTR retrotransposon SLACS-like, partial sequence | *Silene latifolia* |
| SLACS | JN608060 | non-LTR retrotransposon: SLACS-like | *Silene latifolia* isolate fF23 non-LTR retrotransposon SLACS-like, partial sequence | *Silene latifolia* |
| SLACS | JN608059 | non-LTR retrotransposon: SLACS-like | *Silene latifolia* isolate fF21 non-LTR retrotransposon SLACS-like, partial sequence | *Silene latifolia* |
| SLACS | JN608058 | non-LTR retrotransposon: SLACS-like | *Silene latifolia* isolate fF20 non-LTR retrotransposon SLACS-like, partial sequence | *Silene latifolia* |
| SLACS | JN608057 | non-LTR retrotransposon: SLACS-like | *Silene latifolia* isolate fF18 non-LTR retrotransposon SLACS-like, partial sequence | *Silene latifolia* |
| SLACS | JN608056 | non-LTR retrotransposon: SLACS-like | *Silene latifolia* isolate fF17 non-LTR retrotransposon SLACS-like, partial sequence | *Silene latifolia* |
| SLACS | JN608055 | non-LTR retrotransposon: SLACS-like | *Silene latifolia* isolate fF16 non-LTR retrotransposon SLACS-like, partial sequence | *Silene latifolia* |
| SLACS | JN608054 | non-LTR retrotransposon: SLACS-like | *Silene latifolia* isolate fF15 non-LTR retrotransposon SLACS-like, partial sequence | *Silene latifolia* |
| SLACS | JN608053 | non-LTR retrotransposon: SLACS-like | *Silene latifolia* isolate fF14 non-LTR retrotransposon SLACS-like, partial sequence | *Silene latifolia* |
| SLACS | JN608052 | non-LTR retrotransposon: SLACS-like | *Silene latifolia* isolate fF13 non-LTR retrotransposon SLACS-like, partial sequence | *Silene latifolia* |
| SLACS | JN608051 | non-LTR retrotransposon: SLACS-like | *Silene latifolia* isolate fF12 non-LTR retrotransposon SLACS-like, partial sequence | *Silene latifolia* |
| SLACS | JN608050 | non-LTR retrotransposon: SLACS-like | *Silene latifolia* isolate fF11 non-LTR retrotransposon SLACS-like, partial sequence | *Silene latifolia* |
| SLACS | JN608049 | non-LTR retrotransposon: SLACS-like | *Silene latifolia* isolate fF10 non-LTR retrotransposon SLACS-like, partial sequence | *Silene latifolia* |
| SLACS | JN608048 | non-LTR retrotransposon: SLACS-like | *Silene latifolia* isolate fF09 non-LTR retrotransposon SLACS-like, partial sequence | *Silene latifolia* |
| SLACS | JN608047 | non-LTR retrotransposon: SLACS-like | *Silene latifolia* isolate fF08 non-LTR retrotransposon SLACS-like, partial sequence | *Silene latifolia* |
| SLACS | JN608046 | non-LTR retrotransposon: SLACS-like | *Silene latifolia* isolate fF06 non-LTR retrotransposon SLACS-like, partial sequence | *Silene latifolia* |
| SLACS | JN608045 | non-LTR retrotransposon: SLACS-like | *Silene latifolia* isolate fF05 non-LTR retrotransposon SLACS-like, partial sequence | *Silene latifolia* |
| SLACS | JN608044 | non-LTR retrotransposon: SLACS-like | *Silene latifolia* isolate fF04 non-LTR retrotransposon SLACS-like, partial sequence | *Silene latifolia* |
| SLACS | JN608043 | non-LTR retrotransposon: SLACS-like | *Silene latifolia* isolate fF03 non-LTR retrotransposon SLACS-like, partial sequence | *Silene latifolia* |
| SLACS | JN608042 | non-LTR retrotransposon: SLACS-like | *Silene latifolia* isolate fF02 non-LTR retrotransposon SLACS-like, partial sequence | *Silene latifolia* |
| YURECi | AB097133 | rt | *Ciona intestinalis* retrotransposon YURECi DNA, complete sequence | *Ciona intestinalis* |
| CRE | . | Cnl1 | *C. neoformans* non-LTR retrotransposon - consensus. | *Cryptococcus neoformans* |
| CRE | . | CRE-1_ACas | CRE non-LTR retrotransposon: consensus. | *Acanthamoeba castellanii* |
| CRE | . | Cre-1_BM | Cre-1_BM non-LTR retrotransposon - consensus. | *Bombyx mori* |
| CRE | . | CRE-1_CCri | Non-LTR retrotransposon from the red seaweed: consensus. | *Chondrus crispus* |

TABLE 2-continued

Table 2: RLE-type non-LTR retrotransposon elements

| Family | Accession | Mobile Element | Name/Description | Organism |
|---|---|---|---|---|
| CRE | . | Cre-1_FCy | Cre-1_FCy non-LTR retrotransposon - conceptual consensus. | *Fragilariopsis cylindrus* |
| CRE | . | Cre-1_HM | Cre-1_HM non-LTR retrotransposon - consensus. | *Hydra vulgaris* |
| CRE | . | CRE-1_HRo | Cre-like non-LTR retrotransposon: consensus sequence. | *Helobdella robusta* |
| CRE | . | CRE-1_LSa | CRE non-LTR retrotransposon: consensus. | *Lactuca sativa* |
| CRE | . | Cre-1_MB | Cre-1_MB non-LTR retrotransposon - consensus. | *Monosiga brevicollis* |
| CRE | . | Cre-1_NV | Cre-1_NV non-LTR retrotransposon - consensus. | *Nematostella vectensis* |
| CRE | . | CRE-1_PXu | Non-LTR retrotransposon from *Papilio xuthus*: consensus. | *Papilio xuthus* |
| CRE | . | CRE-10_CCri | Non-LTR retrotransposon from the red seaweed: consensus. | *Chondrus crispus* |
| CRE | . | CRE-11_CCri | Non-LTR retrotransposon from the red seaweed: consensus. | *Chondrus crispus* |
| CRE | . | CRE-12_CCri | Non-LTR retrotransposon from the red seaweed: consensus. | *Chondrus crispus* |
| CRE | . | CRE-13_CCri | Non-LTR retrotransposon from the red seaweed: consensus. | *Chondrus crispus* |
| CRE | . | CRE-14_CCri | Non-LTR retrotransposon from the red seaweed: consensus. | *Chondrus crispus* |
| CRE | . | CRE-15_CCri | Non-LTR retrotransposon from the red seaweed: consensus. | *Chondrus crispus* |
| CRE | . | CRE-16_CCri | Non-LTR retrotransposon from the red seaweed: consensus. | *Chondrus crispus* |
| CRE | . | CRE-17_CCri | Non-LTR retrotransposon from the red seaweed: consensus. | *Chondrus crispus* |
| CRE | . | Cre-2_BM | Cre-2_BM non-LTR retrotransposon - consensus. | *Bombyx mori* |
| CRE | . | CRE-2_CCri | Non-LTR retrotransposon from the red seaweed: consensus. | *Chondrus crispus* |
| CRE | . | CRE-2_HMa | CRE non-LTR retrotransposon: consensus. | *Hydra vulgaris* |
| CRE | . | CRE-2_HRo | Cre-like non-LTR retrotransposon: consensus sequence. | *Helobdella robusta* |
| CRE | . | CRE-2_NV | CRE non-LTR retrotransposon: consensus. | *Nematostella vectensis* |
| CRE | . | CRE-2_PXu | Non-LTR retrotransposon from *Papilio xuthus*: consensus. | *Papilio xuthus* |
| CRE | . | CRE-3_CCri | Non-LTR retrotransposon from the red seaweed: consensus. | *Chondrus crispus* |
| CRE | . | CRE-3_HRo | CRE-like non-LTR retrotransposon: consensus sequence. | *Helobdella robusta* |
| CRE | . | CRE-3_NV | CRE non-LTR retrotransposon: consensus. | *Nematostella vectensis* |
| CRE | . | CRE-4_CCri | Non-LTR retrotransposon from the red seaweed: consensus. | *Chondrus crispus* |
| CRE | . | CRE-4_HRo | CRE-like non-LTR retrotransposon: consensus sequence. | *Helobdella robusta* |
| CRE | . | CRE-5_CCri | Non-LTR retrotransposon from the red seaweed: consensus. | *Chondrus crispus* |
| CRE | . | CRE-5_HRo | CRE-like non-LTR retrotransposon: consensus sequence. | *Helobdella robusta* |
| CRE | . | CRE-6_CCri | Non-LTR retrotransposon from the red seaweed: consensus. | *Chondrus crispus* |
| CRE | . | CRE-6_HRo | CRE-like non-LTR retrotransposon: consensus sequence. | *Helobdella robusta* |
| CRE | . | CRE-7_CCri | Non-LTR retrotransposon from the red seaweed: consensus. | *Chondrus crispus* |
| CRE | . | CRE-8_CCri | Non-LTR retrotransposon from the red seaweed: consensus. | *Chondrus crispus* |
| CRE | . | CRE-9_CCri | Non-LTR retrotransposon from the red seaweed: consensus. | *Chondrus crispus* |

TABLE 2-continued

Table 2: RLE-type non-LTR retrotransposon elements

| Family | Accession | Mobile Element | Name/Description | Organism |
|---|---|---|---|---|
| CRE | M33009 | CRE1 | *C. fasciculata* retrotransposable element (CRE1). | *Crithidia fasciculata* |
| CRE | U19151 | CRE2 | *C. fasciculata* retrotransposable element (CRE2). | *Crithidia fasciculata* |
| CRE | M62862 | CZAR | *T. cruzi* SL-RNA-associated non-LTR retrotransposon. | *Trypanosoma cruzi* |
| R4 | . | Dong | *Bombyx mori* non-LTR retrotransposable element. | *Bombyx mori* |
| R4 | . | DONG_FR2 | Non-LTR retrotransposon; site-specific LINE; R4/Dong superfamily; DONG_FR2. | *Takifugu rubripes* |
| R4 | . | Dong-1_AFC | Dong/R4-type non-LTR retrotransposon - consensus. | *Cichlidae* |
| R4 | . | Dong-1_HMM | Non-LTR retrotransposon family from *Heliconius melpomene melpomene*. | *Heliconius melpomene melpomene* |
| R4 | . | Dong-1_NVe | A Dong non-LTR retrotransposon family from *Nematostella vectensis*. | *Nematostella vectensis* |
| R4 | . | Dong-1_PPo | Non-LTR retrotransposon from *Papilio polytes*: consensus. | *Papilio polytes* |
| R4 | . | Dong-1_PXu | Non-LTR retrotransposon from *Papilio xuthus*: consensus. | *Papilio xuthus* |
| R4 | . | Dong-2_BM | Non-LTR retrotransposon - a consensus. | *Bombyx mori* |
| R4 | . | Dong-2_HMM | Non-LTR retrotransposon family from *Heliconius melpomene melpomene*. | *Heliconius melpomene melpomene* |
| R4 | . | Dong-2_Lch | Dong-like non-LTR retrotransposon - consensus. | *Latimeria chalumnae* |
| R4 | . | Dong-2_PPo | Non-LTR retrotransposon from *Papilio polytes*: consensus. | *Papilio polytes* |
| R4 | . | DongAa | A Dong non-LTR retrotransposon family from *Aedes aegypti*. | *Aedes aegypti* |
| R4 | AB097127 | DongAG | *Anopheles gambiae* non-LTR retrotransposon DongAg - a partial sequence. | *Anopheles gambiae* |
| R4 | AB097128 | EhRLE2 | *Entamoeba histolytica* retrotransposon EhRLE2, complete sequence. | *Entamoeba histolytica* |
| R4 | AB097129 | EhRLE3 | *Entamoeba histolytica* retrotransposon EhRLE3, complete sequence. | *Entamoeba histolytica* |
| HERO | . | HERO-1_AFC | Hero-type non-LTR retrotransposon - consensus. | *Cichlidae* |
| HERO | . | HERO-1_BF | Amphioxus HERO-1_BF autonomous non-LTR Retrotransposon - consensus. | *Branchiostoma floridae* |
| HERO | . | HERO-1_HR | A family of HERO non-LTR retrotransposons - a consensus sequence. | *Helobdella robusta* |
| HERO | . | HERO-1_PP | A family of HERO non-LTR retrotransposons - a consensus sequence. | *Physarum polycephalm* |
| HERO | AAGJ02121261 | HERO-1_SP | Sea urchin HERO-1_SP autonomous non-LTR Retrotransposon - consensus. | *Strongylocentrotus purpuratus* |
| HERO | . | HERO-2_BF | Amphioxus HERO-2_BF autonomous non-LTR Retrotransposon - consensus. | *Branchiostoma floridae* |
| HERO | . | HERO-2_DR | HERO-2_DR is a family of HERO non-LTR retrotransposons - a consensus. | *Danio rerio* |
| HERO | . | HERO-2_HR | Non-LTR retrotransposon: consensus sequence. | *Helobdella robusta* |
| HERO | 048B05 | Hero-2_SPur | HERO-type non-ltr retrotransposon from sea urchin. | *Strongylocentrotus purpuratus* |
| HERO | . | HERO-3_BF | HERO-3_BF is a family of HERO non-LTR retrotransposons - a consensus. | *Branchiostoma floridae* |
| HERO | . | HERO-3_DR | HERO-3_DR is a family of HERO non-LTR retrotransposons - a consensus. | *Danio rerio* |

TABLE 2-continued

| Table 2: RLE-type non-LTR retrotransposon elements | | | | |
|---|---|---|---|---|
| Family | Accession | Mobile Element | Name/Description | Organism |
| HERO | . | HERO-3_HR | Non-LTR retrotransposon: consensus sequence. | *Helobdella robusta* |
| HERO | . | Hero-3_SPur | HERO-type non-LTR retrotransposon from sea urchin. | *Strongylocentrotus purpuratus* |
| HERO | . | HERO-4_DR | HERO-4_DR is a family of HERO non-LTR retrotransposons - a consensus. | *Danio rerio* |
| HERO | . | HERO-4_HR | Non-LTR retrotransposon: consensus sequence. | *Helobdella robusta* |
| HERO | . | HERO-5_HR | Non-LTR retrotransposon: consensus sequence. | *Helobdella robusta* |
| HERO | . | HERO-6_HR | Non-LTR retrotransposon: consensus sequence. | *Helobdella robusta* |
| HERO | . | HERO-7_HR | Non-LTR retrotransposon: consensus sequence. | *Helobdella robusta* |
| HERO | . | HERO-8_HR | Non-LTR retrotransposon: consensus sequence. | *Helobdella robusta* |
| HERO | . | HERO-9_HR | Non-LTR retrotransposon: consensus sequence. | *Helobdella robusta* |
| HERO | . | HERODr | HERODr is a family of HERO non-LTR retrotransposons - a consensus. | *Danio rerio* |
| HERO | . | HEROFr | A HERO clade non-LTR Retrotransposon family - consensus. | *Takifugu rubripes* |
| HERO | . | HEROTn | HEROTn or Zebulon non-LTR retrotransposon - a consensus sequence. | *Tetraodon nigroviridis* |
| NeSL | . | LIN10B_SM | Non-LTR retrotransposon; consensus. | *Schmidtea mediterranea* |
| NeSL | . | LIN11_SM | Non-LTR retrotransposon: consensus. | *Schmidtea mediterranea* |
| NeSL | . | LIN13_SM | Non-LTR retrotransposon; consensus. | *Schmidtea mediterranea* |
| NeSL | . | LIN14_SM | Non-LTR retrotransposon; consensus. | *Schmidtea mediterranea* |
| NeSL | . | LIN15_SM | Non-LTR retrotransposon; consensus. | *Schmidtea mediterranea* |
| NeSL | . | LIN2_SM | Non-LTR retrotransposon (consensus). | *Schmidtea mediterranea* |
| NeSL | . | LIN21_SM | Non-LTR retrotransposon; consensus. | *Schmidtea mediterranea* |
| NeSL | . | LIN23_SM | Non-LTR retrotransposon; consensus. | *Schmidtea mediterranea* |
| NeSL | . | LIN24_SM | Non-LTR retrotransposon; consensus. | *Schmidtea mediterranea* |
| NeSL | . | LIN24B_SM | Non-LTR retrotransposon; consensus. | *Schmidtea mediterranea* |
| NeSL | . | LIN25_SM | Non-LTR retrotransposon; consensus. | *Schmidtea mediterranea* |
| NeSL | . | LIN26_SM | Non-LTR retrotransposon; consensus. | *Schmidtea mediterranea* |
| NeSL | . | LIN3_SM | Non-LTR retrotransposon; consensus. | *Schmidtea mediterranea* |
| NeSL | . | LIN4_SM | Non-LTR retrotransposon; consensus. | *Schmidtea mediterranea* |
| NeSL | . | LIN4b_SM | Non-LTR retrotransposon; consensus. | *Schmidtea mediterranea* |
| NeSL | . | LIN5_SM | Non-LTR retrotransposon from *Schmidtea mediterranea*: consensus. | *Schmidtea mediterranea* |
| NeSL | . | LIN6_SM | Non-LTR retrotransposon from *Schmidtea mediterranea*: consensus. | *Schmidtea mediterranea* |
| NeSL | . | LIN7_SM | Non-LTR retrotransposon from *Schmidtea mediterranea*: consensus. | *Schmidtea mediterranea* |
| NeSL | . | LIN7B_SM | Non-LTR retrotransposon; consensus. | *Schmidtea mediterranea* |
| NeSL | . | LIN9_SM | Non-LTR retrotransposon: consensus. | *Schmidtea mediterranea* |
| CRE | JQ747487 | MoTeR1 | Telomere-specific non-LTR retrotransposon MoTeR1 from *Magnaporthe oryzae*. | *Magnaporthe oryzae* |

TABLE 2-continued

| Table 2: RLE-type non-LTR retrotransposon elements | | | | |
|---|---|---|---|---|
| Family | Accession | Mobile Element | Name/Description | Organism |
| CRE | JQ747488 | MoTeR2 | Telomere-specific non-LTR retrotransposon MoTeR2 from *Magnaporthe oryzae*. | *Magnaporthe oryzae* |
| NeSL | Z82058 | NeSL-1 | NeSL-1 is a non-LTR retrotransposon, complete sequence. | *Caenorhabditis elegans* |
| NeSL | . | NeSL-1_C11 | A family of NeSL non-LTR retrotransposons. | *Caenorhabditis tropicalis* |
| NeSL | . | NeSL-1_CA | A family of NeSL non-LTR retrotransposons. | *Caenorhabditis angaria* |
| NeSL | . | NeSL-1_CBre | A family of NeSL non-LTR retrotransposons - consensus. | *Caenorhabditis brenneri* |
| NeSL | . | NeSL-1_CBri | A family of NeSL non-LTR retrotransposons. | *Caenorhabditis briggsae* |
| NeSL | . | NeSL-1_CJap | A family of NeSL non-LTR retrotransposons - consensus. | *Caenorhabditis japonica* |
| NeSL | . | NeSL-1_CRem | A family of NeSL non-LTR retrotransposons - consensus. | *Caenorhabditis remanei* |
| NeSL | . | NeSL-1_SM | Non-LTR retrotransposon; consensus. | *Schmidtea mediterranea* |
| NeSL | . | NeSL-1_TV | A family of NeSL non-LTR retrotransposons - consensus. | *Trichomonas vaginalis* |
| NeSL | . | NeSL-2_CBre | A family of NeSL non-LTR retrotransposons - consensus. | *Caenorhabditis brenneri* |
| NeSL | . | NeSL-2_CRem | A family of NeSL non-LTR retrotransposons - consensus. | *Caenorhabditis remanei* |
| NeSL | . | NeSL-2_SM | Non-LTR retrotransposon; consensus. | *Schmidtea mediterranea* |
| NeSL | . | NeSL-3_CBre | A family of NeSL non-LTR retrotransposons - consensus. | *Caenorhabditis brenneri* |
| NeSL | . | NeSL-3_CRem | A family of NeSL non-LTR retrotransposons - consensus. | *Caenorhabditis remanei* |
| NeSL | chrUn | NeSL-4_CRem | A family of NeSL non-LTR retrotransposons. | *Caenorhabditis remanei* |
| NeSL | . | NeSL-4_SM | Non-LTR retrotransposon; consensus. | *Schmidtea mediterranea* |
| R2 | BN000800 | PERERE-9 | *Schistosoma mansoni* Perere-9 non-LTR retrotransposon (EST). | *Schistosoma mansoni* |
| R4 | . | Plat_R4 | R4 Non-LTR Retrotransposon from *Ornithorhynchus*. | *Ornithorhynchus* |
| R2 | AF015815 | R2_AM | *Anurida maritima* retrotransposon R2, complete sequence. | *Anurida maritima* |
| R2 | M16558 | R2_BM | *Bombyx mori* rDNA insertion element R2 (type II), complete cds. | *Bombyx mori* |
| R2 | AB097121 | R2CI | R2-type LINE. | *Ciona intestinalis* |
| R2 | . | R2CPB | Non-LTR retrotransposon: consensus. | *Chrysemyspicta bellii* |
| R2 | . | R2_DAn | 28S rDNA-specific non-LTR retrotransposon R2 in *Drosophila ananassae*. | *Drosophila ananassae* |
| R2 | X51967 | R2_DM | LINE-like retrotransposable element R2DM. | *Drosophila melanogaster* |
| R2 | . | R2_DPe | 28S rDNA-specific non-LTR retrotransposon R2 in *Drosophila persimilis*. | *Drosophila persimilis* |
| R2 | . | R2_DPs | 28S rDNA-specific non-LTR retrotransposon R2 in *Drosophila pseudoobscura*. | *Drosophila pseudoobscura* |
| R2 | . | R2_DSe | 28S rDNA-specific non-LTR retrotransposon R2 in *Drosophila sechellia*. | *Drosophila sechellia* |
| R2 | . | R2_DSi | 28S rDNA-specific non-LTR retrotransposon R2 in *Drosophila simulans*. | *Drosophila simulans* |
| R2 | . | R2_DYa | 28S rDNA-specific non-LTR retrotransposon R2 in *Drosophila yakuba*. | *Drosophila yakuba* |
| R2 | AF015819 | R2_FA | *Forficula auricularia* retrotransposon R2, complete sequence. | *Forficula auricularia* |
| R2 | AF015816 | R2_HC | *Hippodamia convergens* retrotransposon R2 reverse transcriptase gene, partial cds. | *Hippodamia convergens* |

TABLE 2-continued

Table 2: RLE-type non-LTR retrotransposon elements

| Family | Accession | Mobile Element | Name/Description | Organism |
|---|---|---|---|---|
| R2 | GU949558 | R2_KF | 28S rDNA-specific non-LTR retrotransposon R2 from *Kalotermes flavicollis*. | *Kalotermes flavicollis* |
| R2 | AF015814 | R2_LP | *Limulus polyphemus* retrotransposon R2, complete sequence. | *Limulus polyphemus* |
| R2 | AF015818 | R2_PS | *Porcellio scaber* retrotransposon R2, complete sequence. | *Porcellio scaber* |
| R2 | GU949555 | R2_RL | 28S rDNA-specific non-LTR retrotransposon R2 from *Reticulitermes lucifugus*. | *Reticulitermes lucifugus* |
| R2 | GU949554 | R2_RU | 28S rDNA-specific non-LTR retrotransposon R2 from *Reticulitermes urbis*. | *Reticulitermes urbis* |
| R2 | . | R2-1_AAm | R2 non-LTR retrotransposon from lone star tick. | *Amblyomma americanum* |
| R2 | . | R2-1_ACC | R2 non-LTR retrotransposon from golden eagle. | *Aquila chrysaetos canadensis* |
| R2 | . | R2-1_ACh | R2 non-LTR retrotransposon from rifleman. | *Acanthisitta chloris* |
| R2 | . | R2-1_AFo | R2 non-LTR retrotransposon from emperor penguin. | *Aptenodytes forsteri* |
| R2 | . | R2-1_AMi | R2-type non-LTR retrotransposon. | *Alligator mississippiensis* |
| R2 | . | R2-1_AOM | R2 non-LTR retrotransposon from kiwi. | *Apteryx* spp. |
| R2 | . | R2-1_ApA | R2 non-LTR retrotransposon from north island brown kiwi. | *Apteryx australis mantelli* |
| R2 | . | R2-1_APi | R2 non-LTR retrotransposon from pea aphid. | *Acyrthosiphon pisum* |
| R2 | . | R2-1_BRG | R2 non-LTR retrotransposon from East African grey crowned crane. | *Balearica regulorum gibbericeps* |
| R2 | . | R2-1_BTe | R2 non-LTR retrotransposon from buff-tailed bumblebee. | *Bombus terrestris* |
| R2 | . | R2-1_CAnn | R2 non-LTR retrotransposon from Anna's hummingbird. | *Calypte anna* |
| R2 | . | R2-1_CAu | R2 non-LTR retrotransposon from turkey vulture. | *Cathartes aura* |
| R2 | . | R2-1_CBr | R2 non-LTR retrotransposon from American crow. | *Corvus brachyrhynchos* |
| R2 | . | R2-1_CCa | R2 non-LTR retrotransposon from chuck-will's-widow. | *Antrostomus carolinensis* |
| R2 | . | R2-1_CCan | R2 non-LTR retrotransposon from common cuckoo. | *Cuculus canorus* |
| R2 | . | R2-1_CPu | R2 non-LTR retrotransposon from ruff. | *Calidris pugnax* |
| R2 | . | R2-1_Crp | Non-LTR retrotransposon. | *Crocodylus porosus* |
| R2 | . | R2-1_CSt | R2 non-LTR retrotransposon from speckled mousebird. | *Colius striatus* |
| R2 | . | R2-1_CU | R2 non-LTR retrotransposon from MacQueen's bustard. | *Chlamydotis macqueenii* |
| R2 | . | R2-1_CVo | R2 non-LTR retrotransposon from killdeer. | *Charadrius vociferus* |
| R2 | . | R2-1_DWi | 28S rDNA-specific non-LTR retrotransposon R2 in *Drosophila willistoni*. | *Drosophila willistoni* |
| R2 | . | R2-1_EGa | R2 non-LTR retrotransposon from little egret. | *Egretta garzetta* |
| R2 | . | R2-1_FAl | R2 non-LTR retrotransposon from collared flycatcher. | *Ficedula albicollis* |
| R2 | . | R2-1_FCh | R2 non-LTR retrotransposon from Saker falcon. | *Falco cherrug* |
| R2 | . | R2-1_FPe | R2 non-LTR retrotransposon from peregrine falcon. | *Falco peregrinus* |
| R2 | . | R2-1_GA | R2 non-LTR retrotransposon from three-spined stickleback. | *Gasterosteus aculeatus* |
| R2 | . | R2-1_Gav | Non-LTR retrotransposon. | *Gavialis gangeticus* |
| R2 | . | R2-1_GFo | R2 non-LTR retrotransposon from medium ground finch. | *Geospiza fortis* |
| R2 | . | R2-1_GSt | R2 non-LTR retrotransposon from red-throated loon. | *Gavia stellata* |

TABLE 2-continued

Table 2: RLE-type non-LTR retrotransposon elements

| Family | Accession | Mobile Element | Name/Description | Organism |
|---|---|---|---|---|
| R2 | . | R2-1_HAl | R2 non-LTR retrotransposon from white-tailed eagle. | *Haliaeetus albicilla* |
| R2 | . | R2-1_IS | R2 non-LTR retrotransposon from deer tick. | *Ixodes scapularis* |
| R2 | . | R2-1_LCh | R2-type non-LTR retrotransposon - consensus. | *Latimeria chalumnae* |
| R2 | . | R2-1_LDi | R2 non-LTR retrotransposon from cuckoo roller. | *Leptosomus discolor* |
| R2 | . | R2-1_LSal | non-LTR retrotransposon, consensus. | *Lepeophtheirus salmonis* |
| R2 | . | R2-1_LV | R2 non-LTR retrotransposon from green sea urchin. | *Lytechinus variegatus* |
| R2 | . | R2-1_MDe | R2 non-LTR retrotransposon from Hessian fly. | *Mayetiola destructor* |
| R2 | . | R2-1_MLe | R2 non-LTR retrotransposon - consensus. | *Mnemiopsis leidyi* |
| R2 | . | R2-1_MR | R2 non-LTR retrotransposon from alfalfa leafcutter bee. | *Megachile rotundata* |
| R2 | . | R2-1_MUn | R2 non-LTR retrotransposon fragment from budgerigar. | *Melopsittacus undulatus* |
| R2 | . | R2-1_MUni | R2 non-LTR retrotransposon from brown mesite. | *Mesitornis unicolor* |
| R2 | . | R2-1_MVi | R2 non-LTR retrotransposon from golden-collared manakin. | *Manacus vitellinus* |
| R2 | . | R2-1_NNi | R2 non-LTR retrotransposon from created ibis. | *Nipponia nippon* |
| R2 | . | R2-1_NV | Starlet sea anemone R2-1_NV autonomous Non-LTR Retrotransposon - consensus. | *Nematostella vectensis* |
| R2 | . | R2-1_OHo | R2 non-LTR retrotransposon from hoatzin. | *Opisthocomus hoazin* |
| R2 | . | R2-1_PAd | R2 non-LTR retrotransposon from Adelie penguin. | *Pygoscelis adeliae* |
| R2 | . | R2-1_PBa | R2 non-LTR retrotransposon from red harvester ant. | *Pogonomyrmex barbatus* |
| R2 | . | R2-1_PCar | R2 non-LTR retrotransposon from great cormorant. | *Phalacrocorax carbo* |
| R2 | . | R2-1_PCau | R2 non-LTR retrotransposon sequence. | *Priapulus caudatus* |
| R2 | . | R2-1_PCr | R2 non-LTR retrotransposon from great crested grebe. | *Podiceps cristatus* |
| R2 | . | R2-1_PCri | R2 non-LTR retrotransposon from Dalmatian pelican. | *Pelecanus crispus* |
| R2 | . | R2-1_PGu | R2 non-LTR retrotransposon from sandgrouse. | *Pterocles gutturalis* |
| R2 | . | R2-1_PLe | R2 non-LTR retrotransposon from tropicbird. | *Phaethon lepturus* |
| R2 | . | R2-1_PM | R2-1_PM is a family of R2 non-LTR retrotransposons - consensus. | *Petromyzon marinus* |
| R2 | . | R2-1_PPap | R2 non-LTR retrotransposon from sand fly. | *Phlebotomus papatasi* |
| R2 | . | R2-1_PPu | R2 non-LTR retrotransposon from downy woodpecker. | *Picoides pubescens* |
| R2 | . | R2-1_PRR | R2 non-LTR retrotransposon from American flamingo. | *Phoenicopterus ruber ruber* |
| R2 | . | R2-1_PSi | R2 non-LTR retrotransposon from Chinese soft-shelled turtle. | *Pelodiscus sinensis* |
| R2 | . | R2-1_RMi | R2 non-LTR retrotransposon from brown tick. | *Rhipicephaus microplus* |
| R2 | . | R2-1_RPr | R2 non-LTR retrotransposon sequence. | *Rhodnius prolixus* |
| R2 | . | R2-1_RPu | R2 non-LTR retrotransposon cDNA sequence from brown tick. | *Rhipicephalus pulchellus* |
| R2 | . | R2-1_SCa | R2 non-LTR retrotransposon from Atlantic canary. | *Serinus canaria* |
| R2 | . | R2-1_SK | R2 non-LTR retrotransposon from acorn worm. | *Saccoglossus kowalevskii* |
| R2 | . | R2-1_SM | R2-type retrotransposon from *Schmidtea mediterranea*: consensus. | *Schmidtea mediterranea* |

TABLE 2-continued

Table 2: RLE-type non-LTR retrotransposon elements

| Family | Accession | Mobile Element | Name/Description | Organism |
|---|---|---|---|---|
| R2 | . | R2-1_SP | R2 non-LTR retrotransposon from purple sea urchin. | *Strongylocentrotus purpuratus* |
| R2 | AGKD01072455 | R2-1_SSa | R2-type non-LTR retrotransposon. | *Salmo salar* |
| R2 | . | R2-1_StC | R2 non-LTR retrotransposon from ostrich. | *Struthiocamelus australis* |
| R2 | . | R2-1_TAl | R2 non-LTR retrotransposon from barn owl. | *Tyto alba* |
| R2 | . | R2-1_TCas | R2 non-LTR retrotransposon from red flour beetle - consensus | *Tribolium castaneum* |
| R2 | . | R2-1_TG | A family of R2 non-LTR retrotransposons - consensus sequence. | *Taeniopygia guttata* |
| R2 | . | R2-1_TGut | R2 non-LTR retrotransposon from white-throated tinamou. | *Tinamus guttatus* |
| R2 | . | R2-1_TSP | A family of R2 non-LTR retrotransposons in the *Trichinella spiralis* genome - a consensus. | *Trichinella spiralis* |
| R2 | scaffold_6 | R2-1_TUr | R2 non-LTR retrotransposon from twospotted spider mite. | *Tetranychus urticae* |
| R2 | . | R2-1_XM | R2 non-LTR retrotransposon fragment from Southern platyfish. | *Xiphophorus maculatus* |
| R2 | . | R2-1_ZA | R2 non-LTR retrotransposon from white-throated sparrow. | *Zonotrichia albicollis* |
| R2 | . | R2-1_ZLM | R2 non-LTR retrotransposon from silvereye. | *Zosterops lateralis melanops* |
| R2 | . | R2-2_APi | R2 non-LTR retrotransposon from pea aphid. | *Acyrthosiphon pisum* |
| R2 | . | R2-2_CCan | R2 non-LTR retrotransposon from common cuckoo. | *Cuculus canorus* |
| R2 | . | R2-2_CMa | R2 non-LTR retrotransposon from Macqueen's bustard. | *Chlamydotis macqueenii* |
| R2 | . | R2-2_DWi | 28S rDNA-specific non-LTR retrotransposon R2 in *Drosophila willistoni*. | *Drosophila willistoni* |
| R2 | . | R2-2_HAl | R2 non-LTR retrotransposon from white-tailed eagle. | *Haliaeetus albicilla* |
| R2 | . | R2-2_IS | R2 non-LTR retrotransposon from deer tick. | *Ixodes scapularis* |
| R2 | . | R2-2_MR | R2 non-LTR retrotransposon from alfalfa leafcutter bee. | *Megachile rotundata* |
| R2 | . | R2-2_MUn | R2 non-LTR retrotransposon fragment from budgerigar. | *Melopsittacus undulatus* |
| R2 | . | R2-2_MUni | R2 non-LTR retrotransposon from brown mesite. | *Mesitornis unicolor* |
| R2 | . | R2-2_NNi | R2 non-LTR retrotransposon from created ibis. | *Nipponia nippon* |
| R2 | . | R2-2_NV | Starlet sea anemone R2-2_NV autonomous Non-LTR Retrotransposon - consensus. | *Nematostella vectensis* |
| R2 | . | R2-2_PBa | R2 non-LTR retrotransposon from red harvester ant. | *Pogonomyrmex barbatus* |
| R2 | . | R2-2_PM | R2-2_PM is a family of R2 non-LTR retrotransposons - a consensus. | *Petromyzon marinus* |
| R2 | . | R2-2_RPr | R2 non-LTR retrotransposon sequence. | *Rhodnius prolixus* |
| R2 | . | R2-2_SMed | R2 non-LTR retrotransposon from *Schmidtea mediterranea*: consensus. | *Schmidtea mediterranea* |
| R2 | . | R2-2_TCas | R2 non-LTR retrotransposon from red flour beetle. | *Tribolium castaneum* |
| R2 | scaffold_37 | R2-2_TUr | R2 non-LTR retrotransposon from twospotted spider mite. | *Tetranychus urticae* |
| R2 | ABJB010555169 | R2-3_IS | R2 non-LTR retrotransposon from deer tick. | *Ixodes scapularis* |
| R2 | . | R2-3_MR | R2 non-LTR retrotransposon from alfalfa leafcutter bee. | *Megachile rotundata* |
| R2 | . | R2-4_MR | R2 non-LTR retrotransposon from alfalfa leafcutter bee. | *Megachile rotundata* |
| R2 | . | R2-5_MR | R2 non-LTR retrotransposon from alfalfa leafcutter bee. | *Megachile rotundata* |
| R2 | . | R2-6_MR | R2 non-LTR retrotransposon from alfalfa leafcutter bee. | *Megachile rotundata* |

TABLE 2-continued

Table 2: RLE-type non-LTR retrotransposon elements

| Family | Accession | Mobile Element | Name/Description | Organism |
|---|---|---|---|---|
| R2 | . | R2-7_MR | R2 non-LTR retrotransposon from alfalfa leafcutter bee. | *Megachile rotundata* |
| R2 | . | R2-8_MR | R2 non-LTR retrotransposon from alfalfa leafcutter bee. | *Megachile rotundata* |
| R2 | . | R2-N1_Gav | Non-LTR retrotransposon. | *Gavialis gangeticus* |
| R2 | . | R2-N2_Gav | Non-LTR retrotransposon. | *Gavialis gangeticus* |
| R2 | . | R2-N2B_Gav | Non-LTR retrotransposon. | *Gavialis gangeticus* |
| R2 | . | R2A_NVi | 28S rDNA-specific non-LTR retrotransposon R2 in *Nasonia vitripennis*. | *Nasonia vitripennis* |
| R2 | AF015817 | R2A_TM | *Tenebrio molitor* retrotransposon R2 reverse transcriptase gene, partial cds. | *Tenebrio molitor* |
| R2 | . | R2Amel | R2Amel - R2 non-LTR retrotransposon from the honeybee *Apis mellifera*. | *Apis mellifera* |
| R2 | AF015685 | R2B_DM | *Drosophila mercatorum* R2 retrotransposon reverse transcriptase domain protein gene, complete cds. | *Drosophila mercatorum* |
| R2 | . | R2B_NVi | 28S rDNA-specific non-LTR retrotransposon R2 in *Nasonia vitripennis*. | *Nasonia vitripennis* |
| R2 | AF015822 | R2B_TM | *Tenebrio molitor* retrotransposon R2 reverse transcriptase gene, partial cds. | *Tenebrio molitor* |
| R2 | . | R2C_NGi | 28S rDNA-specific non-LTR retrotransposon R2 in *Nasonia giraulti*. | *Nasonia giraulti* |
| R2 | AB097122 | R2Ci-B | *Ciona intestinalis* retrotransposon R2Ci-B, complete sequence. | *Ciona intestinalis* |
| R2 | . | R2Ci-D | *Ciona intestinalis* retrotransposon R2CiD, complete sequence. | *Ciona intestinalis* |
| R2 | AB097121 | R2CIA_CI | *Ciona intestinalis* retrotransposon R2Ci-A, complete sequence. | *Ciona intestinalis* |
| R2 | AB097125 | R2Cs-D | *Ciona intestinalis* retrotransposon R2CsD, partial sequence. | *Ciona savignyi* |
| R2 | . | R2D_NGi | 28S rDNA-specific non-LTR retrotransposon R2 in *Nasonia giraulti*. | *Nasonia giraulti* |
| R2 | NM_001030097 | R2Dr | R2 non-LTR retrotransposon in the *Danio rerio* genome - a single copy. | *Danio rerio* |
| R2 | . | R2E_NLo | 28S rDNA-specific non-LTR retrotransposon R2 in *Nasonia longicornisi*. | *Nasonia longicornis* |
| R2 | AB201408 | R2Eb | R2 non-LTR retrotransposon from *Eptatretus burgeri*. | *Eptatretus burgeri* |
| R2 | AB201415 | R2Ha | R2 non-LTR retrotransposon from *Hasarius adansoni*. | *Hasarius adansoni* |
| R2 | JN937617 | R2La | R2-type non-LTR retrotransposon. | *Lepidurus arcticus* |
| R2 | . | R2LcA | R2-type non-LTR retrotransposon. | *Lepidurus couesii* |
| R2 | JN937619 | R2LcB | R2-type non-LTR retrotransposon. | *Lepidurus couesii* |
| R2 | . | R2LcC | R2-type non-LTR retrotransposon. | *Lepidurus couesii* |
| R2 | JN937616 | R2Ll | R2-type non-LTR retrotransposon. | *Lepidurus apus lubbocki* |
| R2 | AB201414 | R2Mr | R2 non-LTR retrotransposon from *Metacrinus rotundus*. | *Metacrinus rotundus* |
| R2 | . | R2NS-1_CGi | R2-type retrotransposon from *Crassostrea gigas*. | *Crassostrea gigas* |
| R2 | . | R2NS-1_CSi | R2-type retrotransposon from *Clonorchis sinensis*: consensus. | *Clonorchis sinensis* |
| R2 | . | R2NS-1_PMi | R2-like non-LTR retrotransposon from bat star. | *Patiria miniata* |
| R2 | . | R2NS-1_SMed | R2-type retrotransposon from *Schmidtea mediterranea*: consensus. | *Schmidtea mediterranea* |

TABLE 2-continued

Table 2: RLE-type non-LTR retrotransposon elements

| Family | Accession | Mobile Element | Name/Description | Organism |
|---|---|---|---|---|
| R2 | . | R2Nvec-A | R2Nvec-A - R2 non-LTR retrotransposon from the starlet sea anemone *Nematostella vectensis*. | *Nematostella vectensis* |
| R2 | . | R2Ol-A | R2 non-LTR retrotransposon from the medaka *Oryzias latipes* - consensus. | *Oryzias latipes* |
| R2 | AB201416 | R2Pc | R2 non-LTR retrotransposon from *Procambarus clarkii*. | *Procambarus clarkii* |
| R2 | . | R2Sm-A | R2Sm-A - R2 non-LTR retrotransposon from the bloodfluke *Schistosoma mansoni*. | *Schistosoma mansoni* |
| R2 | AB201409 | R2Ta | R2 non-LTR retrotransposon from *Tanichthys albonubes*. | *Tanichthys albonubes* |
| R2 | EU854578 | R2Tc | R2-type non-LTR retrotransposon. | *Triops cancriformis* |
| R2 | JN937621 | R2Tc_it | R2-type non-LTR retrotransposon. | *Triops cancriformis* |
| R2 | AB201417 | R2Tl | R2 non-LTR retrotransposon from *Triops longicaudatus*. | *Triops longicaudatus* |
| R4 | U29445 | R4_AL | *Ascaris lumbricoides* site-specific non-LTR retrotransposable element R4 in 26S rDNA, complete sequence. | *Ascaris lumbricoides* |
| R4 | U29590 | R4_HC | *Haemonchus contortus* non-LTR retrotransposon specific to the large subunit rRNA genes of nematodes. | *Haemonchus contortus* |
| R4 | . | R4_Hmel | a R4 element from *Heliconius melpomene*. | *Heliconius melpomene* |
| R4 | . | R4-1_AC | A family of R4 non-LTR retrotransposons - consensus sequence. | *Anolis carolinensis* |
| R4 | . | R4-1_ADi | R4-type retrotransposon: consensus. | *Acropora digitifera* |
| R4 | . | R4-1_BM | Non-LTR retrotransposon - a consensus. | *Bombyx mori* |
| R4 | CADV01008175 | R4-1_BX | An R4 non-LTR retrotransposon family from *Bursaphelenchus xylophilus*. | *Bursaphelenchus xylophilus* |
| R4 | ABLE03011482 | R4-1_CJap | An R4 non-LTR retrotransposon family from *Caenorhabditis japonica*. | *Caenorhabditis japonica* |
| R4 | . | R4-1_CM | Non-LTR retrotransposon from the elephant shark - consensus. | *Callorhinchus milii* |
| R4 | . | R4-1_CPB | Non-LTR retrotransposon: consensus. | *Chrysemyspicta bellii* |
| R4 | . | R4-1_ED | Autonomous non-LTR retrotransposon from the R4 clade - a consensus sequence. | *Entamoeba dispar* |
| R4 | . | R4-1_HG | An R4 non-LTR retrotransposon family from *Heterodera glycines*. | *Heterodera glycines* |
| R4 | . | R4-1_HMe | Non-LTR retrotransposon family from *Heliconius melpomene melpomene*. | *Heliconius melpomene melpomene* |
| R4 | CABB01003843 | R4-1_MI | An R4 non-LTR retrotransposon family from *Meloidogyne incognita*. | *Meloidogyne incognita* |
| R4 | . | R4-1_PH | Non-LTR Retrotransposon, consensus. | *Parhyale hawaiensis* |
| R4 | CACX01002001 | R4-1_SRa | An R4 non-LTR retrotransposon family from *Strongyloides ratti*. | *Strongyloides ratti* |
| R4 | . | R4-1_TCa | R4-type retrotransposon: consensus. | *Tribolium castaneum* |
| R4 | . | R4-1B_AC | Dong-type non-LTR retrotransposons - a consensus sequence. | *Anolis carolinensis* |
| R4 | . | R4-2_AS | An R4 non-LTR retrotransposon family from *Ascaris suum*. | *Ascaris suum* |
| R4 | CADV01009048 | R4-2_BX | An R4 non-LTR retrotransposon family from *Bursaphelenchus xylophilus*. | *Bursaphelenchus xylophilus* |

TABLE 2-continued

Table 2: RLE-type non-LTR retrotransposon elements

| Family | Accession | Mobile Element | Name/Description | Organism |
|---|---|---|---|---|
| R4 | ABLA01000389 | R4-2_HG | An R4 non-LTR retrotransposon family from *Heterodera glycines.* | *Heterodera glycines* |
| R4 | CACX01002006 | R4-2_SRa | An R4 non-LTR retrotransposon family from *Strongyloides ratti.* | *Strongyloides ratti* |
| R4 | CADV01008832 | R4-3_BX | An R4 non-LTR retrotransposon family from *Bursaphelenchus xylophilus.* | *Bursaphelenchus xylophilus* |
| R4 | . | R4-3_SRa | An R4 non-LTR retrotransposon family from *Strongyloides ratti.* | *Strongyloides ratti* |
| R4 | . | R4-4_BX | An R4 non-LTR retrotransposon family from *Bursaphelenchus xylophilus.* | *Bursaphelenchus xylophilus* |
| R4 | . | R4-4_SRa | An R4 non-LTR retrotransposon family from *Strongyloides ratti.* | *Strongyloides ratti* |
| R4 | . | R4-5_BX | An R4 non-LTR retrotransposon family from *Bursaphelenchus xylophilus.* | *Bursaphelenchus xylophilus* |
| NeSL | AY216701 | R5 | *Girardia tigrina* R5 retrotransposon, complete sequence. | *Girardia tigrina* |
| NeSL | . | R5-1_SM | A family of planarian NeSL non-LTR retrotransposons - consensus. | *Schmidtea mediterranea* |
| NeSL | . | R5-2_SM | A family of planarian NeSL non-LTR retrotransposons - consensus. | *Schmidtea mediterranea* |
| R2 | . | R8Hm-A | R8Hm-A - 18S rDNA-specific non-LTR retrotransposon from *Hydra magnipapillata.* | *Hydra vulgaris* |
| R2 | . | R8Hm-B | R8Hm-B - 18S rDNA-specific non-LTR retrotransposon from *Hydra magnipapillata.* | *Hydra vulgaris* |
| R2 | . | R9Av | R9Av, an rDNA-specific non-LTR retrotransposon family from rotifer. | *Adineta vaga* |
| R2 | FJ461304 | RaR2 | 28S rDNA-specific non-LTR retrotransposon R2 from *Rhynchosciara americana.* | *Rhynchosciara americana* |
| R4 | . | Rex6 | Non-LTR retrotransposon; site-specific LINE; R4/Dong superfamily; REX6; DONG_FR. | *Takifugu rubripes* |
| R4 | . | Rex6-1_OL | A Rex6 non-LTR retrotransposon family from *Olyzias latipes.* | *Oryzias latipes* |
| CRE | X17078 | SLACS | *Trypanosoma brucei* DNA for retrotransposable element SLACS. | *Trypanosoma brucei* |
| NeSL | . | Utopia-1_ACa | Utopia-1_ACa is a protozoan Utopia non-LTR retrotransposon - a complete sequence. | *Acanthamoeba castellanii* |
| NeSL | scaffold_474 | Utopia-1_ACar | A family of NeSL non-LTR retrotransposons. | *Anolis carolinensis* |
| NeSL | . | Utopia-1_AEc | A family of Utopia non-LTR retrotransposons - consensus. | *Acromyrmex echinatior* |
| NeSL | . | Utopia-1_AMi | A family of NeSL non-LTR retrotransposons - consensus. | *Alligator mississippiensis* |
| NeSL | . | Utopia-1_APi | A family of Utopia non-LTR retrotransposons - consensus. | *Acyrthosiphon pisum* |
| NeSL | . | Utopia-1_APl | A family of Utopia non-LTR retrotransposons. | *Agrilus planipennis* |
| NeSL | . | Utopia-1_CFl | A family of Utopia non-LTR retrotransposons - consensus. | *Camponotus floridanus* |
| NeSL | . | Utopia-1_CMy | A family of Utopia non-LTR retrotransposons - consensus. | *Chelonia mydas* |
| NeSL | . | Utopia-1_CPB | A family of Utopia non-LTR retrotransposons - consensus. | *Chrysemyspicta bellii* |
| NeSL | . | Utopia-1_Crp | Non-LTR retrotransposon. | *Crocodylus porosus* |
| NeSL | . | Utopia-1_DPo | A family of Utopia non-LTR retrotransposons. | *Dendroctonus ponderosae* |
| NeSL | . | Utopia-1_DPu | A family of Utopia non-LTR retrotransposons - consensus. | *Daphnia pulex* |
| NeSL | . | Utopia-1_DYak | A family of Utopia non-LTR retrotransposons - consensus. | *Drosophila yakuba* |
| NeSL | . | Utopia-1_EBr | A family of Utopia non-LTR retrotransposons - consensus. | *Eimeria brunetti* |

TABLE 2-continued

Table 2: RLE-type non-LTR retrotransposon elements

| Family | Accession | Mobile Element | Name/Description | Organism |
|---|---|---|---|---|
| NeSL | . | Utopia-1_EMi | A family of Utopia non-LTR retrotransposons - consensus. | *Eimeria mitis* |
| NeSL | . | Utopia-1_ENe | A family of Utopia non-LTR retrotransposons - consensus. | *Eimeria necatrix* |
| NeSL | . | Utopia-1_Gav | Non-LTR retrotransposon. | *Gavialis gangeticus* |
| NeSL | . | Utopia-1_GG1 | A family of Utopia non-LTR retrotransposons. | *Ganaspis* |
| NeSL | . | Utopia-1_HAra | A family of Utopia non-LTR retrotransposons. | *Hyaloperonospora arabidopsidis* |
| NeSL | . | Utopia-1_HG | A family of Utopia non-LTR retrotransposons. | *Heterodera glycines* |
| NeSL | . | Utopia-1_HMM | A family of Utopia non-LTR retrotransposons. | *Heliconius melpomene melpomene* |
| NeSL | . | Utopia-1_HSal | A family of Utopia non-LTR retrotransposons - consensus. | *Harpegnathos saltator* |
| NeSL | . | Utopia-1_IS | A family of Utopia non-LTR retrotransposons - consensus. | *Ixodes scapularis* |
| NeSL | . | Utopia-1_LAl | A family of Utopia non-LTR retrotransposons. | *Lasioglossum albipes* |
| NeSL | . | Utopia-1_LFu | A family of Utopia non-LTR retrotransposons. | *Ladona fulva* |
| NeSL | AGCV01358106 | Utopia-1_LV | A family of Utopia non-LTR retrotransposons. | *Lytechinus variegatus* |
| NeSL | . | Utopia-1_MRo | A family of Utopia non-LTR retrotransposons - consensus. | *Megachile rotundata* |
| NeSL | . | Utopia-1_NVit | A family of Utopia non-LTR retrotransposons - consensus. | *Nasonia vitripennis* |
| NeSL | . | Utopia-1_PAlni | NeSL non-LTR retrotransposon from *Phytophthora alni*. | *Phytophthora alni* |
| NeSL | . | Utopia-1_PArrh | NeSL non-LTR retrotransposon from *Pythium arrhenomanes*. | *Pythium arrhenomanes* |
| NeSL | . | Utopia-1_PBa | A family of Utopia non-LTR retrotransposons - consensus. | *Pogonomyrmex barbatus* |
| NeSL | . | Utopia-1_PCa | A family of Utopia non-LTR retrotransposons - consensus. | *Phytophthora capsici* |
| NeSL | . | Utopia-1_PCinn | NeSL non-LTR retrotransposon from *Phytophthora cinnamomi*. | *Phytophthora cinnamomi* |
| NeSL | AHJF01004292 | Utopia-1_PCu | A family of Utopia non-LTR retrotransposons - consensus. | *Pseudoperonospora cubensis* |
| NeSL | . | Utopia-1_PI | A family of NeSL non-LTR retrotransposons - consensus. | *Phytophthora infestans* |
| NeSL | . | Utopia-1_PInsi | NeSL non-LTR retrotransposon from *Pythium insidiosum*. | *Pythium insidiosum* |
| NeSL | . | Utopia-1_PKern | NeSL non-LTR retrotransposon from *Phytophthora kernoviae*. | *Phytophthora kernoviae* |
| NeSL | . | Utopia-1_PLate | NeSL non-LTR retrotransposon from *Phytophthora lateralis*. | *Phytophthora lateralis* |
| NeSL | . | Utopia-1_PMi | A family of Utopia non-LTR retrotransposons. | *Patiria miniata* |
| NeSL | . | Utopia-1_PPac | A family of Utopia non-LTR retrotransposons. | *Pristionchus pacificus* |
| NeSL | . | Utopia-1_PPini | NeSL non-LTR retrotransposon from *Phytophthora pinifolia*. | *Phytophthora pinifolia* |
| NeSL | . | Utopia-1_PR | A family of Utopia non-LTR retrotransposons - consensus. | *Phytophthora ramorum* |
| NeSL | . | Utopia-1_PRe | A family of Utopia non-LTR retrotransposons - consensus. | *Panagrellus redivivus* |
| NeSL | . | Utopia-1_PS | A family of Utopia non-LTR retrotransposons - consensus. | *Phytophthora sojae* |
| NeSL | . | Utopia-1_PSi | A family of Utopia non-LTR retrotransposons - consensus. | *Pelodiscus sinensis* |
| NeSL | . | Utopia-1_PT | A family of Utopia non-LTR retrotransposons. | *Parasteatoda tepidariorum* |
| NeSL | ADOS01001321 | Utopia-1_PU | A family of Utopia non-LTR retrotransposons. | *Pythium ultimum* |
| NeSL | . | Utopia-1_PVexa | NeSL non-LTR retrotransposon from *Phytopythium vexans*. | *Phytopythium* aff. *vexans* |
| NeSL | . | Utopia-1_SaPa | A family of Utopia non-LTR retrotransposons. | *Saprolegnia parasitica* |
| NeSL | . | Utopia-1_SDicl | NeSL non-LTR retrotransposon from *Saprolegnia diclina*. | *Saprolegnia diclina* |
| NeSL | . | Utopia-1_SM | A family of Utopia non-LTR retrotransposons. | *Strigamia maritima* |

TABLE 2-continued

| Table 2: RLE-type non-LTR retrotransposon elements | | | | |
|---|---|---|---|---|
| Family | Accession | Mobile Element | Name/Description | Organism |
| NeSL | AAGJ02140537 | Utopia-1_SP | A family of Utopia non-LTR retrotransposons. | *Strongylocentrotus purpuratus* |
| NeSL | . | Utopia-1_TSP | A family of Utopia non-LTR retrotransposons. | *Trichinella spiralis* |
| NeSL | . | Utopia-1B_CPB | A family of Utopia non-LTR retrotransposons - consensus. | *Chrysemys picta bellii* |
| NeSL | . | Utopia-2_APi | A family of Utopia non-LTR retrotransposons. | *Acyrthosiphon pisum* |
| NeSL | . | Utopia-2_CMy | A family of Utopia non-LTR retrotransposons - consensus. | *Chelonia mydas* |
| NeSL | . | Utopia-2_CPB | A family of Utopia non-LTR retrotransposons - consensus. | *Chrysemys picta bellii* |
| NeSL | . | Utopia-2_DPu | A family of Utopia non-LTR retrotransposons. | *Daphnia pulex* |
| NeSL | . | Utopia-2_LFu | A family of Utopia non-LTR retrotransposons. | *Ladona fulva* |
| NeSL | . | Utopia-2_PCa | A family of Utopia non-LTR retrotransposons - consensus. | *Phytophthora capsici* |
| NeSL | . | Utopia-2_PI | A family of NeSL non-LTR retrotransposons - consensus. | *Phytophthora infestans* |
| NeSL | . | Utopia-2_PR | A family of Utopia non-LTR retrotransposons - consensus. | *Phytophthora ramorum* |
| NeSL | . | Utopia-2_PS | A family of Utopia non-LTR retrotransposons - consensus. | *Phytophthora sojae* |
| NeSL | . | Utopia-2_PU | A family of Utopia non-LTR retrotransposons. | *Pythium ultimum* |
| NeSL | . | Utopia-3_CPB | A family of Utopia non-LTR retrotransposons - consensus. | *Chrysemys picta bellii* |
| NeSL | . | Utopia-3_DPu | A family of Utopia non-LTR retrotransposons. | *Daphnia pulex* |
| NeSL | . | Utopia-3_LFu | A family of Utopia non-LTR retrotransposons. | *Ladona fulva* |
| NeSL | . | Utopia-3_PCa | A family of Utopia non-LTR retrotransposons - consensus. | *Phytophthora capsici* |
| NeSL | . | Utopia-3_PI | A family of NeSL non-LTR retrotransposons - consensus. | *Phytophthora infestans* |
| NeSL | . | Utopia-3_PR | A family of Utopia non-LTR retrotransposons - consensus. | *Phytophthora ramorum* |
| NeSL | . | Utopia-4_LFu | A family of Utopia non-LTR retrotransposons. | *Ladona fulva* |
| NeSL | AATU01001281.1 | Utopia-4_PI | A family of NeSL non-LTR retrotransposons - a copy. | *Phytophthora infestans* |
| NeSL | . | Utopia-4_PR | A family of Utopia non-LTR retrotransposons - consensus. | *Phytophthora ramorum* |
| NeSL | . | Utopia-5_LFu | A family of Utopia non-LTR retrotransposons. | *Ladona fulva* |
| NeSL | . | Utopia-5_PI | A family of Utopia non-LTR retrotransposons - consensus. | *Phytophthora infestans* |
| NeSL | . | Utopia-5_PR | A family of Utopia non-LTR retrotransposons - consensus. | *Phytophthora ramorum* |
| NeSL | . | Utopia-6_LFu | A family of Utopia non-LTR retrotransposons. | *Ladona fulva* |
| R4 | . | X4_LINE | Conserved LINE element reconstructed from the human genome - consensus. | *Vertebrata* |
| NeSL | . | YURE_CSa | A NeSL non-LTR retrotransposon from *Ciona savignyi*. | *Ciona savignyi* |
| R2 | . | YURE-2_Cis | YURE non-LTR retrotransposon from *Ciona savignyi*. | *Ciona savignyi* |
| NeSL | . | YURECi | *Ciona intestinalis* retrotransposon YURECi. | *Ciona intestinalis* |

A skilled artisan can, based on the Accession numbers provided in Tables 1-3 determine the nucleic acid and corresponding polypeptide sequences of each retrotransposon and domains thereof, e.g., by using routine sequence analysis tools as Basic Local Alignment Search Tool (BLAST) or CD-Search for conserved domain analysis. Other sequence analysis tools are known and can be found, e.g., at molbiol-tools.ca, for example, at molbiol-tools.ca/Motifs.htm. SEQ ID NOs 1-112 align with each row in Table 1, and SEQ ID NOs 113-1015 align with the first 903 rows of Table 2.

Tables 1-3 herein provide the sequences of exemplary transposons, including the amino acid sequence of the retrotransposase, and sequences of 5' and 3' untranslated regions to allow the retrotransposase to bind the template RNA, and the full transposon nucleic acid sequence. In some embodiments, a 5' UTR of any of Tables 1-3 allows the retrotransposase to bind the template RNA. In some embodiments, a 3' UTR of any of Tables 1-3 allows the retrotransposase to bind the template RNA. Thus, in some embodiments, a polypeptide for use in any of the systems described herein can be a polypeptide of any of Tables 1-3 herein, or a sequence having at least 70%, 75%, 80%, 85%, 90%, 95%, 96%, 97%, 98%, or 99% identity thereto. In some embodiments, the system further comprises one or both of a 5' or 3' untranslated region of any of Tables 1-3 herein (or a sequence having at least 70%, 75%, 80%, 85%, 90%, 95%, 96%, 97%, 98%, or 99% identity thereto), e.g., from the same transposon as the polypeptide referred to in the preceding sentence, as indicated in the same row of the same table. In some embodiments, the system comprises one or both of a 5' or 3' untranslated region of any of Tables 1-3 herein, e.g., a segment of the full transposon sequence that encodes an RNA that is capable of binding a retrotransposase, and/or the sub-sequence provided in the column entitled Predicted 5' UTR or Predicted 3' UTR.

In some embodiments, a polypeptide for use in any of the systems described herein can be a molecular reconstruction or ancestral reconstruction based upon the aligned polypeptide sequence of multiple retrotransposons. In some embodiments, a 5' or 3' untranslated region for use in any of the systems described herein can be a molecular reconstruction based upon the aligned 5' or 3' untranslated region of multiple retrotransposons. A skilled artisan can, based on the Accession numbers provided herein, align polypeptides or nucleic acid sequences, e.g., by using routine sequence analysis tools as Basic Local Alignment Search Tool (BLAST) or CD-Search for conserved domain analysis. Molecular reconstructions can be created based upon sequence consensus, e.g. using approaches described in Ivics et al., *Cell* 1997, 501-510; Wagstaff et al., *Molecular Biology and Evolution* 2013, 88-99. In some embodiments, the retrotransposon from which the 5' or 3' untranslated region or polypeptide is derived is a young or a recently active mobile element, as assessed via phylogenetic methods such as those described in Boissinot et al., Molecular Biology and Evolution 2000, 915-928.

Table 3 (below) shows exemplary GENE WRITER™ proteins and associated sequences from a variety of retrotransposases, identified using data mining. Column 1 indicates the family to which the retrotransposon belongs. Column 2 lists the element name. Column 3 indicates an accession number, if any. Column 4 lists an organism in which the retrotransposase is found. Column 5 lists the DNA sequence of the retrotransposon. Column 6 lists the predicted 5' untranslated region, and column 7 lists the predicted 3' untranslated region; both are segments of the sequence of column 5 that are predicted to allow the template RNA to bind the retrotransposase of column 8. (It is understood that columns 5-7 show the DNA sequence, and that an RNA sequence according to any of columns 5-7 would typically include uracil rather than thymidine.) Column 8 lists the predicted retrotransposase sequence encoded in the retrotransposon of column 5.

TABLE 3

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| R2 | R2-1_TG | — | *Taeniopygia guttata* | GTCTAGTTACAACTGGGCATCGCTGCAGAGATCGCACCTCCTCGTGGTC | GTCTAGTT | TTCAGG | MASCPKPGPPVSAG |
| | | | | CCGCTGGTAGCCCTTCGAAGGGTGACTAAGTCGATCTCTGCCCCAGGTA | ACAACTGG | TTATTTA | AMSLESGLTTHSVLAI |
| | | | | CGGAGCCGTTGGGACTCACCAGTCCAACGTAACTCCTGCCTAAATTCGG | GCATCGCT | GATGCT | ERGPNSLANSGSDFG |
| | | | | TGAAACAAATTCCTCGGTAAAAGCCCCATGGCTTCTTGCCCGAAACCT | GCAGAGAT | TAGTTTT | GGGLGLPLRLLRVSV |
| | | | | GGCCCCCCGGTTTCAGCAGGGGCAATGAGTTTGGAAAGTGGACTGACC | CGCACCTC | TGTACCT | GTQTSRSDWVDLVS |
| | | | | ACCCACTCCGTTCTCGCCATCGAACGTGGTCCCAATTCGTTGGCAAATTC | CTCGTGGT | TTCTTGT | WSHPGPTSKSQQVD |
| | | | | CGGATCAGACTTTGGGGGGGGGGGTCTGGGGCTACCGTTACGCCTATT | CCCGCTGG | TTTGTTT | LVSLFPKHRVDLLSKN |
| | | | | GAGGGTATCGGTCGGCACTCAGACCTCCCGCTCCGACTGGGTAGACCTG | TAGCCCTT | AGGATT | DQVDLVAQFLPSKFP |
| | | | | GTGTCCTGGAGCCACCCAGGACCCACGTCTAAGTCCCAGCAGGTTGACC | CGAAGGG | TTGATA | PNLAENDLALLVNLE |
| | | | | TGGTGTCTTTATTTCCTAAACACCGGGTTGACCTGTTATCCAAAAACGAC | TGACTAAG | GTGTTA | FYRSDLHVYECVHFA |
| | | | | CAGGTAGACCTGGTGGCTCAATTTTTACCATCTAAATTTCCCCCAATTT | TCGATCTC | GTATTTT | AHWEGLSGLPEVYE |
| | | | | GGCAGAAAATGATTTGGCTTTGCTGGTGAACTTAGAGTTCTACAGATCG | TGCCCCAG | TATATTT | QLAPQPCVGETLHSS |
| | | | | GATTTGCATGTGTATGAGTGTGTTCATTTTGCTGCACATTGGGAGGGAT | GTACGGA | TTGTAC | LPRDSELFVPEEGSSE |
| | | | | TAAGTGGTTTGCCTGAGGTGTATGAACAACTTGCACCACAACCGTGTGT | GCCGTTGG | GATTGC | KESEDAPKTSPPTPG |
| | | | | GGGAGAAACTTTACATTCTAGCCTCCCACGAGACAGTGAACTGTTTGTG | GACTCACC | ATAATG | KHGLEQTGEEKVMV |
| | | | | CCTGAAGAGGGGAGCAGCGAGAAGGAGAGCGAGGACGCGCCAAAAAC | AGTCCAAC | TTCTTTT | TVPDKNPPCPCCGTR |
| | | | | ATCTCCTCCGACGCCTGGGAAACATGGTTTGGAACAGACTGGGGAGGA | GTAACTCC | TTATACA | VNSVLNLIEHLKVSH |
| | | | | AAAAGTGATGGTGACTGTTCCTGACAAAAATCCACCTTGTCCTTGCTGTG | TGCCTAAA | GTTCTGT | GKRGVCFRCAKCGKE |
| | | | | GTACCCGGGTAAACTCTGTGTTGAATCTGATTGAACATCTGAAAGTGTC | TTCGGTGA | TTTAATA | NSNYHSVVCHFPKCR |
| | | | | ACACGGGAAAAGGGGGGTTTGTTTTCGGTGTGCAAAATGTGGAAAGGA | AACAAATT | AAATAG | GPETEKAPAGEWICE |
| | | | | AAATAGTAACTATCACAGTGTTGTTTGTCATTTTCCAAAATGCAGGGGTC | CCTCGGTA | ACGATA | VCNRDFTTKIGLGQH |
| | | | | CAGAGACGGAGAAAGCCCCAGCTGGGGAGTGGATTTGTGAGGTATGC | AAAAGCCC | GCTAGA | KRLAHPAVRNQERIV |
| | | | | AACAGAGATTTTACAACCAAAATTGGCCTGGGACAACACAAGAGATTG | C (SEQ ID | GACGTT | ASQPKETSNRGAHKR |
| | | | | GCACACCCAGCAGTGAGAAATCAGGAAAGGATCGTTGCTTCCCAACCG | NO: 1140) | AGGGCA | CWTKEEEELLIRLEAQ |
| | | | | AAAGAAACATCAAATAGAGGTGCTCACAAAAGGTGCTGGACAAAGGAG | | GCCACA | FEGNKNINKLIAEHIT |
| | | | | GAGGAAGAATTACTAATAAGACTGGAGGCTCAGTTCGAGGGAAACAAA | | AGCCAG | TKTAKQISDKRRLLSR |
| | | | | AATATTAATAAGCTTATTGCAGAACACATAACCACCAAAACAGCTAAGC | | TTAGGT | KPAEEPREEPGTCHH |
| | | | | AGATCAGTGACAAAAGGCGATTGCTGTCCAGAAAGCCAGCAGAGGAGC | | AGCGGA | TRRAAASLRTEPEMS |
| | | | | CACGTGAGGAGCCTGGAACGTGTCATCACACCAGGAGAGCAGCTGCGA | | TAGTAG | HHAQAEDRDNGPG |
| | | | | GCCTGAGAACGGAGCCTGAGATGAGTCATCACGCCCAGGCAGAGGACA | | GTAGGA | RRPLPGRAAAGGRT |
| | | | | GAGATAATGGACCTGGGAGACGCCCTCTGCCAGGCAGGGCAGCTGCCG | | ACAGAC | MDEIRRHPDKGNGQ |
| | | | | GAGGGAGAACAATGGACGAGATAAGACGCCACCCTGATAAGGGCAAC | | TTTTACT | QRPTKQKSEEQLQAY |
| | | | | GGACAGCAGAGACCCACCAAGCAAAAATCAGAAGAACAGCTGCAGGCT | | ATTTCAT | YKKTLEERLSAGALNT |
| | | | | TACTATAAAAAGACACTAGAGGAACGACTTTCAGCTGGGGCACTTAACA | | AACGCG | FPRAFKQVMEGRDIK |
| | | | | CCTTCCCCCGAGCATTCAAGCAGGTAATGGAAGGCCGGGATATAAAGCT | | TCAATTA | LVINQTAQDCFGCLE |
| | | | | AGTAATCAATCAGACAGCGCAGGACTGCTTCGGATGCCTGGAATCCATA | | CCACCT | SISQIRTATRDKKDTV |
| | | | | AGCCAAATAAGAACGGCAACCCGAGATAAAAAGGACACGGTGACCCGG | | GATTTG | TREKHPKKPFQKWM |
| | | | | GAGAAACACCCAAAGAAACCTTTTCAGAAGTGGATGAAGGACAGAGCA | | GACCAA | KDRAIKKGNYLRFQR |
| | | | | ATCAAAAAAGGTAATTATCTTCGGTTCCAGCGTTTATTTTATCTTGATAG | | TTCACG | LFYLDRGKLAKIILDDI |
| | | | | AGGGAAACTGGCTAAAATCATTTTAGATGATATTGAATGCTTGTCTTGT | | GGATTT | ECLSCDIPLSEIYSVFK |
| | | | | GACATACCACTCAGTGAAATTTATTCGGTTTTTAAAACAAGATGGAAA | | GTCCAA | TRWETTGSFKSLGDF |
| | | | | CAACTGGTAGCTTTAAAAGCCTTGGGGACTTTAAAACTTACGGGAAGGC | | GGTGGA | KTYGKADNTAFRELIT |
| | | | | TGACAACACTGCCTTCAGAGAATTAATTACGGCTAAAGAAATTGAGAAA | | CGGGCC | AKEIEKNVQEMSKGS |
| | | | | AATGTGCAGGAAATGAGCAAAGGCTCGGCTCCCGGTCCAGACGGGATT | | ACCTTTA | APGPDGITLGDVVK |
| | | | | ACTCTTGGGGACGTCGTAAAGATGGATCCCGAGTTTTCCCGGACCATGG | | CTTAACC | MDPEFSRTMEIFNL |
| | | | | AGATTTTCAATTTATGGTTAACAACTGGTAAAATCCCGGACATGGTGAG | | CGGAAA | WLTTGKIPDMVRGC |
| | | | | GGGGTGCAGAACCGTTTTGATTCCAAAATCATCAAAGCCGGATCGTTTG | | AGGAAC | RTVLIPKSSKPDRLKDI |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AAAGACATTAATAACTGGAGACCTATCACGATCGGTTCCATCTTGCTGA | | ATATATA | NNWRPITIGSILLRLF |
| | | | | GACTGTTCTCCAGGATTGTAACAGCTAGGCTGAGCAAAGCGTGCCCCCT | | ATTTATG | SRIVTARLSKACPLNP |
| | | | | GAACCCAAGGCAAAGAGGCTTTATCAGAGCGGCGGGATGCTCTGAAAA | | TGTGTTC | RQRGFIRAAGCSENL |
| | | | | CTTAAAACTCCTGCAAACTATAATTTGGTCGGCCAAAAGAGAACACAGA | | GATAAA | KLLQTIIWSAKREHRP |
| | | | | CCACTGGGTGTTGTATTCGTGGACATCGCCAAGGCTTTTGACACCGTAA | | (SEQ ID | LGVVFVDIAKAFDTV |
| | | | | GCCACCAGCACATCATTCATGCTTTGCAGCAAAGAGAGGTGGATCCCCA | | NO: | SHQHIIHALQQREVD |
| | | | | CATCGTCGGTCTGGTGAGCAATATGTACGAGAACATCAGTACGTATATC | | 1263) | PHIVGLVSNMYENIS |
| | | | | ACCACAAAGAGGAACACACACACAGACAAAATCCAGATCCGGGTTGGA | | | TYITTKRNTHTDKIQI |
| | | | | GTAAAGCAGGGTGACCCGATGTCGCCCCTTTTATTTAACCTGGCAATGG | | | RVGVKQGDPMSPLL |
| | | | | ACCCTCTATTATGCAAGCTGGAAGAGAGTGGCAAAGGATACCACCGAG | | | FNLAMDPLLCKLEES |
| | | | | GACAGAGCAGCATCACAGCGATGGCATTTGCAGACGATCTGGTTTTGCT | | | GKGYHRGQSSITAM |
| | | | | GAGCGACTCCTGGGAAAATATGAATACAAATATTAGCATACTGGAGACC | | | AFADDLVLLSDSWEN |
| | | | | TTCTGCAATCTGACCGGTCTCAAAACACAGGGGCAAAAGTGCCACGGCT | | | MNTNISILETFCNLTG |
| | | | | TTTACATCAAGCCGACAAAGGACTCTTACACCATCAATGACTGCGCTGCC | | | LKTQGQKCHGFYIKP |
| | | | | TGGACTATCAACGGCACACCCCTGAACATGATCGACCCCGGCGAATCTG | | | TKDSYTINDCAAWTI |
| | | | | AGAAATACCTCGGCCTGCAGTTTGACCCGTGGATTGGAATAGCAAGGTC | | | NGTPLNMIDPGESEK |
| | | | | CGGTCTCTCCACAAAACTAGATTTTTGGCTTCAGCGGATCGATCAAGCAC | | | YLGLQFDPWIGIARS |
| | | | | CACTTAAACCTCTGCAGAAAACTGATATTCTCAAAACATACACCATCCCT | | | GLSTKLDFWLQRIDQ |
| | | | | CGGCTGATCTACATAGCTGACCACTCAGAAGTGAAAACTGCACTACTCG | | | APLKPLQKTDILKTYTI |
| | | | | AAACCCTTGACCAGAAGATCCGGACAGCGGTCAAGGAATGGCTTCACCT | | | PRLIYIADHSEVKTALL |
| | | | | ACCTCCGTGCACCTGCGATGCCATCCTGTACTCGAGCACGAGAGACGGC | | | ETLDQKIRTAVKEWL |
| | | | | GGTTTGGGCATCACCAAATTGGCAGGACTGATCCCCAGCGTGCAGGCCC | | | HLPPCTCDAILYSSTR |
| | | | | GTAGACTGCATCGGATCGCACAGTCATCTGACGATACGATGAAATGCTT | | | DGGLGITKLAGLIPSV |
| | | | | CATGGAAAAAGAGAAAATGGAACAGCTGCATAAGAAATTGTGGATTCA | | | QARRLHRIAQSSDDT |
| | | | | AGCTGGAGGGGACAGAGAGAACATACCCTCGATTTGGGAAGCACCACC | | | MKCFMEKEKMEQL |
| | | | | GTCGAGTGAACCACCAAACAACGTGAGCACAAATTCGGAATGGGAAGC | | | HKKLWIQAGGDRENI |
| | | | | ACCGACCCAGAAAGATAAATTTCCAAAGCCTTGCAATTGGAGGAAAAAC | | | PSIWEAPPSSEPPNN |
| | | | | GAATTCAAAAAATGGACCAAATTGGCATCCCAAGGCCGCGGAATTGTAA | | | VSTNSEWEAPTQKD |
| | | | | ATTTTGAAAGAGACAAAATTAGTAACCATTGGATCCAATACTACAGACG | | | KFPKPCNWRKNEFKK |
| | | | | CATACCTCACAGGAAACTCCTCACTGCACTACAACTCAGGGCCAACGTTT | | | WTKLASQGRGIVNFE |
| | | | | ACCCCACGAGAGAATTTCTAGCCAGGGGTAGACAAGACCAATACATCAA | | | RDKISNHWIQYYRRI |
| | | | | GGCGTGTAGGCACTGCGATGCGGACATTGAATCCTGCGCCCACATCATC | | | PHRKLLTALQLRANV |
| | | | | GGCAACTGCCCAGTGACACAGGACGCCCGAATCAAGAGGCACAATTAC | | | YPTREFLARGRQDQY |
| | | | | ATCTGCGAACTGCTTCTCGAGGAGGCGAAGAAGAAGGACTGGGTAGTG | | | IKACRHCDADIESCA |
| | | | | TTCAAGGAACCGCACATAAGGGATTCCAACAAGGAACTGTACAAACCTG | | | HIIGNCPVTQDARIKR |
| | | | | ACCTGATATTTGTGAAGGATGCCCGTGCACTTGTCGTGGATGTGACAGT | | | HNYICELLLEEAKKKD |
| | | | | ACGGTATGAAGCAGCCAAATCATCGCTGGAGGAAGCCGCTGCAGAGAA | | | WVVFKEPHIRDSNKE |
| | | | | AGTGAGAAAGTACAAACACCTGGAAACGGAAGTAAGACATCTCACGAA | | | LYKPDLIFVKDARALV |
| | | | | TGCAAAGGACGTTACTTTTGTGGGCTTTCCCCTAGGAGCGCGGGGGAA | | | VDVTVRYEAAKSSLE |
| | | | | ATGGCACCAAGATAACTTTAAACTTTTGACTGAGCTTGGCCTCTCCAAAT | | | EAAAEKVRKYKHLET |
| | | | | CGAGGCAAGTGAAAATGGCAGAGACTTTTTCCACAGTAGCGCTCTTTTC | | | EVRHLTNAKDVTFVG |
| | | | | ATCTGTGGACATTGTACATATGTTTGCCAGTAGGGCCAGAAAATCTATG | | | FPLGARGKWHQDNF |
| | | | | GTTATGTAATTCAGGTTATTTAGATGCTTAGTTTTTGTACCTTTCTTGTTT | | | KLLTELGLSKSRQVK |
| | | | | TGTTTAGGATTTTGATAGTGTTAGTATTTTTATATTTTTGTACGATTGCAT | | | MAETFSTVALFSSVDI |
| | | | | AATGTTCTTTTTTATACAGTTCTGTTTTAATAAAATAGACGATAGCTAGA | | | VHMFASRARKSMV |
| | | | | GACGTTAGGGCAGCCACAAGCCAGTTAGGTAGCGGATAGTAGGTAGGA | | | M (SEQ ID NO: |
| | | | | ACAGACTTTTACTATTTCATAACGCGTCAATTACCACCTGATTTGGACCA | | | 1016) |
| | | | | ATTCACGGGATTTGTCCAAGGTGGACGGGCCACCTTTACTTAACCCGGA | | | |
| | | | | AAAGGAACATATATAATTTATGTGTGTTCGATAAA (SEQ ID NO: 1539) | | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| R2 | R2-1_Gfo | — | *Geospiza fortis* | AGACTTAAGTGAGTTTGGTTACAACTGGGCATAGCTGCAGAGACCGCG | AGACTTAA | GGTAGA | VGLCPSPGVDGTHQ |
| | | | | CCTCCTCGCGGCCCCGCTGGTAAGCCCTTAACAGGGTGACTAAGTCGGT | GTGAGTTT | TAATCTT | PNDSFQNFGETNFSV |
| | | | | CTCTGCCCCAGTCCGGGAGTCGATGGGACTCACCAGCCCAACGATTCCT | GGTTACAA | TGTATA | QVARLVTRNLAPRSV |
| | | | | TCCAAAATTTCGGTGAAACAAATTTCTCGGTGCAAGTCGCAAGGCTTGT | CTGGGCAT | GTGGGG | RGNGFGSGMATHPV |
| | | | | CACCCGAAACCTAGCCCCCCGGTCGGTCAGGGGCAACGGGTTCGGAAG | AGCTGCAG | GGGGAT | PADESGHESDPFLVG |
| | | | | TGGGATGGCCACCCACCCCGTTCCCGCAGACGAATCCGGCCATGAATCT | AGACCGCG | CTCATGT | RSCGQPARLTRQSVG |
| | | | | GATCCATTCCTTGTAGGGAGGAGCTGCGGACAACCGGCACGCCTTACTA | CCTCCTCG | ACCGGG | TQTSRDDILPSKTTKL |
| | | | | GGCAATCGGTTGGCACCCAGACCTCCCGAGATGATATTTTACCATCTAA | CGGCCCCG | TTTCTTT | TENELDLLVNFSLELY |
| | | | | AACCACCAAATTGACAGAGAATGAATTGGACTTGCTGGTGAACTTTTCT | CTGGTAAG | TATTTGA | RSDLQGFVQEGIHFS |
| | | | | TTAGAATTGTATAGGTCAGATCTGCAGGGATTTGTGCAGGAGGGGATTC | CCCTTAAC | TTTTCAA | VNREVLEGFPEVYEQ |
| | | | | ATTTTTCTGTGAATAGGGAGGTGTTAGAGGGGTTTCCTGAGGTGTATGA | AGGGTGA | TAAAAC | PAPQPAVGDDLNTSL |
| | | | | ACAACCTGCACCACAACCGGCAGTAGGGGACGATTTAAACACCAGTCTC | CTAA (SEQ | AGACGG | PPDNNICVLEKGSSE |
| | | | | CCACCGGACAATAATATATGCGTACTTGAGAAGGGTAGCAGTGAAGCA | ID NO: | TAGCTA | AVEDGTPEVAHPVPE |
| | | | | GTGGAGGATGGCACACCGGAGGTAGCGCACCCCGTGCCTGAAACCCAG | 1141) | GGTTCG | TQGKESPNNIVMVTL |
| | | | | GGCAAAGAGTCACCGAATAACATCGTGATGGTAACTCTTCCCAACAAAA | | CAAGGC | PNKNPPCPCCRVRLH |
| | | | | ATCCACCATGTCCTTGCTGTAGGGTCAGACTGCATTCAGTACTGGCTCTG | | AGCCAC | SVLALIEHLKGSHGKK |
| | | | | ATTGAACATCTTAAGGGGTCGCATGGGAAGAAGAGGGCATGCTTTAGG | | AAGCCA | RACFRCVKCGRENFN |
| | | | | TGTGTCAAGTGTGGGAGGGAGAACTTTAACTATCATAGTACTGTTTGTC | | AAGATA | YHSTVCHIAKCKGPK |
| | | | | ACATCGCAAAATGCAAGGGACCAAAAGTTGAGAAGGCCCCAGTGGGAG | | GGTAGG | VEKAPVGEWICEVCG |
| | | | | AGTGGATCTGTGAGGTATGTGGTAGGGACTTTACAACCAAAATCGGCCT | | GTGCTC | RDFTTKIGLGQHKRL |
| | | | | GGGACAACATAAAAGATTGGCACATCCCTTGGTTAGAAACCAAGAAAG | | ATAGTG | AHPLVRNQERIDASQ |
| | | | | GATCGATGCTTCCCAACCGAAGGAGACATCAAACAGAGGAGCCCACAA | | AGTAGG | PKETSNRGAHKRCW |
| | | | | GAGATGTTGGACAAAAGAGGAGGAGGAGATGCTGATAAAGTTGGAGG | | GACAGT | TKEEEEMLIKLEVQFE |
| | | | | TACAGTTCGAGGGACACAGAAACATCAATAAGCTTATCGCGGAACACTT | | GCCTTTT | GHRNINKLIAEHLTTK |
| | | | | AACAACTAAAACATCCAAACAGATTAGTGATAAAAGGAGACTATTACCC | | GATTCA | TSKQISDKRRLLPRKQ |
| | | | | AGAAAACAATTAACAGATCTAAGTAAGGGAGTGGCTGGACAGAAGGTG | | CAACGC | LTDLSKGVAGQKVLD |
| | | | | CTGGACCCAGGACTGAGTCATCAACCCCAGCTGGGGGTAGTTGACAAT | | GTCAAT | PGLSHQPQLGVVDN |
| | | | | GGACTTGGTGGGGGTCATCTGCCAGGGGGGCCAGCTGCTGAAGGAAG | | ACCATCT | GLGGGHLPGGPAAE |
| | | | | AACAATAGAGCCATTAGGACACCACCTTGATAAGGATAACGGTCACCGG | | GACACG | GRTIEPLGHHLDKDN |
| | | | | GAAATCGCTGACCAGCACAAGGCAGGGAGGCTGCAGGCCCATTACCGA | | GATACC | GHREIADQHKAGRL |
| | | | | AAGAAGATAAGGAAGCGCCTTTCAGAAGGGATGATTAGCAACTTCCCC | | CTTACCG | QAHYRKKIRKRLSEG |
| | | | | GAAGTATTTGAACAACTACTGGACTGCCAGGAAGCACAACCATTGATCA | | GACTTG | MISNFPEVFEQLLDC |
| | | | | ATCAAGCAGCGCAGGATTGCTTTGGATGCCTGGATTCAGCAAGCCAGAT | | TCATGAT | QEAQPLINQAAQDC |
| | | | | AAGGAAGGCGCTCCGAAAACAGAACACACAGAAAGACCAGGGGGATC | | CTCCCA | FGCLDSASQIRKALRK |
| | | | | AACCCAAAAGACCAGCTCAGAAGTGGATGAAAAAAAGAGCAGTTAAGA | | GACTTG | QNTQKDQGDQPKR |
| | | | | GGGGTCACTTCCTCCGCTTTCAGAAATTATTTCATCTTGACAGGGGGAA | | TCCAAG | PAQKWMKKRAVKR |
| | | | | ATTGGCAAAGATTATTTTGGACGACGTAGAGTGTTTGTCCTGTGATATA | | GTGGAC | GHFLRFQKLFHLDRG |
| | | | | CCACCCAGTGAAATTTATTCGGTATTCAAAGCCCGATGGGAAACACCTG | | GGGCCA | KLAKIILDDVECLSCDI |
| | | | | GACAGTTTGCTGGCCTTGGGGATTTCGAAATTAATAGGAAGGCGAACA | | CCTTTAC | PPSEIYSVFKARWETP |
| | | | | ATAAAGCCTTCAGGGACTTAATTACGGCCAAAGAAATTCTCAAAAATGT | | TTAACCC | GQFAGLGDFEINRKA |
| | | | | GCGGGAGATGACCAAGGGCTCGGCCCCAGGTCCAGATGGGATCGCGCT | | GGAAAA | NNKAFRDLITAKEILK |
| | | | | TGGGGACATCAGGAAGATGGACCCTGAGTACACCCGGACCGCCGAACT | | GGAACA | NVREMTKGSAPGPD |
| | | | | CTTCAACTTATGGTTAACATCTGGTGAGATCCCGGACATGGTGAGGGGG | | TATATTA | GIALGDIRKMDPEYT |
| | | | | TGCAGAACTGTGTTAATCCCCAAATCGTCAAAACCGGAACGCCTGAAGG | | ATTATAT | RTAELFNLWLTSGEIP |
| | | | | ACATCAATAACTGGAGACCCATCACGATTGGATCCATCTTGCTGAGACTT | | GTGTTC | DMVRGCRTVLIPKSS |
| | | | | TTCTCCAGGATCATAACAGCGAGGTTAACAAAGGCGTGCCCCCTCAACC | | GGAAAA | KPERLKDINNWRPITI |
| | | | | CTAGGCAAAGAAGCTTCATCAGTGCGGCAGGATGCTCCGAGAACTTGA | | (SEQ ID | GSILLRLFSRIITARLTK |
| | | | | AGCTCCTGCAAACCATAATTCGGACTGCTAAAAATGAACACAGACCACT | | NO: | ACPLNPRQRSFISAA |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGGTGTTGTATTCGTGGACATCGCCAAGGCCTTTGACACCGTGAGCCAC<br>CAACACATCATACATGTATTGCAAAGGAGGAGAGTGGACCCCCACATCA<br>TTGGATTGGTGAAAAATATGTACAAAGACATCAGTACGGTTATCACCAC<br>AAAGAAGAACACATACACGGACAAAATCCAGATCCAGGTTGGAGTGAA<br>GCAAGGTGATCCGCTTTCGCCCCTTCTATTCAACCTGGCGATGGACCCCC<br>TGTTGTGCAAGCTGGAAGAACACGGCAAAGGATTCCACCGAGGACAGA<br>GCAAGATAACAGCGATGGCATTCGCTGATGACCTGGTCCTGTTGAGCGA<br>TTCCTGGGAAGACATGAATGCGAACATCAAGATACTGGAGACCTTCTGC<br>GACCTCACCGGTCTCAAAACACAGGGTCAAAAGTGCCACGGCTTCTACA<br>TCAAGCCTACAAAGGACTCTTACACCGTCAACAACTGCGCTGCGTGGAC<br>CATCAATGGCACACCCCTGAACATGATCAACCCCGGGGAATCAGAGAAA<br>TACCTCGGCCTGCAGTTTGACCCCTGGGTGGGAATTGCAAAGACCAGCC<br>TCCCCGAAAAACTGGACTTCTGGCTCGAACGCATTGATCGAGCTCCACT<br>CAAACCATTTCAGAAACTGGACATTCTTAAGACATACACCATACCTCGAC<br>TGACCTACGTAGCTGACCACTCAGAGATGAAAGCGGGGGCCCTTGAAG<br>CCCTTGACCGGACAATTCGATCGGCGGTCAAGGACTGGCTGCACCTACC<br>TTCGAGCACCTGTGATGCCATCTTGTACACGAGCATGAAGGACGGTGGT<br>TTGGGAGTGACCAAATTGGTGGGACTGATTCCGAGTGTACAAGCCCGG<br>AGGCTGCACAGGATTGCGCAGTCACCGGAGGAGACGATGAAAGACTTC<br>CTGGAAAAGGCCCAGATGGAGAAGATGTACGAGAAATTGTGGGTCCAA<br>GCTGGAGGGAAAAGAAAGAGGATGCCGTCAATTTGGGAAGCGCTCCC<br>GGAGGTTGTACCATCCATAGACACAGCCACAACTTCGGAGTGGGAAGC<br>ACCGAACCCTAAAAGTAAGTACCCTAGACCTTGTAATTGGCGCAGAAAA<br>GAATTTAAAAAGTGGACTAAATTAATAGCCCAGGGCTGGGGAATTAGG<br>TGTTTTAAGGGGGACAAAATTAGTAACAATTGGATTCGACATTATAGAT<br>ACATACCTCACAGGAAACTTCTCACTGCCATACAGCTCCGGGCCAGTGT<br>GTACCCCACAAGGGAATTTCTCGCGCGGGGGAGGGAAGATAACTGTGT<br>TAAGTCTTGTAGGCACTGTGAGGCGGCAGAGGAGTCCTGTGCCCACATC<br>ATCGGCATGTGTCCAGTCGTGAGGGATGCCCGAATCAAGAGGCACAAT<br>CGCATTTGCGAGAGGCTGATGGAGGAGGCGGGGAAGAGGGACTGGAC<br>GGTGTTTCAGGAGCCGCACATAAGGGACGTCACCAAGGAACTGTACAA<br>ACCGGACTTGATATTCGTGAAAGAAGGCCTTGCACTTGTTGTGGATGTT<br>ACAATACGGTTCGAGTCAACCAAGACAACGTTGGAGGAGGCTGCTGCA<br>GAGAAGGTGAACAAGTACAAACATCTGGAGACCGAAGTACGGAACCTC<br>ACCAACGCTAAGGACGTTATCTTTATGGGGTTTCCCCTTGGAGCGCGGG<br>GACAATGGTACAATAAGAACTTTGAACTTTTGGACACTCTTGGCCTCCCC<br>AGATCGAGGCAGGACATTATTGCAAAGACTTTATCCACGGACGCGCTCA<br>TTTCATCTGTGGACATTATACATATGTTTGCCAGTAGAGGCAGAAGACA<br>GCATGCTTAGGGTAGATAATCTTTGTATAGTGGGGGGGGATCTCATGTA<br>CCGGGTTTCTTTTATTTGATTTTCAATAAAACAGACGGTAGCTAGGTTCG<br>CAAGGCAGCCACAAGCCAAAGATAGGTAGGGTGCTCATAGTGAGTAGG<br>GACAGTGCCTTTTGATTCACAACGCGTCAATACCATCTGACACGGATACC<br>CTTACCGGACTTGTCATGATCTCCCAGACTTGTCCAAGGTGGACGGGCC<br>ACCTTTACTTAACCCGGAAAAGGAACATATATTAATTATATGTGTTCGGA<br>AAA (SEQ ID NO: 1540) | | 1264) | GCSENLKLLQTIIRTA<br>KNEHRPLGVVFVDIA<br>KAFDTVSHQHIIHVL<br>QRRRVDPHIIGLVKN<br>MYKDISTVITTKKNTY<br>TDKIQIQVGVKQGDP<br>LSPLLFNLAMDPLLCK<br>LEEHGKGFHRGQSKI<br>TAMAFADDLVLLSDS<br>WEDMNANIKILETFC<br>DLTGLKTQGQKCHG<br>FYIKPTKDSYTVNNCA<br>AWTINGTPLNMINP<br>GESEKYLGLQFDPWV<br>GIAKTSLPEKLDFWLE<br>RIDRAPLKPFQKLDIL<br>KTYTIPRLTYVADHSE<br>MKAGALEALDRTIRS<br>AVKDWLHLPSSTCDA<br>ILYTSMKDGGLGVTK<br>LVGLIPSVQARRLHRI<br>AQSPEETMKDFLEKA<br>QMEKMYEKLWVQA<br>GGKRKRMPSIWEAL<br>PEVVPSIDTATTSEW<br>EAPNPKSKYPRPCN<br>WRRKEFKKWTKLIA<br>QGWGIRCFKGDKISN<br>NWIRHYRYIPHRKLLT<br>AIQLRASVYPTREFLA<br>RGREDNCVKSCRHCE<br>AAEESCAHIIGMCPV<br>VRDARIKRHNRICERL<br>MEEAGKRDWTVFQE<br>PHIRDVTKELYKPDLI<br>FVKEGLALVVDVTIRF<br>ESTKTTLEEAAAEKVN<br>KYKHLETEVRNLTNA<br>KDVIFMGFPLGARG<br>QWYNKNFELLDTLGL<br>PRSRQDIIAKTLSTDA<br>LISSVDIIHMFASRGR<br>RQHA (SEQ ID NO:<br>1386) |
| R2 | R2-<br>1_ZA | — | *Zonotrichia albicollis* | CGACTTGAGAAGGTCTGGTTACAACTGGGCATAGCTGCAGAGATCGCG<br>CCTCCTCGTGGCCCCGCTGGTAAGCCCTTAACAGGGTGACTAAGTCGAT<br>CTCTGCCCCAGTCCAGGAGCCGCTGGGTTTCACCAGCCCAGCGATTCCTT | CGACTTGA<br>GAAGGTCT<br>GGTTACAA | GTAGTC<br>ACATTG<br>CACTTTC | NKFLGKSRVAYCLKP<br>GPPVSDRGKEFGSGL<br>TTHPEPESESGHDPT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCAAATTCGGTGAAACAAATTCCTCGGTAAAAGCCGCGTGGCTTATTGC | CTGGGCAT | TGTAACT | VPNPGPSLGAGEGA |
| | | | | CTGAAACCTGGCCCCCCGGTTTCAGACAGGGGCAAAGAGTTCGGAAGT | AGCTGCAG | TGCACT | QPLPLLRVSVGTQTC |
| | | | | GGACTGACCACCCACCCCGAACCCGAGAGCGAATCTGGTCATGACCCAA | AGATCGCG | GGGTGT | EEDFITSRPTKLPGIES |
| | | | | CTGTCCCAAATCCTGGTCCGTCTCTTGGAGCGGGGGAAGGTGCACAGCC | CCTCCTCG | GGGATG | ELGPLVKFSLEVYRSD |
| | | | | ACTACCCTTACTCAGGGTATCGGTGGGCACCCAAACCTGTGAAGAGGAC | TGGCCCCG | TGGGCC | LKGDVQFEGIHFPDN |
| | | | | TTTATAACATCTAGACCAACCAAATTACCCGGAATTGAATCAGAATTAGG | CTGGTAAG | TGGGGT | WGVLEGFPEVYEQL |
| | | | | CCCGCTGGTGAAGTTTTCTTTAGAGGTTTACAGGTCAGATCTTAAGGGG | CCCTTAAC | GTGGGT | APQPNGGDELNHSL |
| | | | | GATGTGCAATTTGAGGGGATTCATTTTCCAGATAATTGGGGGGTACTGG | AGGGTGA | TATGGG | PGDREGDVLEKDSSE |
| | | | | AGGGGTTTCCTGAGGTGTACGAACAACTGGCACCACAGCCAAACGGGG | CTAAGTCG | GTATAT | KEKEAAPEALPSVQR |
| | | | | GAGACGAGTTAAATCATAGTCTCCCAGGGGACAGGGAGGGGGATGTAC | ATCTCTGC | ATGTGG | ARSEQLPDNIVKVTV |
| | | | | TTGAGAAGGATAGCAGCGAAAAGGAGAAGGAGGCTGCACCAGAGGCA | CCCAGTCC | GATATTC | PDKNPPCPCCGVRLN |
| | | | | TTGCCCTCAGTGCAAAGGGCCCGCAGTGAACAGTTGCCAGATAACATCG | AGGAGCC | TGGTGG | SVLALIEHLKGSHGRR |
| | | | | TAAAGGTGACTGTTCCCGACAAAAATCCACCATGTCCCTGCTGTGGTGT | GCTGGGTT | GAATGT | RVCFRCAKCGRENFN |
| | | | | CCGCTTAAACTCAGTGTTAGCTCTGATTGAACATCTGAAGGGCTCACAC | TCACCAGC | CCATTCA | HHSTVCHYAKCKGP |
| | | | | GGGAGGAGGAGGGTGTGCTTTAGGTGTGCCAAATGTGGGAGGGAGAA | CCAGCGAT | CTGTAT | QIERPPVGEWICEVC |
| | | | | TTTTAACCACCATAGTACTGTTTGTCATTACGCAAAGTGCAAAGGTCCAC | TCCTTCCA | GCCTATC | GRDFTTKIGLGQHKR |
| | | | | AGATTGAAAGGCCACCAGTGGGAGAGTGGATCTGTGAGGTATGCGGA | AATTCGGT | TTTTTAA | HMHAMVRNQERID |
| | | | | AGGGACTTCACGACCAAAATTGGCCTGGGACAACACAAAAGACATATG | GA (SEQ | TAAAAA | ASQPKETSNRGAHKR |
| | | | | CATGCAATGGTGAGAAACCAGGAAAGGATCGATGCTTCCCAACCGAAA | ID NO: | GACGGT | CWTKEEEELLMKLEV |
| | | | | GAGACATCAAATCGAGGAGCCCACAAGAGGTGCTGGACGAAGGAGGA | 1142) | AGCTAG | QFENHKNINKLIAEQ |
| | | | | GGAAGAACTGCTCATGAAGTTGGAGGTACAGTTTGAGAATCACAAAAA | | GTTCGC | LTTKTAKQISDKRRM |
| | | | | CATCAATAAGCTTATCGCAGAGCAATTAACAACTAAAACAGCTAAACAA | | GAAGCA | LLKKGRGTTGNLETE |
| | | | | ATTAGTGATAAAAGGAGAATGCTGCTCAAAAAAGGTAGGGGGACAACT | | GCCACA | PGMSHQSQAKVKD |
| | | | | GGTAATTTGGAAACAGAGCCTGGGATGAGTCATCAATCGCAGGCAAAA | | AGCCAA | NGLGGDHLPGGPVV |
| | | | | GTTAAGGACAATGGACTGGGTGGGGACCATCTGCCGGGAGGACCAGTT | | TAGCCA | DKGTIGKPGQHLDTD |
| | | | | GTCGATAAGGGAACAATAGGGAAGCCAGGACAACATCTTGACACAGAT | | GTTAGG | NSHQITAGKKKGGGL |
| | | | | AACAGCCATCAAATAACTGCTGGCAAGAAGAAAGGGGGAGGGCTGCA | | TAGCTC | QARYRRRIMKRLAAG |
| | | | | GGCTCGTTATAGAAGGAGAATAATGAAACGATTAGCGGCCGGGACAAT | | ATAGTG | TINIFPKVFKELINDQE |
| | | | | TAACATCTTCCCCAAAGTGTTTAAAGAACTGATTAACGACCAAGAGGCG | | GGTAGG | ARPLINQTTEDCFGLL |
| | | | | AGACCGCTAATCAATCAAACAACAGAAGACTGCTTTGGCCTCTTGGACT | | TGACAG | DSACQIRTALREKGK |
| | | | | CTGCATGCCAAATTAGAACGGCACTCCGGGAGAAGGGCAAATCTCAGG | | GAACCT | SQEERPRKQYQKW |
| | | | | AGGAACGACCAAGAAAACAGTATCAGAAGTGGATGAAGAAGAGAGCG | | TTGACTC | MKKRAIKRGDYLRFQ |
| | | | | ATTAAAAGGGGGGACTATCTCCGCTTCCAGCGATTATTCCATCTAGACA | | AGAACG | RLFHLDRGKLARIILD |
| | | | | GGGGGAAACTGGCGAGAATTATCTTGGACAACACTGAGAGCTTGTCTT | | CGTCCAT | NTESLSCDISPSEIYSV |
| | | | | GCGATATATCACCCAGTGAAATTTATTCGGTATTCAAGGCCAGATGGGA | | TAACATC | FKARWETPGHFNGL |
| | | | | AACACCTGGACACTTCAACGGCCTTGGGGACTTTGAAATTAAAGGGAAG | | TAGAAC | GDFEIKGKANNKAFR |
| | | | | GCCAACAACAAAGCCTTCAGGGACTTCATCACGGCTAAAGAAATTGAAA | | GGACCA | DFITAKEIEKNVREMS |
| | | | | AGAACGTGCGGGAAATGAGTAAGGGTTCGGCGCCAGGTCCAGATGGG | | AACTTC | KGSAPGPDGIALGDI |
| | | | | ATCGCCCTTGGGGACATCAAGAAGATGGATCCCGGGTATTCCCGGACC | | GGACAT | KKMDPGYSRTAELFN |
| | | | | GCCGAGCTATTCAACTTGTGGCTGACAGCTGGTGACATCCCGGACATGG | | GCACCG | LWLTAGDIPDMVRG |
| | | | | TGAGGGGGTGCAGGACTGTTTTGATCCCGAAATCGACGACACCGGAGC | | ATTAACC | CRTVLIPKSTTPERLK |
| | | | | GCCTAAAGGACATCAACAACTGGAGACCCATCACGATTGGTTCCATCTT | | GGATTT | DINNWRPITIGSILLRL |
| | | | | GCTAAGGCTGTTCTCCAGGATCATAACGGCGAGGATGACTAAGGCGTG | | GTCCAA | FSRIITARMTKACPLN |
| | | | | CCCCCTCAACCCGAGACAGAGAGGCTTCATCAGTGCGCCGGGATGCTCT | | GGTGGA | PRQRGFISAPGCSEN |
| | | | | GAGAACCTGAAACTCCTGCAATCTATAATTCGGACTGCCAAAAATGAGC | | CGGGCC | LKLLQSIIRTAKNEHK |
| | | | | ACAAGCCGCTGGGTGTTATTTTCGTGGACATTGCTAAGGCTTTTGACACC | | ACCTTTA | PLGVIFVDIAKAFDTV |
| | | | | GTGAGCCACCAACACATCATACACGTTTTACAGCAACGGAGGGTTGACC | | CTTAACC | SHQHIIHVLQQRRVD |
| | | | | CCCACATTGTTGGACTGGTGAACAATATGTACAAGGACATCAGTACGTA | | CGGAAA | PHIVGLVNNMYKDIS |
| | | | | TGTCACCACAAAGAAGAACACACACACGGACAAAATCCAGATCCGGGTT | | GGGAAC | TYVTTKKNTHTDKIQI |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGAGTGAAGCAGGGTGACCCACTATCACCCCTTCTATTCAACTTGGCAA<br>TGGACCCCCTGTTGTGTAAGCTGGAAGAAAGTGGCAAAGGATTCCATC<br>GAGGACAGAGCTCAATAACCGCGATGGCGTTCGCCGACGATCTGGTCTT<br>GTTAAGCGACTCCTGGGAGAACATGAAAGAGAACATCAAAATACTGGA<br>GACCTTTTGCAATCTCACCGGTCTCAAAACACAGGGTCAGAAGTGCCAC<br>GGCTTTTACATCAAGCCTACAAAGGACTCTTACACCATCAACAACTGCCC<br>TGCATGGACCATCAACGGCACACCCCTGAACATGATCAACCCCGGGGAG<br>TCAGAGAAATACCTCGGCCTGCAGATCGACCCATGGACTGGAGTAGCA<br>AAATACGATCTCTCCACAAAATTGAAAATATGGCTCGAAAGCATTGACC<br>GAGCTCCACTTAAACCTCTGCAAAAATTAGACATCCTCAAAACATACACC<br>ATTCCTCGACTGACCTACCTGGCTGACCATTCAGAGATGAAAGCAGGGG<br>CTCTGGAAGCACTCGACCAGCAGATTCGAACAGCGGTCAAAGACTGGC<br>TGCACCTGCCCTCGTGCACCTGTGATGCCATCTTGTACGTGAGCACGAG<br>GGACGGCGGTTTGGGTGTTACCAAGTTGGCGGGACTGATTCCAAGTGT<br>GCAAGCCCGGAGGCTGCATCGCATTGCGCAGTCGCCGGACGAGACGAT<br>GAAGGACTTCCTAGAGAAGGCGCAGATGGAGAAGATGTATGAGAAGTT<br>ATGGGTTCAAGCTGGAGGCAAAAAGAAGGGGATGCCGTCAATTTGGGA<br>GGCCCTACCGATGACTGTACCACCCACTAATACAGGTAATCTTTCGGAG<br>TGGGAAGCACCGAACCCCAAAAGTAAGTACCCAAAACCTTGTGATTGGA<br>GAAGGAAAGAGCTTAAAAAGTGGACAAAATTGGAGTCCCAAGGTCGTG<br>GAGTCAAAAATTTTAGGAATGATACAATTAGTAACGATTGGATCCAATA<br>TTATAGACGCATACCTCACAGGAAACTCCTCACTGCCATACAACTCAGG<br>GCCAATGTATACCCCACAAGGGAATTTCTCGCGCGGGGGAGGGGTGAT<br>AACTATGTTAAGTTTTGTAGGCACTGTGAAGCGGACCTTGAAACCTGTG<br>GCCATATCATCGGCTTTTGCCCAGTAACGAAGGACGCCCGAATCAAGAG<br>GCACAATCGCATATGCGACAGGCTTTGCGAGGAGGCAGCTAAGAGGGA<br>ATGGGTGGTCTTCAAGGAGCCGCACTTGAGGGATGCCACCACGGAACT<br>GTTTAAACCGGATGTGATATTCGTGAAAGAGGACCGTGCACTGGTTGTG<br>GATGTGACAGTACGATATGAATCAGCCAAGACAACGCTGGAGGCAGCT<br>GCTATGGAGAAAGTGGACAAGTACAAACATCTGGAGGCAGAAGTGAA<br>GGAACTCACCAACGCAAAGGACGTTGTTTTTATGGGGTTCCCCCTTGGA<br>GCGCGAGGGAAATTCTACAAAGGGAACTTTAACTTGCTAGAGACTCTTG<br>GCCTCCCAAAAACGAGGCAATTGAGTGTGGCAAAGACTCTATCCACGTA<br>CGCGCTCATGTCATCTGTGGACATTGTGCATATGTTTGCCAGTAGATCTA<br>GGAAACCAAATGTCTAGGTAGTCACATTGCACTTTCTGTAACTTGCACTG<br>GGTGTGGGATGTGGGCCTGGGGTGTGGGTTATGGGGTATATATGTGG<br>GATATTCTGGTGGGAATGTCCATTCACTGTATGCCTATCTTTTTAATAAA<br>AAGACGGTAGCTAGGTTCGCGAAGCAGCCACAAGCCAATAGCCAGTTA<br>GGTAGCTCATAGTGGGTAGGTGACAGGAACCTTTGACTCAGAACGCGT<br>CCATTAACATCTAGAACGGACCAAACTTCGGACATGCACCGATTAACCG<br>GATTTGTCCAAGGTGGACGGGCCACCTTTACTTAACCCGGAAAGGGAAC<br>ATATATAGTTATATGTGTTCGTAATA (SEQ ID NO: 1541) | | ATATATA<br>GTTATAT<br>GTGTTC<br>GTAATA<br>(SEQ ID<br>NO:<br>1265) | RVGVKQGDPLSPLLF<br>NLAMDPLLCKLEESG<br>KGFHRGQSSITAMAF<br>ADDLVLLSDSWENM<br>KENIKILETFCNLTGLK<br>TQGQKCHGFYIKPTK<br>DSYTINNCPAWTING<br>TPLNMINPGESEKYL<br>GLQIDPWTGVAKYD<br>LSTKLKIWLESIDRAPL<br>KPLQKLDILKTYTIPRL<br>TYLADHSEMKAGALE<br>ALDQQIRTAVKDWL<br>HLPSCTCDAILYVSTR<br>DGGLGVTKLAGLIPS<br>VQARRLHRIAQSPDE<br>TMKDFLEKAQMEK<br>MYEKLWVQAGGKK<br>KGMPSIWEALPMTV<br>PPTNTGNLSEWEAP<br>NPKSKYPKPCDWRR<br>KELKKWTKLESQGRG<br>VKNFRNDTISNDWIQ<br>YYRRIPHRKLLTAIQL<br>RANVYPTREFLARGR<br>GDNYVKFCRHCEADL<br>ETCGHIIGFCPVTKDA<br>RIKRHNRICDRLCEEA<br>AKREWVVFKEPHLR<br>DATTELFKPDVIFVKE<br>DRALVVDVTVRYESA<br>KTTLEAAAMEKVDKY<br>KHLEAEVKELTNAKD<br>VVFMGFPLGARGKF<br>YKGNFNLLETLGLPKT<br>RQLSVAKTLSTYALM<br>SSVDIVHMFASRSRK<br>PNV (SEQ ID NO:<br>1387) |
| R2 | R2Dr | AB097126 | *Danio rerio* | AATCCCCCCTACCCAATCCCCCCGTCGTGACCTCCAGGCCAGGAATCACG<br>AGCGTACGACAGTGGCCATCCGGCAATGACAATAGCGTGACTAACGAC<br>AATGAGTCAGATCCATGACCCTTGGAGTGGGTTAACCTCCGCCTCTTTAA<br>AAACATGGAAAGTACAGCAAAAGGAAAGTCATACTGGATGGCCCGTCG<br>CCCAGTAGAAGGTGCCACGGAGGGATCTTTGGGTCGGGTCCCTTTCGTA<br>ACGCGAGATCCTAAGCGCAAACCAGAGGCTAAACGAACACTTACGCAT | AATCCCCC<br>CTACCCAA<br>TCCCCCCG<br>TCGTGACC<br>TCCAGGCC<br>AGGAATCA | AAATCC<br>CAGCGG<br>GATACA<br>GCAAGA<br>AGGTAT<br>CGGATC | MESTAKGKSYWMA<br>RRPVEGATEGSLGRV<br>PFVTRDPKRKPEAKR<br>TLTHGLGLRECSVVLT<br>RLIEGRRGRDHTPSG<br>WNAQRGMPNDESS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCTTAGGACTACGAGAATGCTCGGTTGTCTTGACACGCCTCATCGAGG | CGAGCGTA | TAATAA | VEEPNGPIPSNPIPTG |
| | | | | GGCGTCGAGGTCGCGATCACACACCATCAGGATGGAACGCACAGCGCG | CGACAGTG | GGTTGA | TQALPEPMADGEQG |
| | | | | GCATGCCAAACGACGAAAGCTCGGTCGAGGAGCCCAATGGGCCGATAC | GCCATCCG | GCGAGG | EHPGVVVTLPLRDLN |
| | | | | CATCTAACCCCATACCAACGGGCACCCAAGCCCTGCCTGAACCTATGGC | GCAATGAC | AGAGGG | CPLCGGSASTAVKVQ |
| | | | | GGACGGGGAGCAGGGGGAGCACCCGGGAGTGGTGGTGACCCTGCCGC | AATAGCGT | TGGAGA | RHLAFRHGTVPVRFS |
| | | | | TCAGGGACTTAAACTGCCCCCTATGTGGCGGGTCGGCGAGCACCGCGG | GACTAACG | TCCTTTG | CESCGKTSPGCHSVL |
| | | | | TGAAAGTGCAAAGACACTTGGCATTTCGCCACGGAACAGTGCCGGTTA | ACAATGAG | GGGGGG | CHIPKCRGPTGEPPE |
| | | | | GATTCAGCTGTGAATCATGTGGAAAAACTTCTCCGGGTTGCCATTCCGTC | TCAGATCC | GTCGGG | KVVKCEGCSRTFGTR |
| | | | | CTCTGTCACATTCCGAAATGTCGCGGACCGACAGGCGAGCCGCCTGAGA | ATGACCCT | CTAAGTT | RACSIHEMHVHSEIR |
| | | | | AAGTGGTTAAGTGCGAGGGATGCAGTAGGACGTTTGGCACAAGGAGA | TGGAGTG | CCCCTCT | NRKRIAQDRQEKGTS |
| | | | | GCGTGTAGTATACATGAGATGCACGTTCACTCAGAAATCCGCAATAGGA | GGTTAACC | CGGGTC | TDGEGRAGVERADA |
| | | | | AAAGAATTGCTCAAGACAGGCAAGAAAAAGGGACCTCGACAGATGGA | TCCGCCTC | CTCCCAC | GEGPSGEGIPPKRPR |
| | | | | GAGGGGAGAGCTGGAGTCGAAAGGGCTGACGCTGGGGAAGGTCCCTC | TTTAAAAA | GGTGAC | RARTPREPSEPPANP |
| | | | | TGGGGAAGGGATCCCCCCTAAACGTCCCAGACGTGCGAGAACGCCCAG | C (SEQ ID | GCTCTAC | PILSPQPDLPPGGLRD |
| | | | | AGAACCGTCTGAGCCCCCCGCGAATCCGCCGATTCTCTCGCCACAACCC | NO: 1143) | CCCTCCC | LLREVASGWVRAAR |
| | | | | GATCTGCCCCCAGGAGGCCTCCGGGACCTACTCCGGGAGGTGGCCAGT | | TCCTCGC | DGGTVIDSVLAAWL |
| | | | | GGGTGGGTAAGGGCAGCGAGAGACGGAGGTACGGTGATTGACAGCGT | | TCGTAG | DGNDRLPELVDAAT |
| | | | | GCTCGCAGCATGGTTGGATGGCAACGATCGGCTCCCTGAGCTGGTTGAC | | AACCCA | QRTLQGLPAGRLARR |
| | | | | GCGGCGACGCAAAGGACACTGCAGGGCTTACCTGCAGGGAGGTTGGCC | | ACGGTG | PATFVAPNRRRGRW |
| | | | | CGAAGACCCGCAACTTTTGTTGCGCCTAACCGGAGGAGAGGCAGGTGG | | AACACG | GRRLKLLAKRRAYHD |
| | | | | GGGCGCCGGCTCAAACTGCTCGCTAAGCGCCGCGCCTACCACGATTGCC | | GTTGGC | CQIRFRKDPARLAANI |
| | | | | AAATTCGGTTCCGAAAAGACCCAGCCCGCCTAGCCGCGAACATCCTAGA | | AGGATG | LDGKSETSCPINEQAI |
| | | | | CGGCAAAAGCGAAACAAGTTGCCCAATCAATGAGCAAGCGATTCATGA | | AAGTGA | HEHFRNKWANPSPF |
| | | | | GCACTTTCGAAACAAATGGGCAAATCCAAGTCCATTTGGTGGGCTGGGA | | CGTGAG | GGLGRFGTENRANN |
| | | | | CGATTTGGGACGGAAAACAGGGCCAACAACGCCCACCTCCTCGGGCCA | | GGGTAA | AHLLGPISKSEVQTSL |
| | | | | ATCTCCAAAAGCGAGGTCCAAACTAGCCTCCGAAATGCATCGAACGCCT | | GACATG | RNASNASTPGPDGV |
| | | | | CCACACCAGGCCCAGACGGCGTTGGGAAAAGGGACATTTCCAACTGGG | | CGTACG | GKRDISNWDPECETL |
| | | | | ATCCTGAGTGTGAGACCCTCACTCAGCTGTTTAACATGTGGTGGTTCACA | | TGAGCG | TQLFNMWWFTGVIP |
| | | | | GGTGTCATCCCCTCTCGCTTGAAGAAAAGTCGTACGGTGCTTCTGCCCA | | CGCATTT | SRLKKSRTVLLPKSSD |
| | | | | AGTCCTCAGACCCAGGAGCGGAGATGGAGATCGGCAACTGGAGACCAA | | TTGCTGT | PGAEMEIGNWRPITI |
| | | | | TCACCATCGGGTCGATGGTCTTGCGGCTTTTCACAAGGGTGATCAATAC | | TCTCTG | GSMVLRLFTRVINTR |
| | | | | GAGATTAACGGAAGCCTGTCCGTTGCACCCAAGACAGAGAGGGTTTCG | | GACTGG | LTEACPLHPRQRGFR |
| | | | | ACGAAGCCCCGGGTGTTCGGAGAACCTGGAAGTACTCGAATGTCTCCTC | | GTTTCGT | RSPGCSENLEVLECLL |
| | | | | CGACACTCCAAAGAAAAGCGCAGCCAACTGGCAGTGGTATTCGTCGATT | | CCCCCTC | RHSKEKRSQLAVVFV |
| | | | | TTGCACAAGCGTTTGACACCGTCTCTCATGAACACATGCTGTCAGTCCTT | | ACAACC | DFAQAFDTVSHEHM |
| | | | | GAGCAGATGAACGTGGATCCCCACATGGTAAATCTGATCCGGGAGATTT | | ATCACTT | LSVLEQMNVDPHMV |
| | | | | ACACAAACAGCTGCACAAGTGTCGAGCTAGGCCGGAAAGAGGGACCAG | | ACACTAT | NLIREIYTNSCTSVELG |
| | | | | ACATCCCAGTGAGGGTTGGTGTTAAGCAAGGGGATCCTCTGTCCCCGCT | | AGGGGC | RKEGPDIPVRVGVKQ |
| | | | | GCTTTTCAACCTGGCTTTGGATCCTCTCATCCAAAGTCTCGAACGCACAG | | ACAGCG | GDPLSPLLFNLALDPL |
| | | | | GCAAAGGGTGTGAGGCCGAAGGTCACAAAGTGACAGCTTTAGCGTTCG | | GCTCCTA | IQSLERTGKGCEAEG |
| | | | | CGGATGACCTGGCACTGGTTGCGGGCTCGTGGGAGGGAATGGCACACA | | CCTCCCT | HKVTALAFADDLALV |
| | | | | ACCTTGCGCTTGTAGACGAATTCTGCCTAACCACCGGCCTCACAGTCCAA | | CCCTATG | AGSWEGMAHNLAL |
| | | | | CCCAAAAAGTGCCACAGTTTCATGGTCAGGCCCTGCAGAGGTGCCTTCA | | ACCCCCC | VDEFCLTTGLTVQPK |
| | | | | CAGTGAACGACTGCCCCCCATGGGTTCTGGGGGGCAAGGCCCTGCAGC | | CTTCCCA | KCHSFMVRPCRGAF |
| | | | | TAACAAACATCGAAAACTCCATCAAATATCTGGGAGTAAAAGTCAATCC | | TACCGA | TVNDCPPWVLGGKA |
| | | | | TTGGGCGGGGATTGAAAAGCCTGACCTTACAGTGGCACTAGACCGATG | | TCCATG | LQLTNIENSIKYLGVK |
| | | | | GTGCAAGCGCATTGGGAAGTCACTGCTCAAACCCTCACAGAAGGTATAC | | GCTGTT | VNPWAGIEKPDLTVA |
| | | | | ATTCTCAATCAGTTTGCCATCCCGCGACTCTTCTACCTGGCTGATCACGG | | CTAGTCT | LDRWCKRIGKSLLKPS |
| | | | | TGGGGCCGGCGACGTCATGCTCCAGAACCTGGATGGGACAATCAGGAA | | GGACCG | QKVYILNQFAIPRLFY |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCGGTGAAGAAATGGCTGCATCTTCCACCGTCAACCTGCAACGGGCT | | AGGGTC | LADHGGAGDVMLQ |
| | | | | GTTGTATGCCAGGAACTGTAATGGTGGCCTCGGTATATGCAAGCTCACT | | GGACGG | NLDGTIRKAVKKWLH |
| | | | | CGGCACATCCCATCAATGCAGGCGAGACGAATGTTCCGCTTGGCCAACT | | GGCATT | LPPSTCNGLLYARNC |
| | | | | CATCGGACCCGTTGATGAAGGCCATGATGCGCGGCTCCCGAGTCGAAC | | TGAAGG | NGGLGICKLTRHIPS |
| | | | | AGAAATTCAAAAAGGCCTGGATGCGGGCCGGGGGAGAGGAGAGTGCG | | TAGCTG | MQARRMFRLANSSD |
| | | | | CTCCCACGGGTGTTCGGGGCGAATCAGTACCAGGAAGGGGAGGAGGT | | GAATCC | PLMKAMMRGSRVE |
| | | | | CGCTAACGATCTGGTACCTCGCTGCCCAATGCCGAGCGATTGGAGACTG | | TCCGCT | QKFKKAWMRAGGE |
| | | | | GAAGAATTCCAACACTGGATGGGCCTGCCGATCCAGGGTGTGGGTATA | | GCTGCG | ESALPRVFGANQYQE |
| | | | | GCCGGCTTCTTCAGAAACAGGGTGGCTAACGGATGGCTCAGGAAGCCG | | AGCCTG | GEEVANDLVPRCPM |
| | | | | GCAGGGTTCAAAGAGCGGCACTACATCGCCGCTCTACAACTGCGAGCAT | | AGGTCG | PSDWRLEEFQHWM |
| | | | | GTGTATACCCCACCCTCGAATTCCAGCAAAGGGGCAGGAGCAAAGCGG | | ATGGTT | GLPIQGVGIAGFFRN |
| | | | | GTGCGGCCTGCAGGCGGTGCTCATCCCGGTTGGAATCCAGCTCTCACAT | | AGAGGT | RVANGWLRKPAGFK |
| | | | | CCTCGGCAAATGTCCGGCGGTGCAGGGAGCCAGAATCAGGCGTCATAA | | GAAATA | ERHYIAALQLRACVYP |
| | | | | CAAAATATGCGACCTCCTGAAGGCCGAAGCCGAAACCCGGGGTTGGGA | | CTTGGG | TLEFQQRGRSKAGAA |
| | | | | GGTACGCCGGGAATGGGCCTTCAGAACTCCGGCTGGGGAACTGAGAAG | | AGGAGA | CRRCSSRLESSSHILG |
| | | | | GCTCGACCTGGTACTCATCCTCGGGGATGAGGCATTGGTCATTGACGTC | | CACAGC | KCPAVQGARIRRHNK |
| | | | | ACAGTAAGGTACGAGTTCGCTCCGGATACCCTCCAGAATGCCGGAAAG | | CTCCGG | ICDLLKAEAETRGWE |
| | | | | GACAAGGTCAGCTACTACGGCCCGCACAAAGAAGCGATCGCTCGGGAG | | AGAGCC | VRREWAFRTPAGELR |
| | | | | CTGGGCGTAAGAAGGGTCGACATACATGGGTTTCCGTTGGGTGCACGC | | CCTCCCG | RLDLVLILGDEALVID |
| | | | | GGACTTTGGCTCGCCAGCAACTCCAAAGTGCTGGAACTGATGGGATTGA | | GGTGGT | VTVRYEFAPDTLQNA |
| | | | | GCAGGGAAAGAGTGAAGGTCTTCTCCAGACTCTTGAGTCGGAGAGTGC | | CATCAT | GKDKVSYYGPHKEAI |
| | | | | TCCTGTACTCTATCGACATCATGAGGACATTTTACGCAACCCTGCAATGA | | GGCAAC | ARELGVRRVDIHGFP |
| | | | | AAATCCCAGCGGGATACAGCAAGAAGGTATCGGATCTAATAAGGTTGA | | CGGGTG | LGARGLWLASNSKVL |
| | | | | GCGAGGAGAGGGTGGAGATCCTTTGGGGGGGGTCGGGCTAAGTTCCC | | AAACCTT | ELMGLSRERVKVFSR |
| | | | | CTCTCGGGTCCTCCCACGGTGACGCTCTACCCCTCCCTCCTCGCTCGTAG | | ACGGTT | LLSRRVLLYSIDIMRTF |
| | | | | AACCCAACGGTGAACACGGTTGGCAGGATGAAGTGACGTGAGGGGTA | | TCACTTA | YATLQ (SEQ ID NO: |
| | | | | AGACATGCGTACGTGAGCGCGCATTTTTGCTGTTCTCTGGACTGGGTTTC | | CGAAAC | 1388) |
| | | | | GTCCCCCTCACAACCATCACTTACACTATAGGGGCACAGCGGCTCCTACC | | AGCACC | |
| | | | | TCCCTCCCTATGACCCCCCCTTCCCATACCGATCCATGGCTGTTCTAGTCT | | ATAACA | |
| | | | | GGACCGAGGGTCGGACGGGGCATTTGAAGGTAGCTGGAATCCTCCGCT | | GCGCCG | |
| | | | | GCTGCGAGCCTGAGGTCGATGGTTAGAGGTGAAATACTTGGGAGGAGA | | TAATAG | |
| | | | | CACAGCCTCCGGAGAGCCCCTCCCGGGTGGTCATCATGGCAACCGGGT | | CGCACC | |
| | | | | GAAACCTTACGGTTTCACTTACGAAACAGCACCATAACAGCGCCGTAAT | | GGTGTG | |
| | | | | AGCGCACCGGTGTGACTACTGTCCAGTGCTGATATTCTCATCTGGAGAA | | ACTACT | |
| | | | | TACAACACGGGTAATGGCAGAGTATTCAAAACCCAAATGTTTACGATCG | | GTCCAG | |
| | | | | ACCAACGGAGTCGTTCCCTTGCATCTAGGCCGGACCCGAAACTGCCGTA | | TGCTGA | |
| | | | | ATTGCCCGTCCCCAAGGTAGCCTCTTAGAAAACCGAAGCCCGGTCGGGG | | TATTCTC | |
| | | | | CGGTGGTTGCGGCGGCGCTGCGGGGGCCTGCTGCTCGGGCGGCGTCG | | ATCTGG | |
| | | | | GTGTGCCGCGGTGGTTGCGGTGGTGCGGCGGGGATCTCGGTCCTTGCG | | AGAATA | |
| | | | | GTGCCGCTGTGCCGCCGCGGTCGCGTCGGTGGCGCTGGGGTGGTGGCC | | CAACAC | |
| | | | | CGAGTGGCGTCGGCGTGCCACTGCCCATAGTCGCCCGCGGGGGCGACC | | GGGTAA | |
| | | | | GATCTGGAGGGGCGAGGGGGCTCGCGGGACTTTAACGAGAAACGGAA | | TGGCAG | |
| | | | | CGCAACTTCTCGCATCGCTCCCGGGACTTTCCCCCCTCGTTCAGCCGAGG | | AGTATTC | |
| | | | | GATGCCAAAAGGCATGAAAGGTAAGTACCATACCGGTCCGCAAAACTCT | | AAAACC | |
| | | | | CTTCTGACTCGGTTCTCTGTTGGTTTTCTAGAGTAACAACGAGGTGGAG | | CAAATG | |
| | | | | GAGAGGGACATGGCAGGGACTCCCATTCGTGCCAGCGGGTGGGGACA | | TTTACGA | |
| | | | | GATCGAAGGAACGGTTCGAGGGCGTAACAGACGAGAGGGAATCCGGT | | TCGACC | |
| | | | | CACACATTGATGCCATGCCTAAATAGGCGAGGTTTGTATTTCTACTTTGT | | AACGGA | |
| | | | | GGGTTCAGTATAGTCGGAGCATATGGTCGGTTGTCCCGTTGTTTTCACG | | GTCGTT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCGGGCAAGCGACTATCATGATAAAGTAGAATGGGAGACGGGCTCCCTGACAAACCCGGAAAGGCGCCCCCCCGTGGTTCGTAGCAGCTGACGGATCACGCTCGAAGAAAAATGAGTGAGAGGGGACGCCGCAACCAC (SEQ ID NO: 1542) | | CCCTTGCATCTAGGCCGGACCCGAAACTGCCGTAATTGCCCGTCCCCAAGGTAGCCTCTTAGAAAACCGAAGCCCGGTCGGGGCGGTGGTTGCGGCGGCGCTGCGGGGGCCTGCTGCTCGGGCGGCGTCGGTGTGCCGCGGTGGTTGCGGTGGTGCGGCGGGGATCTCGGTCCTTGCGGTGCCGCTGTGCCGCCGCGGTCGCGTCGGTGGCGCTGGGGTGGTGGCCCGAGTGGCGTCGGCGTGCCACTGCCCATAGTCGCCCGCGGGGGCGACCGATCTGGAGGGGCGAGGGGGCTC | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GCGGGA<br>CTTTAAC<br>GAGAAA<br>CGGAAC<br>GCAACT<br>TCTCGCA<br>TCGCTCC<br>CGGGAC<br>TTTCCCC<br>CCTCGTT<br>CAGCCG<br>AGGGAT<br>GCCAAA<br>AGGCAT<br>GAAAGG<br>TAAGTA<br>CCATACC<br>GGTCCG<br>CAAAAC<br>TCTCTTC<br>TGACTC<br>GGTTCT<br>CTGTTG<br>GTTTTCT<br>AGAGTA<br>ACAACG<br>AGGTGG<br>AGGAGA<br>GGGACA<br>TGGCAG<br>GGACTC<br>CCATTCG<br>TGCCAG<br>CGGGTG<br>GGGACA<br>GATCGA<br>AGGAAC<br>GGTTCG<br>AGGGCG<br>TAACAG<br>ACGAGA<br>GGGAAT<br>CCGGTC<br>ACACATT<br>GATGCC<br>ATGCCT<br>AAATAG<br>GCGAGG<br>TTTGTAT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | TTCTACT TTGTGG GTTCAG TATAGTC GGAGCA TATGGT CGGTTG TCCCGTT GTTTTCA CGGCGG GCAAGC GACTAT CATGAT AAAGTA GAATGG GAGACG GGCTCC CTGACA AACCCG GAAAGG CGCCCC CCCGTG GTTCGT AGCAGC TGACGG ATCACG CTCGAA GAAAAA TGAGTG AGAGGG GACGCC GCAACC AC (SEQ ID NO: 1266) | |
| R2 | R2-1_GA | — | *Gasterosteus aculeatus* | CATATTGGGGTCTCAGGAGGAGACACAGGGTCTGTTGCGGCTCCGGTA AACGGTACCGGAGTCGGTTAAGCATCGTTTGGGCCCGCCTCCACGTGGT GGTCCGCGGTAACACCAATAGGGTGGCTAAGAGGCCCAGTAATTTCCCC GAATTGTCTTCCCCCCCGCGCGGGGGGGACCCCCCTTTAGTGTCGGAGC GGTCGCGCCTCCGCGTTTGGGGTGTCGCAGGCGTGAGCCTTCGTCCCCT TAAGTTCAGACGGTCCCGGCTTCTTGCCGGGCCAACCCCCGGTGCAGCG TTCTCCCATGTTGGATCGGCACCCAGCCCCGGGTGCCATGCGAGTTCAG ACATTTTGTTTATGTATCGTCTGCGTGGTTGACTTGCTAAGCTCATTTCCT CCTCTCACTGCGTCCCCCCAGGTGCTGATCGGTTGAAGAGGATTCGTCG TTGACCTCGGCGGTGAATTTGGGATTGTATTATACAGGTAGGTATAGAG GGCGTGCGGATGTTGCGTGGCGGTGTTGGTACTCCCCCGGCTGGGGGA GCGGGTGCGGTGGGGCCAGGCATGGCCTCGCCGGGTGGTTGCAGTGTC CGGTTCAGTCCCGGAGGGAGGCGACTGCTTGGCCACAGGACTGGAGG | CATATTGG GGTCTCAG GAGGAGA CACAGGGT CTGTTGCG GCTCCGGT AAACGGTA CCGGAGTC GGTTAAGC ATCGTTTG GGCCCGCC TCCACGTG GTGGTCCG | GGAGGG GAGTAG GTCTCTA CTCTGAC CCGAAG GGCCCC CCCGTTT CAGACC TGATTCT AGGCTA CCTGTG CCTAATT GGGGGG | MLRGGVGTPPAGGA GAVGPGMASPGGCS VRFSPGGRRLLGHRT GGLSPSVSWRLKRLS VSLRRWSGPGLLGA DGAGGGAAVASPRG TQVLGSGAGRRWLG HGSRGSSPSAARGLR RLTVRLKRLSGGLLSP KACRDAEEGSSSSPG FRNPKGLGGRGLTPL GSRRFCRLTVSLNRW RGSLVKLNASSRASG |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTTGAGTCCCTCCGTGTCCTGGAGGCTCAAGCGACTGTCTGTCTCTCTGA | CGGTAACA | GTCCCA | RRTPVKPACDSRAGR |
| | | | | GGCGCTGGAGCGGGCCTGGGCTGCTAGGTGCGGATGGTGCGGGGGGA | CCAATAGG | AAGAGA | GSEHAEGGGVSAAP |
| | | | | GGCGCTGCGGTGGCCTCCCCCAGGGGTACGCAGGTCCTGGGAAGTGGG | GTGGCTAA | TGTTGTC | MVLRSRRKLTFSVDG |
| | | | | GCCGGGCGTCGGTGGCTTGGGCACGGGTCGCGAGGGTCTTCTCCTTCT | GAGGCCCA | TGTTGTA | DSNSGDRARSGSVSA |
| | | | | GCGGCCCGGGGGCTAAGGCGGCTGACGGTACGGTTGAAGCGACTCAG | GTAATTTC | GAAGGG | ARPGHLLVDGESASS |
| | | | | CGGTGGCCTGTTGTCCCCTAAGGCGTGTCGGGATGCGGAAGAAGGAAG | CCCGAATT | TTTGCG | RSGPAGDARLAGPST |
| | | | | CTCCAGCAGCCCAGGGTTCCGGAATCCAAAAGGTCTCGGGGGAAGGGG | GTCTTCCC | CCACTG | RSRRKGCLPPVDFEN |
| | | | | GTTGACGCCTCTCGGATCCCGTAGATTTTGTCGGCTGACCGTCTCCCTGA | CCCCGCGC | ACTGCA | PKKRTRLMAKMTNG |
| | | | | ATCGCTGGAGGGGCAGTCTGGTGAAGTTGAACGCTAGTAGCAGGGCCT | GGGGGGG | CGGAAG | NPTSHVPCPAPCSNG |
| | | | | CCGGCCGGAGGACCCCTGTGAAACCCGCTTGTGACTCTAGAGCCGGAC | ACCCCCCT | GGTGGG | HEGGGRVAVIEGRLP |
| | | | | GGGGCTCGGAGCATGCGGAGGGAGGTGGAGTGAGCGCTGCACCTATG | TTAGTGTC | CCTCGA | ELSGSRISGIQPALPV |
| | | | | GTGTTGCGCAGTCGGCGTAAGCTCACCTTCTCTGTGGATGGCGACTCTA | GGAGCGG | CAGGTA | ETSFVGQSTGRGAD |
| | | | | ACTCCGGGGATAGGGCCCGGAGCGGGTCCGTCTCTGCAGCCCGTCCTG | TCGCGCCT | GGGGTT | GDANANSSPPSPNL |
| | | | | GCCACTTGTTGGTGGATGGTGAGAGTGCGTCCTCAAGATCTGGCCCCGC | CCGCGTTT | ACATGA | GGSVGMVPAVRDGT |
| | | | | GGGGGATGCCAGGTTGGCGGGGCCTTCTACGCGGAGTAGGAGGAAGG | GGGGTGT | CTCCGT | PPLGRPGEDHSRECA |
| | | | | GTTGCCTTCCCCCGGTCGACTTTGAAAACCCGAAGAAGCGCACACGGTT | CGCAGGC | GCTGCT | GGNTPLWMLEDSFR |
| | | | | GATGGCTAAGATGACGAATGGTAATCCTACCTCGCACGTCCCTTGCCCT | GTGAGCCT | CAGCAG | CDYCPREFGTRAGRS |
| | | | | GCCCCGTGCTCAAATGGGCATGAAGGAGGTGGGCGAGTTGCGGTGATC | TCGTCCCC | ACCCGC | LHMRRAHLAEYDGA |
| | | | | GAGGGGCGGCTGCCGGAGTTAAGCGGTAGTAGGATCTCTGGAATACAG | TTAAGTTC | GCCTCT | GFCWGERLSEFAATR |
| | | | | CCAGCCCTGCCTGTTGAAACCAGCTTTGTCGGCCAATCGACTGGCCGGG | AGACGGTC | GAGACC | LWSTEETKKLAVFCE |
| | | | | GCGCGGACGGCGATGCGAATGCGAATAGTAGCCCGCCTTCTCTCCTAATCT | CCGGCTTC | GGGTAG | RGVPSPSECRAIAASL |
| | | | | GGGCGGCTCGGTTGGGATGGTGCCTGCCGTGCGTGATGGTACCCCGCC | TTGCCGGG | GGCTAC | GAGKTHHQVRSKCR |
| | | | | GCTTGGGCGTCCAGGAGAGGATCACTCGCGGGAGTGTGCAGGGGGAA | CCAACCCC | TTGAAC | LVFEAIRRRELLEVAA |
| | | | | ATACTCCCCTCTGGATGCTGGAGGACAGTTTCCGGTGTGACTACTGTCCT | CGGTGCAG | AAGCGA | ATERLEKSARRKQPA |
| | | | | AGGGAATTCGGCACAAGAGCGGGGCGCTCGTTGCACATGCGCAGGGCT | CGTTCTCC | CGCCCT | VPPAPVHGVRGVLR |
| | | | | CACCTGGCCGAGTACGACGGGGCAGGTTTCTGTTGGGGTGAACGTCTC | CATGTTGG | GGTGTA | GLLGKRVPREGGTTG |
| | | | | AGTGAATTCGCCGCTACGCGCCTCTGGTCGACGGAGGAAACCAAAAAG | ATCGGCAC | TGTCCG | STSARIVRRDDCRQG |
| | | | | CTGGCCGTGTTTTGTGAGAGGGGTGTGCCCTCACCGTCGGAATGCAGA | CCAGCCCC | TATCCTA | AVASASLNLIRRLGRK |
| | | | | GCCATTGCAGCCTCTCTGGGCGCAGGAAAAACACATCATCAGGTTAGAT | GGGTGCCA | ACCTGG | ATGRSGRRRVLGRPP |
| | | | | CGAAGTGTCGACTGGTGTTCGAGGCCATTCGGCGGCGTGAATTGCTTGA | TGCGAGTT | TTTGGG | RMDVRRSVRMRRM |
| | | | | GGTGGCTGCTGCCACGGAGCGTTTGGAGAAAAGCGCTAGGCGGAAGC | CAGACATT | AAAGCC | RRFLYRLARLGWAKL |
| | | | | AGCCCGCCGTACCACCGGCACCCGTACACGGAGTGAGAGGGGTCCTGC | TTGTTTAT | GATACC | AMFVLDGQMGASC |
| | | | | GGGGCCTACTAGGGAAGCGGGTGCCGAGAGAGGGTGGTACCACAGGC | GTATCGTC | GGCAAT | PVPLVEVSAVFRERW |
| | | | | AGCACCTCAGCAAGGATCGTCAGGAGAGACGACTGCCGTCAGGGGGCA | TGCGTGGT | GCCCGC | SIVRAFLGLGQFGGF |
| | | | | GTTGCGTCGGCTTCTCTCAATCTGATCAGAAGGCTGGGTCGAAAGGCAA | TGACTTGC | CACAGG | GTADNAGFGKLIDPA |
| | | | | CGGGCCGCTCCGGCAGGAGACGGGTCCTTGGACGCCCACCCAGGATGG | TAAGCTCA | TGTCGC | EVRAHLQSIKNRSSP |
| | | | | ATGTAAGGCGTAGCGTGAGGATGAGGAGGATGCGCAGGTTCCTCTATC | TTTCCTCCT | GCACCC | GPDGITKVALSKWDP |
| | | | | GGTTGGCCCGGCTGGGCTGGGCCAAGTTGGCTATGTTTGTCCTGGACG | CTCACTGC | CACGGG | EGIKLAHMYSTWLVS |
| | | | | GACAGATGGGGGCGAGCTGCCCCGTTCCACTCGTCGAAGTGTCGGCGG | GTCCCCCC | ATGACG | AGIPKVFKKCRTTLIP |
| | | | | TCTTCCGGGAGAGGTGGAGCATAGTCAGAGCCTTCCTGGGTCTGGGTC | AGGTGCTG | TATGGG | KTGDVSLHGDVGQ |
| | | | | AGTTCGGGGGCTTCGGGACTGCCGACAACGCAGGATTTGGGAAGCTGA | ATCGGTTG | CCCCGG | WRPITIASLVLRLYSRI |
| | | | | TCGATCCGGCTGAAGTCAGGGCCCATCTCCAGTCCATCAAGAACCGGTC | AAGAGGA | GGGACC | LTERMTVACPSHPRQ |
| | | | | TTCCCCGGGCCCGGATGGCATCACCAAGGTGGCGCTGTCCAAATGGGA | TTCGTCGT | TCATGG | RGFIASPGCSENLML |
| | | | | CCCCGAAGGGATTAAATTGGCGCACATGTACTCAACATGGTTGGTATCG | TGACCTCG | ATACTCC | LEGCMSLSKAGNGSL |
| | | | | GCAGGCATCCCTAAGGTCTTCAAGAAGTGCAGGACGACACTTATCCCAA | GCGGTGA | ACTGGA | AVVFVDFAKAFDTVS |
| | | | | AGACCGGGGACGTTAGTCTACATGGTGACGTGGGGCAATGGAGGCCCA | ATTTGGGA | CTTGCAC | HEHLLSVLVQKGLDQ |
| | | | | TAACCATTGCGTCCCTGGTCCTGAGACTCTATTCGCGGATCCTGACGGA | TTGTATTA | AATCCT | HMVELIKDSYENSVT |
| | | | | AAGGATGACAGTGGCCTGTCCTAGCCACCCGCGCCAGAGGGGCTTCATT | TACAGGTA | GGTGTA | KVHCQEGCSTDIAM |
| | | | | GCCTCCCCGGGCTGTTCGGAAAACCTCATGCTGTTGGAAGGTTGCATGA | GGTATAGA | CTGGAT | KVGVKQGDSMSPLL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTCTCAGCAAGGCAGGAAATGGCTCCCTCGCGGTTGTGTTCGTCGACTT | GGGCGTG | GCAGCG | FNLALDPLIQQLEREG |
| | | | | TGCGAAGGCCTTCGATACCGTCTCCCACGAGCACCTCCTGAGTGTTCTG | CGG (SEQ | ACGTTG | RGFPVNGKSITAMAF |
| | | | | GTGCAGAAAGGCTTGGACCAACACATGGTGGAGTTGATCAAGGACTCC | ID NO: | GTGACA | ADDLAIVSDSWEGM |
| | | | | TACGAGAACAGCGTGACCAAGGTGCACTGTCAGGAGGGTTGTTCCACT | 1144) | TAAGCA | RANLDILVDFCELTG |
| | | | | GACATCGCCATGAAGGTGGGAGTGAAGCAGGGTGACTCCATGTCCCCT | | ATCGCT | MRTQPSKCHGFLIEK |
| | | | | CTCCTCTTTAACCTGGCGCTGGATCCGCTTATCCAGCAACTTGAACGCGA | | AAGTCG | SGSRSYKVNRCEPWL |
| | | | | GGGCCGGGGCTTCCCAGTAAATGGGAAGTCCATTACTGCGATGGCATTT | | GGGTAG | LNDTALHMVGPKESI |
| | | | | GCGGATGACTTGGCCATAGTGAGTGACTCTTGGGAAGGCATGAGAGCC | | GGGAGG | KYLGVQVNPWTGIF |
| | | | | AACCTTGATATCCTGGTGGACTTCTGCGAGCTTACTGGAATGCGAACCC | | TGGGGA | AEDTVAKLRQWVVA |
| | | | | AGCCCAGTAAGTGCCACGGGTTCCTGATTGAGAAGAGTGGCAGCAGGT | | CCTCGG | ISKTPLRPLDKVSLLC |
| | | | | CGTACAAAGTGAACAGGTGCGAACCGTGGCTGCTGAACGACACAGCTC | | CACGGC | QFAVPRVIFVADHC |
| | | | | TTCACATGGTCGGGCCTAAGGAATCAATCAAGTACCTGGGCGTCCAGGT | | TGTAGG | MLSAKALTEMDRSIR |
| | | | | GAACCCGTGGACAGGGATCTTCGCTGAGGATACGGTTGCCAAACTACG | | AACGGG | QAVKRWLHLARCTT |
| | | | | ACAGTGGGTAGTTGCAATCTCCAAGACGCCTCTACGTCCGCTTGACAAG | | TGTATG | NGLLYSRKSSGGLGIP |
| | | | | GTGTCCCTGTTGTGCCAGTTTGCCGTACCGAGGGTCATCTTCGTGGCTG | | GGCTCC | KLSMIVPAMQARRLL |
| | | | | ATCACTGCATGCTATCTGCGAAGGCCCTGACAGAAATGGATAGGAGCAT | | GGCAGC | GLSRSKDETVRWMF |
| | | | | AAGACAAGCAGTGAAGAGGTGGTTGCACCTGGCCAGGTGTACCACGAA | | CGTCGT | LETTDHVAFERAWLR |
| | | | | CGGCCTCCTCTACTCAAGGAAATCCAGCGGTGGTCTGGGTATCCCAAAA | | CACTCCC | AGGSPDEVPELGPDL |
| | | | | TTGTCGATGATTGTTCCGGCCATGCAGGCCAGGAGACTCCTGGGCCTGT | | ATACAA | VEGSPAEGNADPVST |
| | | | | CCCGTTCTAAGGACGAGACGGTCAGGTGGATGTTTCTGGAGACAACTG | | CACAGG | VRPRKRIVPCDWRQ |
| | | | | ATCACGTGGCGTTTGAGAGGGCATGGCTGAGGGCTGGAGGGTCGCCA | | GGCTGC | VEFDRWAGQLVQGK |
| | | | | GATGAGGTACCGGAGCTGGGTCCGGATCTGGTGGAGGGCTCCCCTGCG | | ATCCTG | GIRTFEADKISNCWLY |
| | | | | GAGGGGAACGCTGACCCTGTCAGCACGGTGAGGCCAAGGAAGCGCAT | | GTGGCC | DYPPNKLKPGDFTAA |
| | | | | AGTCCCGTGTGACTGGCGTCAAGTCGAGTTCGACAGATGGGCCGGTCA | | GGTGCT | VQLRANVYPTRELAG |
| | | | | ATTGGTGCAGGGAAAAGGGATTCGGACGTTCGAAGCGGACAAGATCA | | AGTTGG | RGRTDTIDVCCRHCG |
| | | | | GCAACTGCTGGTTGTACGACTACCCGCCAAACAAGCTGAAGCCTGGGG | | TTCTGG | EAPETCWHILALCPK |
| | | | | ATTTTACGGCGGCTGTCCAGCTTAGAGCGAACGTTTACCCGACCCGGGA | | AAGCCC | VKRCRIQRHHKVCQV |
| | | | | GCTAGCGGGTCGCGGAAGGACCGATACGATAGATGTCTGTTGTCGACA | | GCCCGG | LVAEAERHGWEVER |
| | | | | CTGTGGGGAGGCCCCAGAGACTTGCTGGCACATCCTTGCGCTCTGCCCG | | GCTGGT | EKRWMLPSGECVAP |
| | | | | AAGGTTAAGCGGTGCCGTATTCAGAGGCACCACAAGGTGTGCCAGGTC | | TCGCAG | DLICWLDELALIVDVT |
| | | | | CTCGTCGCGGAGGCTGAGCGCCATGGATGGGAAGTGGAAAGGGAAAA | | AAGCAG | VRYEFDEESLERARIE |
| | | | | GCGCTGGATGCTGCCCTCCGGGGAGTGTGTCGCGCCGGACCTGATCTG | | GGTGCG | KECKYRPLIPVIRASR |
| | | | | CTGGTTGGATGAGCTGGCGCTCATTGTCGATGTGACGGTGAGGTACGA | | CCCAGG | VQTKKVTVYGFPLGA |
| | | | | GTTCGATGAGGAGTCGCTAGAACGCGCGCGAATCGAGAAGGAATGCAA | | GTAGGT | RGKWPAKNELLLADL |
| | | | | GTACCGCCCTCTCATTCCAGTGATCAGGGCGAGCAGAGTTCAGACGAAG | | TTGGTAT | GLSKARTRSFAKLLSR |
| | | | | AAGGTGACGGTCTATGGCTTCCCTCTGGGAGCCAGGGGAAAGTGGCCT | | ATCTGG | RVLLHSLDVMRTFM |
| | | | | GCTAAGAACGAGCTGCTGCTCGCCGACCTCGGCCTGAGCAAGGCTCGG | | GTCCGG | R (SEQ ID NO: 1389) |
| | | | | ACTCGGAGTTTTGCTAAACTCCTGAGCCGCAGAGTTCTCTTACATTCTCT | | TGCGAT | |
| | | | | GGATGTTATGAGGACGTTTATGCGTTAAGGAGGGGAGTAGGTCTCTAC | | ACCTATC | |
| | | | | TCTGACCCGAAGGGCCCCCCCGTTTCAGACCTGATTCTAGGCTACCTGTG | | GATGGG | |
| | | | | CCTAATTGGGGGGGTCCCAAAGAGATGTTGTCTGTTGTAGAAGGGTTTG | | CAGCGA | |
| | | | | CGCCACTGACTGCACGGAAGGGTGGGCCTCGACAGGTAGGGGTTACAT | | GGGCCG | |
| | | | | GACTCCGTGCTGCTCAGCAGACCCGCGCCTCTGAGACCGGGTAGGGCT | | CCTCGT | |
| | | | | ACTTGAACAAGCGACGCCCTGGTGTATGTCCGTATCCTAACCTGGTTTG | | GACGCG | |
| | | | | GGAAAGCCGATACCGGCAATGCCCGCCACAGGTGTCGCGCACCCCACG | | CTGTGT | |
| | | | | GGATGACGTATGGGCCCCGGGGGACCTCATGGATACTCCACTGGACTT | | GGAGCT | |
| | | | | GCACAATCCTGGTGTACTGGATGCAGCGACGTTGGTGACATAAGCAATC | | GGAGCC | |
| | | | | GCTAAGTCGGGGTAGGGGAGGTGGGGACCTCGGCACGGCTGTAGGAA | | GGCCTG | |
| | | | | CGGGTGTATGGGCTCCGGCAGCCGTCGTCACTCCCATACAACACAGGG | | GGTATG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCTGCATCCTGGTGGCCGGTGCTAGTTGGTTCTGGAAGCCCGCCCGGGC | | AACAGT | |
| | | | | TGGTTCGCAGAAGCAGGGTGCGCCCAGGGTAGGTTTGGTATATCTGGG | | TCTTGC | |
| | | | | TCCGGTGCGATACCTATCGATGGGCAGCGAGGGCCGCCTCGTGACGCG | | GGATGT | |
| | | | | CTGTGTGGAGCTGGAGCCGGCCTGGGTATGAACAGTTCTTGCGGATGT | | GGCGTA | |
| | | | | GGCGTAGCTAGATAGTACCCGTGGTTGTGGGCGTGGTGTCGACCAAAT | | GCTAGA | |
| | | | | GTTGTCCTGTGTGCACATAGGCCAAGGGTTACGTGGGTGGCAGTCAGA | | TAGTAC | |
| | | | | AGCACCCGCACCTGGAAGTGATTGCCCCGGGATCCCGGCTCTCTGTGAA | | CCGTGG | |
| | | | | GAGCTACCTTGAGGAAAGGTGTTCCGCTGGAACTCAAGACCCTACAGTA | | TTGTGG | |
| | | | | GGGGATATCAACTGGCTTTGAGGTGCTGTGATTCCGGAACCAGGGCGA | | GCGTGG | |
| | | | | GGGCGAGTACTTAGAGCATGTCCAAAAGCCCGGGGAACGTTCCGGGGG | | TGTCGA | |
| | | | | CCTGCTTGGGTCGTTGGACCCACATCCGTAAAACGATGGATCTCGCGTC | | CCAAAT | |
| | | | | GGCGCTCGGGAGAACTTCCCGCATGAACGCTGATTGCATGTGAGAACG | | GTTGTC | |
| | | | | CCCCCACGGCGGCGGGGCAGGCGCTCCCCCTGGGTGTAAGGCTCGGGG | | CTGTGT | |
| | | | | GGGTCACGGCTCCGCTCTAAAAG (SEQ ID NO: 1543) | | GCACAT | |
| | | | | | | AGGCCA | |
| | | | | | | AGGGTT | |
| | | | | | | ACGTGG | |
| | | | | | | GTGGCA | |
| | | | | | | GTCAGA | |
| | | | | | | AGCACC | |
| | | | | | | CGCACC | |
| | | | | | | TGGAAG | |
| | | | | | | TGATTG | |
| | | | | | | CCCCGG | |
| | | | | | | GATCCC | |
| | | | | | | GGCTCT | |
| | | | | | | CTGTGA | |
| | | | | | | AGAGCT | |
| | | | | | | ACCTTG | |
| | | | | | | AGGAAA | |
| | | | | | | GGTGTT | |
| | | | | | | CCGCTG | |
| | | | | | | GAACTC | |
| | | | | | | AAGACC | |
| | | | | | | CTACAG | |
| | | | | | | TAGGGG | |
| | | | | | | ATATCA | |
| | | | | | | ACTGGC | |
| | | | | | | TTTGAG | |
| | | | | | | GTGCTG | |
| | | | | | | TGATTCC | |
| | | | | | | GGAACC | |
| | | | | | | AGGGCG | |
| | | | | | | AGGGCG | |
| | | | | | | AGTACTT | |
| | | | | | | AGAGCA | |
| | | | | | | TGTCCA | |
| | | | | | | AAAGCC | |
| | | | | | | CGGGGA | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | ACGTTCC<br>GGGGGC<br>CTGCTT<br>GGGTCG<br>TTGGAC<br>CCACATC<br>CGTAAA<br>ACGATG<br>GATCTC<br>GCGTCG<br>GCGCTC<br>GGGAGA<br>ACTTCCC<br>GCATGA<br>ACGCTG<br>ATTGCAT<br>GTGAGA<br>ACGCCC<br>CCACGG<br>CGGCGG<br>GGCAGG<br>CGCTCCC<br>CCTGGG<br>TGTAAG<br>GCTCGG<br>GGGGGT<br>CACGGC<br>TCCGCTC<br>TAAAAG<br>(SEQ ID<br>NO:<br>1267) | |
| R2 | R2_BM | AB076841 | *Bombyx mori* | GGGCGATACGCATAATTTTAATTTCCCGATTGAAATCCAGTCGTCTTAAT<br>CTGGTGACCAGTGGCGCGGTCACCAGTATAGTGCACAGGACGTGAATG<br>GCTCCGAGGCTGGCGGAGTCACTCACTATAAGTGTGAGAGACGATGTC<br>CTGTGCCAAGTATACGTCCAACCCTAACGGGTTAAGTGAAATTAGTTGC<br>TCATAACAGGGACGGTGTACCTGTTTGCTCGTGGCTGGCTATCGAATGG<br>ACGGGACCAATACACCCCCCTGTTAGTAATGGGGTAAGAGAGAGCGGT<br>CTGAAACTATGGCCGAAATCACGACGCCCCACTCCTACCCATAACCTGCA<br>CGTGGTACCGCCGCACATTGACCGATACGGGAGGAGGGGCAGCACTTG<br>AATCACGTAGTCTTGGTGTAGCCATTGCGGGACTACAGCCCTCGTAAGT<br>GCCGCCTTAGAACGCAACGGGGCAATAGGTGGGCCGGGGCGCTAGCG<br>GGGGGGAGTAATCTCCCCTGTTGGCGTGCACCGCACTGCTCCCACTGGG<br>GGCAGTGTCATCCGGAAACAGGTGGGCCGGGGCGCCACCAGGGGGGA<br>GCAATCCCTCCTGATGATGGCGAGCACCGCACTGTCCCTTATGGGACGG<br>TGTAACCCGGATGGCTGTACACGTGGTAAACACGTGACAGCAGCCCCG<br>ATGGACGGACCGCGAGGACCGTCAAGCCTAGCAGGTACCTTCGGGTGG<br>GGCCTTGCGATACCTGCGGGCGAACCCTGTGGTCGGGTTTGCAGCCCG | GGGCGAT<br>ACGCATAA<br>TTTTAATTT<br>CCCGATTG<br>AAATCCAG<br>TCGTCTTA<br>ATCTGGTG<br>ACCAGTGG<br>CGCGGTCA<br>CCAGTATA<br>GTGCACAG<br>GACGTGAA<br>TGGCTCCG<br>AGGCTGGC<br>GGAGTCAC<br>TCACTATA | GCCTTG<br>CACAGT<br>AGTCCA<br>GCGGTA<br>AGGGTG<br>TAGATC<br>AGGCCC<br>GTCTGTT<br>TCTTCCC<br>CGGAGC<br>TCGCTCC<br>CTTGGC<br>TTCCCTT<br>ATATTTA<br>ACATCA<br>GAAACA | MMASTALSLMGRC<br>NPDGCTRGKHVTAA<br>PMDGPRGPSSLAGT<br>FGWGLAIPAGEPCG<br>RVCSPATVGFFPVAK<br>KSNKENRPEASGLPL<br>ESERTGDNPTVRGSA<br>GADPVGQDAPGWT<br>CQFCERTFSTNRGLG<br>VHKRRAHPVETNTD<br>AAPMMVKRRWHGE<br>EIDLLARTEARLLAER<br>GQCSGGDLFGALPGF<br>GRTLEAIKGQRRREP<br>YRALVQAHLARFGSQ<br>PGPSSGGCSAEPDFR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCCACAGTGGGTTTTTTTCCTGTTGCAAAAAAGTCAAATAAAGAAAATA | AGTGTGAG | GACATT | RASGAEEAVEERCAE |
| | | | | GACCTGAAGCCTCTGGCCTCCCGCTGGAGTCAGAGAGGACAGGCGATA | AGACGATG | AAACAT | DAAAYDPSAVGQMS |
| | | | | ACCCGACTGTGCGGGGTTCCGCCGGCGCAGATCCTGTGGGTCAGGATG | TCCTGTGC | CTACTG | PDAARVLSELLEGAG |
| | | | | CGCCTGGTTGGACCTGCCAGTTCTGCGAACGAACCTTTTCGACCAACAG | CAAGTATA | ATCCAAT | RRRACRAMRPKTAG |
| | | | | GGGTTTGGGTGTCCACAAGCGTAGAGCCCACCCTGTTGAGACCAATACG | CGTCCAAC | TTCGCC | RRNDLHDDRTASAH |
| | | | | GATGCCGCTCCGATGATGGTGAAGCGGCGGTGGCATGGCGAGGAAATC | CCTAACGG | GGCGTA | KTSRQKRRAEYARVQ |
| | | | | GACCTCCTCGCTCGCACCGAGGCCAGGTTGCTCGCTGAGCGGGGTCAGT | GTTAAGTG | CGGCCA | ELYKKCRSRAAAEVID |
| | | | | GCTCGGGTGGAGACCTCTTTGGCGCGCTTCCAGGGTTTGGAAGAACTCT | AAATTAGT | CGATCG | GACGGVGHSLEEME |
| | | | | GGAAGCGATTAAGGGACAACGGCGGAGGGAGCCTTATCGGGCATTGG | TGCTCATA | GGAGGG | TYWRPILERVSDAPG |
| | | | | TGCAAGCGCACCTTGCCCGATTTGGTTCCCAGCCGGGTCCCTCGTCGGG | ACAGGGA | TGGGAA | PTPEALHALGRAEW |
| | | | | GGGGTGCTCGGCCGAGCCTGACTTCCGGCGGGCTTCTGGAGCTGAGGA | CGGTGTAC | TCTCGG | HGGNRDYTQLWKPI |
| | | | | AGCGGTCGAGGAACGATGCGCCGAAGACGCCGCTGCCTATGATCCATC | CTGTTTGC | GGATCT | SVEEIKASRFDWRTS |
| | | | | CGCAGTCGGTCAGATGTCGCCCGATGCCGCTCGGGTTCTCTCCGAACTC | TCGTGGCT | TCCGATC | PGPDGIRSGQWRAV |
| | | | | CTTGAGGGTGCGGGGAGAAGACGAGCGTGCAGGGCTATGAGACCCAA | GGCTATCG | CTAATCC | PVHLKAEMFNAWM |
| | | | | GACTGCAGGGCGGCGAAACGATTTGCACGATGATCGGACAGCTAGTGC | AATGGACG | ATGATG | ARGEIPEILRQCRTVF |
| | | | | CCACAAAACCAGTAGACAAAAGCGCAGGGCAGAGTACGCGCGTGTGCA | GGACCAAT | ATTACG | VPKVERPGGPGEYRP |
| | | | | GGAACTGTACAAGAAGTGTCGCAGCAGAGCAGCAGCTGAGGTGATCGA | ACACCCCC | ACCTGA | ILIASIPLRHFHSILARR |
| | | | | TGGCGCGTGTGGGGGTGTCGGACACTCGCTCGAGGAGATGGAGACCTA | CTGTTAGT | GTCACT | LLACCPPDARQRGFI |
| | | | | TTGGCGACCTATCCTCGAGAGAGTGTCCGATGCACCTGGGCCTACACCG | AATGGGGT | AAAGAC | CADGTLENSAVLDAV |
| | | | | GAAGCTCTTCACGCCCTAGGGCGTGCGGAGTGGCACGGGGGCAATCGC | AAGAGAG | GATGGC | LGDSRKKLRECHVAV |
| | | | | GACTACACCCAGCTGTGGAAGCCGATCTCGGTGGAAGAGATCAAGGCC | AGCGGTCT | ATGATG | LDFAKAFDTVSHEAL |
| | | | | TCCCGCTTTGACTGGCGAACTTCGCCGGGCCCGGACGGTATACGTTCGG | GAAACTAT | ATCCGG | VELLRLRGMPEQFCG |
| | | | | GTCAGTGGCGTGCGGTTCCTGTGCACTTGAAGGCGGAAATGTTCAATGC | GGCCGAA | CGATGA | YIAHLYDTASTTLAVN |
| | | | | ATGGATGGCACGAGGCGAAATACCCGAAATTCTACGGCAGTGCCGAAC | ATCACGAC | AAA | NEMSSPVKVGRGVR |
| | | | | CGTCTTTGTACCTAAGGTGGAGAGACCAGGTGGACCGGGGGAATATCG | GCCCCACT | (SEQ ID | QGDPLSPILFNVVMD |
| | | | | ACCGATCTTGATCGCGTCGATTCCCCTGAGACACTTTCACTCCATCTTGG | CCTACCCA | NO: | LILASLPERVGYRLEM |
| | | | | CCCGGAGGCTGTTGGCTTGCTGCCCCCCTGATGCACGACAGCGCGGATT | TAACCTGC | 1268) | ELVSALAYADDLVLLA |
| | | | | TATCTGCGCCGACGGTACGCTGGAGAATTCCGCAGTACTGGACGCGGT | ACGTGGTA | | GSKVGMQESISAVDC |
| | | | | GCTTGGGGATAGCAGGAAGAAGCTGCGGGAATGTCACGTGGCGGTGC | CCGCCGCA | | VGKQMGLRLNCRKS |
| | | | | TAGACTTCGCCAAGGCATTTGACACAGTGTCTCACGAGGCACTTGTCGA | CATTGACC | | AVLSMIPDGHRKKH |
| | | | | ATTGCTGAGGTTGAGGGGCATGCCCGAACAGTTCTGCGGCTACATTGCT | GATACGG | | HYLTERTFNIGGKPLR |
| | | | | CACTTATACGATACGGCGTCCACCACCTTAGCCGTGAACAATGAAATGA | GAGGAGG | | QVSCVERWRYLGVD |
| | | | | GCAGCCCTGTGAAAGTGGGACGAGGGGTTCGTCAAGGGGACCCTCTGT | GGCAGCAC | | FEASGCVTLEHSISSA |
| | | | | CGCCGATACTCTTCAACGTGGTGATGGACCTCATCCTAGCTTCCCTGCCG | TTGAATCA | | LNNISRAPLKPQQRL |
| | | | | GAGAGGGTCGGGTATAGGTTGGAGATGGAACTTGTGTCCGCTCTGGCC | CGTAGTCT | | EILRAHLIPRFQHGFV |
| | | | | TATGCTGACGACCTAGTCCTGCTTGCGGGGTCGAAGGTAGGGATGCAG | TGGTGTAG | | LGNISDDRLRMLDVQ |
| | | | | GAGTCCATCTCTGCTGTGGACTGTGTTGGTAAGCAGATGGGCCTACGCC | CCATTGCG | | IRKAVGQWLRLPAD |
| | | | | TGAATTGCAGGAAGAGCGCGGTTCTGTCTATGATACCGGATGGCCACC | GGACTACA | | VPKAYYHAAVQDGG |
| | | | | GCAAGAAGCATCACTACCTGACTGAGCGAACCTTCAATATTGGAGGTAA | GCCCTCGT | | LAIPSVRATIPDLIVRR |
| | | | | GCCGCTCAGGCAGGTGAGTTGTGTTGAGCGGTGGCGATATCTTGGTGT | AAGTGCCG | | FGGLDSSPWSVARA |
| | | | | CGATTTTGAGGCCTCTGGATGCGTGACATTAGAGCATAGTATCAGTAGT | CCTTAGAA | | AAKSDKIRKKLRWA |
| | | | | GCTCTGAATAACATCTCAAGGGCACCTCTCAAACCCCAACAGAGGTTGG | CGCAACGG | | WKQLRRFSRVDSTT |
| | | | | AGATTTTGAGAGCTCATCTGATTCCGAGATTCCAGCACGGTTTTGTGCTT | GGCAATAG | | QRPSVRLFWREHLH |
| | | | | GGAAACATCTCGGATGACCGATTGAGAATGCTCGATGTCCAAATCCGGA | GTGGGCC | | ASVDGRELRESTRTP |
| | | | | AAGCAGTCGGACAGTGGCTAAGGCTACCGGCGGATGTGCCCAAGGCAT | GGGGCGC | | TSTKWIRERCAQITG |
| | | | | ACTATCACGCCGCAGTTCAGGACGGCGGCTTAGCGATCCCATCGGTGCG | TAGCGGG | | RDFVQFVHTHINALP |
| | | | | AGCGACCATCCCGGACCTCATTGTGAGGCGTTTCGGGGGGCTCGACTCG | GGGGAGT | | SRIRGSRGRRGGES |
| | | | | TCACCATGGTCAGTGGCAAGAGCCGCCGCCAAATCTGATAAGATTCGTA | AATCTCCC | | SLTCRAGCKVRETTA |
| | | | | AGAAACTGCGGTGGGCCTGGAAACAGCTCCGCAGGTTCAGCCGTGTTG | CTGTTGGC | | HILQQCHRTHGGRIL |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACTCCACAACGCAACGACCATCTGTGCGCTTGTTTTGGCGAGAACATCT<br>GCACGCATCTGTTGATGGACGCGAACTTCGCGAATCCACACGCACCCCG<br>ACATCCACAAAGTGGATTAGGGAGCGATGCGCGCAGATAACCGGACGG<br>GACTTCGTGCAGTTCGTGCACACTCATATCAACGCCCTCCCATCCCGCAT<br>TCGCGGATCGAGAGGGCGTAGAGGTGGGGGTGAGTCTTCGTTGACCTG<br>CCGTGCTGGTTGCAAGGTTAGGGAGACGACGGCTCACATCCTACAACA<br>GTGTCACAGAACACACGGCGGCCGGATTCTACGACACAACAAGATTGTA<br>TCTTTCGTGGCGAAAGCCATGGAAGAGAACAAGTGGACGGTTGAGCTG<br>GAGCCGAGGCTACGAACATCGGTTGGTCTCCGTAAGCCGGATATTATCG<br>CCTCCAGGGATGGTGTCGGAGTGATCGTGGACGTGCAGGTGGTCTCGG<br>GCCAGCGATCGCTTGACGAGCTTCACCGTGAGAAACGTAATAAATACGG<br>GAATCACGGGGAGCTGGTTGAGTTGGTCGCAGGTAGACTAGGACTTCC<br>GAAAGCTGAGTGCGTGCGAGCCACTTCGTGCACGATATCTTGGAGGGG<br>AGTATGGAGCCTGACTTCTTATAAGGAGTTAAGGTCCATAATCGGGCTT<br>CGGGAACCGACACTACAAATCGTTCCGATACTGGCGTTGAGAGGTTCAC<br>ACATGAACTGGACCAGGTTCAATCAGATGACGTCCGTCATGGGGGGCG<br>GCGTTGGTTGAGCCTTGCACAGTAGTCCAGCGGTAAGGGTGTAGATCA<br>GGCCCGTCTGTTTCTTCCCCGGAGCTCGCTCCCTTGGCTTCCCTTATATTT<br>AACATCAGAAACAGACATTAAACATCTACTGATCCAATTTCGCCGGCGT<br>ACGGCCACGATCGGGAGGGTGGGAATCTCGGGGATCTTCCGATCCTAA<br>TCCATGATGATTACGACCTGAGTCACTAAAGACGATGGCATGATGATCC<br>GGCGATGAAAA (SEQ ID NO: 1544) | GTGCACCG<br>CACTGCTC<br>CCACTGGG<br>GGCAGTGT<br>CATCCGGA<br>AACAGGTG<br>GGCCGGG<br>GCGCCACC<br>AGGGGGG<br>AGCAATCC<br>CTCCTG<br>(SEQ ID<br>NO: 1145) | | RHNKIVSFVAKAMEE<br>NKWTVELEPRLRTSV<br>GLRKPDIIASRDGVG<br>VIVDVQVVSGQRSLD<br>ELHREKRNKYGNHG<br>ELVELVAGRLGLPKAE<br>CVRATSCTISWRGV<br>WSLTSYKELRSIIGLRE<br>PTLQIVPILALRGSHM<br>NWTRFNQMTSVMG<br>GGVG (SEQ ID NO:<br>1390) |
| R2 | R8Hm-<br>A | — | *Hydra vulgaris* | TTCAAGTGGATGAAGCTGGGAAGGTAATCTGTAGTTGGTTGAGTTGGTT<br>GCAGATTACTGCTGTCGATTTTGCTTTCTATTGAAAGCCTGTCTCTACGG<br>GTCCTGAAGCTTGAATTTTGGTAGCTATAGTTTTGTGGAGGAAAGTGG<br>AATTTTGTACCATCTTTTGTCTCTCGTATCTACTATAGTAAATCCGGTCAT<br>GCAGCCTCTACGCGGCGCAACTAGAAACTTGGATCAGTGATCAAGGCTA<br>ATGCATGCCGGGTCTCCTCAGATTAGGAGTATAATACAAATCTGACTTC<br>ATCACTAAGAGGCTATGGGGCTAACGATCCTATAGTCTCGATGAACCTA<br>TTGATTGTTACTAGTAGCATAAAAGAAAGTGACGTACCCTCTAGTGGAA<br>AGGGGGGTGTAGCAGTCAATAACATAACAGCAGGAGCTAGTGGAAAA<br>GATACGTGCGTGATCATACACCCAGGTACCGATGGTATTTGGTGCTGTA<br>CTGAGTGTGTAGAGATACATAACAGCGGTAAGGATCTGAAACGACATCT<br>TGCAAAACGTCACCCGAGTGTAACGATAAGCGGTTACAAATGCAATCTG<br>TGTCCATTTGTTAGTGAACGCCAACTAAGTGTGGGGACACATCTGAGGT<br>ACTGCAGAGGCGTAAAAGAAGTGGTTAAAAGAGAGTTTGCATGCGCGA<br>GCTGCTCTTTTTCTTCGGATACGTTCTCAGGACTTCAGGTGCATATGCAA<br>AGAAAGCATATAGCAGAATGGAACGACCAGCTGAAGGAGAAAACGGA<br>GTTTGCTTGGACAGACCGAGAATTGAGGGAGCTTGCTGAGAAGGAACT<br>TACCACTCCTTCCTTCAGGTACAACAAAATTTTCTATGCTGCGCTAGGTA<br>CCTCCCGGACCTACGACGCTGTGAGGAAAATTCGCTATAATGACAGATA<br>CAAATCTGCCATTGCTGAAATGCGATCACAGATAGCAGATGCGGCTGCC<br>GCTGCACAAGAGAGGGATGTAGAGCGGGGTTTAGTTTCAGCACACTCA<br>GACAGAGGAAAAGAAATGCTCCCTGTTGTTGAAACCAAAAGTGATATCC<br>AAGTAAACAACGATATCAAAAAGGATATTGAATTAACACCGAATTCAAG<br>ACAGAAACAAACTAATCTAGCGCTGGCAAGGCCAGCTGTAATTGAGGT<br>GGAGGAAGACTTGGGTAGGCAGGATGTGAAACAATATCTCGCATCCCT<br>GCGCCAAGACGACTACACAAGTCCGGCCGAGCGGTCAATCTTTGCATAC | TTCAAGTG<br>GATGAAGC<br>TGGGAAG<br>GTAATCTG<br>TAGTTGGT<br>TGAGTTGG<br>TTGCAGAT<br>TACTGCTG<br>TCGATTTT<br>GCTTTCTA<br>TTGAAAGC<br>CTGTCTCT<br>ACGGGTCC<br>TGAAGCTT<br>GAATTTTG<br>GTAGCTAT<br>AGTTTTGT<br>GGGAGGA<br>AAGTGGA<br>ATTTTGTA<br>CCATCTTTT<br>GTCTCTCG<br>TATCTACT<br>ATAGTAAA<br>TCCGGTCA<br>TGCAGCCT | TAAATG<br>CCAAAA<br>GTTGCTT<br>GGGCTA<br>AATGAT<br>ACGTAC<br>GCTAGA<br>AAAAGC<br>GACTTG<br>CTGCAC<br>GGATGA<br>CGGTTC<br>ATCAGA<br>GCCCGA<br>TATGTG<br>CATGTC<br>AAGGCG<br>GCAGGG<br>AGAATC<br>ACTAGT<br>GTAGCT<br>GTTCTTT<br>CCATTAC<br>GACTTA<br>CGCGGT<br>TAACGT | MNLLIVTSSIKESDVP<br>SSGKGGVAVNNITAG<br>ASGKDTCVIIHPGTD<br>GIWCCTECVEIHNSG<br>KDLKRHLAKRHPSVTI<br>SGYKCNLCPFVSERQ<br>LSVGTHLRYCRGVKE<br>VVKREFACASCSFSSD<br>TFSGLQVHMQRKHI<br>AEWNDQLKEKTEFA<br>WTDRELRELAEKELT<br>TPSFRYNKIFYAALGT<br>SRTYDAVRKIRYNDR<br>YKSAIAEMRSQIADA<br>AAAAQERDVERGLV<br>SAHSDRGKEMLPVV<br>ETKSDIQVNNDIKKDI<br>ELTPNSRQKQTNLAL<br>ARPAVIEVEEDLGRQ<br>DVKQYLASLRQDDYT<br>SPAERSIFAYCREETN<br>WSATKRQVLKISRTT<br>RGLRQPKKVRPFEFP<br>EGFKPNRNMRKWR<br>KYRFLQECYREKRAET<br>VSKILDGTFIDEPEEEI |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGCAGGGAGGAAACCAATTGGTCTGCGACAAAAAGACAGGTATTAAAG | CTACGCGG | GGCACG | RPELEEVQRMYIDRL |
| | | | | ATATCGAGAACTACCAGAGGTTTAAGACAACCTAAGAAGGTTCGTCCAT | CGCAACTA | ATAGAT | EKRTQLDTTKIVQTD |
| | | | | TTGAGTTTCCGGAAGGGTTCAAACCTAACAGAAATATGAGAAAGTGGA | GAAACTTG | TTACACC | EVFCLQSYGRITIGEV |
| | | | | GAAAGTATAGATTCCTTCAGGAATGCTATAGGGAAAAGAGAGCTGAGA | GATCAGTG | AGGAAA | RDALGASKKDSASGP |
| | | | | CTGTTAGCAAGATCCTGGACGGGACTTTTATCGATGAACCGGAGGAAG | ATCAAGGC | TAATAC | DGLLLQDVRRLGPLLL |
| | | | | AGATTAGACCAGAGTTAGAGGAAGTACAACGTATGTACATTGACCGGCT | TAATGCAT | GTGAAG | CNIFNMWYLHGIPVE |
| | | | | GGAGAAAAGAACTCAGCTGGATACCACGAAGATTGTGCAAACAGACGA | GCCGGGTC | GGTTCC | ENRCRTILLYKSGDRH |
| | | | | GGTGTTTTGTCTGCAAAGCTACGGTCGCATTACGATCGGGGAAGTAAGA | TCCTCAGA | ACCATAT | LASNYRPVTIGNMLN |
| | | | | GATGCACTCGGTGCAAGCAAGAAGGACTCGGCCTCGGGTCCTGACGGC | TTAGGAGT | ACTGGA | RLYAKIWDKRIRKNV |
| | | | | CTGCTTCTACAGGATGTGAGGAGGCTGGGACCACTATTATTGTGTAACA | ATAATACA | GTTTAG | RLHVRQKAFIPVDGC |
| | | | | TCTTTAACATGTGGTACTTACATGGGATCCCTGTGGAAGAAAACAGGTG | AATCTGAC | ATCTATG | FENVKTIQCVLQSYR |
| | | | | TCGAACAATACTCTTATACAAGAGTGGCGATAGACATCTGGCATCAAAC | TTCATCAC | AGGGAA | KRKLEHNVVFIDLAK |
| | | | | TATAGACCTGTGACAATCGGCAACATGCTGAACAGGCTTTACGCCAAAA | TAAGAGGC | ACATTTG | AFDTVLHDSIRKALW |
| | | | | TCTGGGACAAACGGATCCGGAAGAACGTGCGTCTTCATGTGAGGCAAA | TATGGGGC | TAATAA | RKGVPSGVVKVVDSL |
| | | | | AAGCATTTATCCCGGTGGATGGGTGCTTTGAGAACGTAAAAACGATCCA | TAACGATC | GTCAGT | YAGAVTSISVGKTKTR |
| | | | | ATGCGTTCTCCAGTCTTACAGAAAGCGTAAGTTGGAACACAACGTCGTA | CTATAGTC | CTGGTA | SICINSGVKQGCPLSP |
| | | | | TTTATTGATCTTGCCAAGGCCTTTGACACGGTCTTGCATGACTCGATAAG | TCG (SEQ | ACCTGG | LLFNLILDELAERIEAT |
| | | | | GAAAGCGTTGTGGCGGAAAGGTGTTCCGTCTGGGGTTGTTAAAGTGGT | ID NO: | CGCCGC | GCGLDLDGHVLSSM |
| | | | | AGACAGCTTATATGCGGGAGCTGTCACAAGCATAAGTGTTGGAAAAAC | 1146) | TGTTGA | AFADDYVLLAKDSVE |
| | | | | GAAAACTCGTTCTATATGTATAAACTCTGGAGTCAAGCAGGGTTGTCCT | | GTCAAA | MNELIRVCSTFFKEK |
| | | | | CTGTCACCTCTTCTATTCAACCTAATACTGGATGAACTAGCGGAGAGGAT | | TTAACTA | GLSVNPGKCQSLRVL |
| | | | | AGAGGCAACCGGCTGCGGGTTAGATCTTGATGGTCACGTTCTATCATCT | | TGTCAAT | PVKEKKRSMKVLVRP |
| | | | | ATGGCCTTTGCTGACGACTACGTGTTGCTAGCGAAGGACTCCGTGGAGA | | ACTCATT | HRWWRIKDQDVDIP |
| | | | | TGAACGAGTTGATAAGAGTGTGTAGTACATTCTTCAAAGAGAAAGGCTT | | AAGTTA | SMTYDSLGKYLGVSI |
| | | | | ATCTGTAAACCCAGGTAAATGTCAATCGCTAAGAGTTCTTCCCGTAAAG | | TCGACTT | DPTGKIALPIEEWKN |
| | | | | GAGAAGAAACGGTCAATGAAGGTCCTTGTTAGACCTCATAGATGGTGG | | TGATAT | WMTKLKECKLKPEQ |
| | | | | AGGATAAAAGACCAGGATGTTGACATCCCATCTATGACATATGACAGCT | | GGCATG | KVKILKEVVCSRVNYV |
| | | | | TAGGAAAATACCTTGGTGTTTCGATTGACCCAACTGGTAAGATAGCGCT | | GGGTGA | LRMSECGISELRSWT |
| | | | | TCCGATTGAGGAGTGGAAGAATTGGATGACCAAGCTAAAAGAGTGTAA | | TTCCGC | RFVRNWAKNIIHLPT |
| | | | | GCTCAAGCCCGAGCAGAAAGTTAAAATTCTGAAAGAAGTGGTTTGCTCT | | GTTATAT | WCSSDWIHSIKGLGI |
| | | | | CGGGTAAACTACGTTTTGCGGATGTCAGAGTGTGGCATCAGCGAACTTC | | CAAAGT | PDVSKGIVIQRMRAS |
| | | | | GGAGTTGGACACGATTTGTAAGGAATTGGGCGAAAAACATCATTCACTT | | CAAACA | EKMSTSEDGIVRVVG |
| | | | | ACCCACATGGTGCAGTAGTGACTGGATACACTCGATCAAAGGGTTAGG | | TGATGA | ARLVQKNRVLWEKA |
| | | | | CATTCCCGACGTTTCGAAGGGAATTGTCATACAACGTATGAGGGCTTCG | | TTGCAAT | GFEGIELKAARRHCE |
| | | | | GAGAAAATGTCTACGTCTGAAGACGGTATAGTCCGCGTGGTTGGTGCA | | GAGAAA | VERLNNIGNITNGVA |
| | | | | CGACTTGTTCAGAAGAACAGAGTCTTGTGGGAAAAGGCCGGTTTCGAA | | CTACCAC | LKTIAAVSSVNRYW |
| | | | | GGTATCGAACTGAAGGCAGCCAGGAGGCACTGCGAAGTGGAGAGACT | | GCTTGG | MIEDNLKSGNKILVW |
| | | | | CAACAACATTGGTAACATTACCAACGGCGTTGCACTCAAAACTATCGCA | | TCACGTT | KAMAGAIPTKINLSR |
| | | | | GCAGTCTCCTCGGTAAATCGGTACTGGATGATTGAAGACAACTTGAAAT | | TGTGAG | GVADQTLKKCRRCGL |
| | | | | CCGGGAACAAGATTCTCGTTTGGAAAGCAATGGCGGGTGCCATTCCAAC | | GAGAAC | TAETDGHILAGCHTS |
| | | | | AAAGATTAACCTTTCGCGGGGCGTAGCAGACCAGACCCTCAAAAAATGT | | ATCTCAT | SDAYSKRHNMLCDKL |
| | | | | CGTCGATGCGGTTTAACAGCGGAAACGGATGGACACATCTTGGCTGGA | | TCAAGC | AKELKLNGGPNRRV |
| | | | | TGCCATACTAGCAGCGACGCGTACTCAAAACGTCACAACATGCTCTGTG | | CTCCCG | WRERTCFTSTGRRYR |
| | | | | ATAAACTCGCCAAAGAGCTCAAACTCAATGGTGGACCAAACAGACGTGT | | GATGTC | PDIIVKDDSKITVIDM |
| | | | | GTGGCGCGAGAGGACGTGCTTCACTAGTACAGGCAGGCGATATAGACC | | GGCACC | TCPYEKSEGHLIQCES |
| | | | | TGACATTATCGTTAAAGATGACAGTAAAATCACAGTCATCGATATGACTT | | CGCTGA | AKVTKYEPLKLDKYW |
| | | | | GTCCGTATGAGAAATCAGAAGGACACCTGATCCAATGTGAAAGTGCGA | | CATCTTC | TRELEGANGIVAEKV |
| | | | | AAGTAACTAAATACGAGCCACTCAAGCTAGATAAGTATTGGACTCGAGA | | TGGCTT | ELMGLAIGAIGTIMR |
| | | | | ACTCGAGGGAGCAAATGGTATTGTTGCTGAAAAGGTAGAGCTGATGGG | | ATGAAA | STLRKLCELKSGRIVR |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATTGGCAATAGGGGCGATCGGCACAATCATGCGTAGTACCCTTCGGAA | | ATTTTCA | RLQMIACNNSAQIIK |
| | | | | ACTCTGTGAGTTAAAGTCGGGCAGGATCGTAAGACGTCTACAAATGATT | | TTAATTT | GHLSRATRRNLR |
| | | | | GCTTGTAATAATAGCGCCCAAATTATAAAGGGTCACCTGTCAAGGGCGA | | TTGTAA | (SEQ ID NO: 1391) |
| | | | | CTCGGAGGAATTTGCGGTGATAAATGCCAAAAGTTGCTTGGGCTAAATG | | GTCATG | |
| | | | | ATACGTACGCTAGAAAAAGCGACTTGCTGCACGGATGACGGTTCATCAG | | GGCGGC | |
| | | | | AGCCCGATATGTGCATGTCAAGGCGGCAGGGAGAATCACTAGTGTAGC | | TTGAAA | |
| | | | | TGTTCTTTCCATTACGACTTACGCGGTTAACGTGGCACGATAGATTTACA | | GC (SEQ | |
| | | | | CCAGGAAATAATACGTGAAGGGTTCCACCATATACTGGAGTTTAGATCT | | ID NO: | |
| | | | | ATGAGGGAAACATTTGTAATAAGTCAGTCTGGTAACCTGGCGCCGCTGT | | 1269) | |
| | | | | TGAGTCAAATTAACTATGTCAATACTCATTAAGTTATCGACTTTGATATG | | | |
| | | | | GCATGGGGTGATTCCGCGTTATATCAAAGTCAAACATGATGATTGCAAT | | | |
| | | | | GAGAAACTACCACGCTTGGTCACGTTTGTGAGGAGAACATCTCATTCAA | | | |
| | | | | GCCTCCCGGATGTCGGCACCCGCTGACATCTTCTGGCTTATGAAAATTTT | | | |
| | | | | CATTAATTTTTGTAAGTCATGGGCGGCTTGAAAGC (SEQ ID NO: | | | |
| | | | | 1545) | | | |
| R2 | R8Hm- | — | *Hydra* | CTTGGGGTCACTGACACATTTTTCGGTAGCCATAGTTTTTTGAGAGGAA | CTTGGGGT | ATGCCC | MSNRITIGDVPSVGK |
| | B | | *vulgaris* | GAGTGGAAGTTTTTCCATGAGTCGTCTCTCGTATAAACTGTGGTAAATCC | CACTGACA | GAGGTA | GGLTVNKQTAGADG |
| | | | | GGCCATCCAGCCTCTACGCGGCGCAACTAGAAACTTGGATCAGTGATCA | CATTTTTC | GTTGGG | AEACVVIHPGAKGIW |
| | | | | AGGCTAATGGATGACGGGACTCCATGGATAAGGAGATATAAAGATCTT | GGTAGCCA | ATAATG | SSPACLRKFTIGKELR |
| | | | | ATTTGAACGCATCTTAAGGGGTTATGGGGCTAACACCCCCTTAATTCTG | TAGTTTTTT | ATGCAC | AHLAQIHKLAPSAVR |
| | | | | GTGCACATTTATTGACCGTTATGAGCAATAGAATCACGATAGGTGATGT | GAGAGGA | AAGCTC | YRCNKCPYEGDVQLS |
| | | | | ACCCTCGGTAGGAAAGGGGGGTTTAACTGTCAATAAACAAACAGCAGG | AGAGTGG | GTAAGG | VGTHLRYCKGIAGVV |
| | | | | AGCTGATGGTGCTGAAGCGTGTGTAGTCATACACCCAGGTGCCAAGGG | AAGTTTTT | CGACTT | EEKKQFACAICNFSSD |
| | | | | TATTTGGTCCTCTCCTGCGTGTTTAAGAAAGTTTACGATCGGAAAAGAAC | CCATGAGT | GCTGCA | TFSGLQVHKQRKHV |
| | | | | TAAGGGCACATTTGGCTCAAATTCATAAACTTGCACCGAGTGCAGTTCG | CGTCTCTC | CGTATG | VEWNEQLKEKTEFA |
| | | | | GTACAGGTGTAATAAGTGTCCGTATGAGGGTGATGTCCAACTCAGTGTG | GTATAAAC | CCGCTA | WTDRELRELAVKEVT |
| | | | | GGAACACATCTGAGGTACTGTAAGGGTATTGCGGGAGTGGTGGAGGA | TGTGGTAA | AACGCT | IPFSVVNTETFAVLDI |
| | | | | GAAAAAGCAATTCGCTTGCGCGATTTGTAATTTCTCTTCGGATACCTTTT | ATCCGGCC | TAGCTC | TTRTKDAVRKIRYTDR |
| | | | | CAGGACTTCAGGTGCATAAGCAAAGAAAGCATGTAGTTGAATGGAACG | ATCCAGCC | GATGAG | YKSILAEVRAQVNAV |
| | | | | AGCAGCTGAAAGAGAAAACGGAGTTTGCTTGGACAGACAGGGAACTGC | TCTACGCG | TGCATG | AEEAPQASDESQITLL |
| | | | | GGGAGCTGGCGGTTAAGGAAGTAACGATTCCTTTCTCTGTGGTGAATAC | GCGCAACT | TCAAGA | VNTGRGAELQPAVIN |
| | | | | GGAGACCTTTGCTGTGCTAGATATTACGACGCGGACTAAGGATGCTGTG | AGAAACTT | CGGTCG | ITDSIELVTDVNEVEM |
| | | | | AGGAAAATTCGCTACACGGATAGATACAAATCTATCCTGGCTGAAGTAC | GGATCAGT | GGAGTA | VTSNSTNEEQPINAP |
| | | | | GCGCACAAGTTAACGCTGTGGCGGAGGAAGCGCCGCAAGCTAGTGATG | GATCAAGG | TGATCA | VEPAVIEADLGRQDA |
| | | | | AGAGTCAAATAACGCTCTTAGTTAACACAGGCAGGGGAGCAGAATTAC | CTAATGGA | GTGGAG | KLYLASLRQSDCTNA |
| | | | | AACCTGCTGTGATTAATATAACTGATTCAATTGAATTAGTTACTGATGTC | TGACGGG | CTGACTT | SDRWTLAYCRGEVD |
| | | | | AATGAGGTTGAAATGGTAACATCGAATTCAACCAATGAAGAACAGCCTA | ACTCCATG | TCCAGA | WCKTKSRLFKVSRHA |
| | | | | TCAACGCGCCGGTGGAACCGGCTGTAATTGAGGCGGACTTGGGAAGAC | GATAAGG | CAACTC | RGLRQPQRVENWEF |
| | | | | AGGATGCGAAACTATATCTCGCATCGCTGCGTCAAAGCGATTGCACAAA | AGATATAA | ACGCGG | PEGFRPNRNLRKWR |
| | | | | CGCATCTGATCGATGGACCCTTGCGTATTGCAGGGGAGAAGTTGATTGG | AGATCTTA | ATTCGC | KYSFLQSCYRTKKKET |
| | | | | TGTAAGACGAAAAGCAGGCTTTTCAAAGTATCAAGACATGCCCGGGGTT | TTTGAACG | GTGCGG | VSKILDGTFKDTPEEEI |
| | | | | TAAGACAACCTCAAAGGGTGGAGAATTGGGAGTTTCCAGAGGGATTCA | CATCTTAA | TGGATA | RPELEEVQRVYVDRL |
| | | | | GACCTAACAGGAACCTTCGTAAATGGAGGAAGTATTCATTCTTGCAAAG | GGGGTTAT | CAACAC | EVRTQLDTTRTVHID |
| | | | | TTGCTATAGAACGAAGAAGAAGGAAACTGTTAGTAAGATTCTTGATGGT | GGGGCTA | CTGGTA | ERFDLVSYGRITIREV |
| | | | | ACTTTCAAGGACACACCTGAGGAAGAGATTAGGCCAGAGTTGGAGGAA | ACACCCCC | TAACAT | QDAISASKKDASGGP |
| | | | | GTACAACGTGTGTACGTTGACCGGCTAGAGGTAAGAACTCAGCTGGAT | TTAATTCT | ATGAAG | DGLLLQDVKKASPRQ |
| | | | | ACCACTAGGACAGTGCATATAGACGAAAGATTCGATTTAGTAAGCTATG | GGTGCACA | GGTTCC | LCIIFNMWYLHGIPV |
| | | | | GTCGCATTACGATCAGGGAGGTACAAGACGCAATCAGCGCAAGCAAGA | TTTATTGA | ATCTAGT | VENRCRTILLHKGGE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGGATGCCTCAGGGGGTCCCGACGGCTTGCTCCTACAGGACGTGAAAA | CCGTT | ACAGGG | KHLTSNYRPVTIGNM |
| | | | | AGGCGAGCCCACGCCAATTGTGTATCATCTTTAATATGTGGTACTTGCAT | (SEQ ID | ATAACG | LNRVYAKIWDRRIRK |
| | | | | GGAATCCCTGTAGTGGAAAATAGGTGCCGAACAATACTCTTGCATAAGG | NO: 1147) | ATCCAT | NLQLHVRQKAFVPLD |
| | | | | GTGGCGAGAAGCATCTAACGTCGAACTACCGACCTGTGACGATCGGCA | | GGGAGC | GCFENVKTIQCILQSY |
| | | | | ATATGCTGAATAGGGTATACGCTAAGATCTGGGACAGACGGATCAGAA | | AAACTA | RRSRREHNVVFVDLA |
| | | | | AAAACCTGCAACTTCATGTGAGACAGAAAGCATTCGTCCCGCTGGATGG | | ATTAGTT | KAFDTILHDSIEKALLR |
| | | | | GTGCTTTGAGAATGTAAAAACCATCCAATGCATTCTCCAGTCTTACAGAA | | GGAGGT | KGIPRSVIKVVDSLYA |
| | | | | GGAGCAGGCGGGAACACAATGTCGTATTTGTCGATCTTGCAAAAGCGTT | | AATCCA | GAVTSITVGKTKTRPI |
| | | | | TGATACGATTTTGCATGATTCGATAGAGAAAGCATTGCTGAGGAAAGGC | | ACGCCG | CINSGVKQGCPLSPLL |
| | | | | ATACCGCGAAGTGTGATAAAAGTGGTAGACAGCTTATATGCGGGAGCT | | CTGTTG | FNLVIDELAERLEATG |
| | | | | GTCACGAGCATTACGGTTGGGAAAACAAAGACTCGACCTATATGTATAA | | AGTCAG | CGLDLEGHVISSMAF |
| | | | | ATTCAGGGGTGAAGCAGGGTTGTCCTCTATCTCCTTTGCTGTTCAATCTA | | TTTTTAA | ADDYVLLAKDSVEM |
| | | | | GTAATAGATGAACTAGCGGAGAGGCTGGAGGCAACTGGCTGCGGTCTT | | CCGCCA | NVLMNVCNTFFEEK |
| | | | | GATCTGGAAGGTCACGTCATTTCTTCCATGGCTTTTGCTGATGACTACGT | | GTCAAC | GLAVNPAKCQSLRVL |
| | | | | GTTGTTGGCGAAAGACTCGGTTGAAATGAACGTGCTAATGAACGTGTG | | TCTTGTA | PVKGKRSMKVLTRTH |
| | | | | CAATACGTTCTTTGAGGAGAAGGGTTTAGCTGTAAATCCAGCAAAATGT | | GGTTAT | RWWKINNQDVEIPS |
| | | | | CAGTCGTTACGCGTTTTGCCTGTAAAAGGCAAACGGTCCATGAAAGTCC | | CGGTCT | MTYESVGKYLGVMI |
| | | | | TTACGAGGACGCATAGATGGTGGAAAATTAATAACCAGGATGTTGAAA | | TCGGCA | DPAGKIALPIEEWKL |
| | | | | TCCCATCTATGACATACGAAAGTGTTGGAAAATATCTTGGGGTAATGAT | | GACCTT | WLTRLRECKLKPDQK |
| | | | | TGACCCAGCTGGTAAGATTGCTCTTCCGATTGAGGAATGGAAGCTTTGG | | GGACCG | VKVLKEVVCARANYV |
| | | | | CTAACTAGGTTAAGGGAGTGTAAGCTCAAACCTGATCAAAAAGTGAAG | | CCTAGC | LRMSGCGICELRKWS |
| | | | | GTGCTGAAAGAGGTAGTTTGTGCCCGAGCAAACTATGTTCTCCGGATGT | | GCCGGC | RFVRGWVKSIIHFPA |
| | | | | CCGGGTGCGGAATCTGTGAGCTCCGTAAGTGGTCACGATTTGTGAGGG | | CAACAG | WCNSEWMHSSKGL |
| | | | | GATGGGTGAAATCCATCATTCACTTCCCCGCATGGTGCAATAGCGAATG | | TTTGTCG | GIPDVVSGIVIQRMR |
| | | | | GATGCATTCGAGCAAAGGCTTAGGCATTCCTGATGTAGTGTCAGGAATT | | TCGACT | AAEKMAKSTDGVVR |
| | | | | GTCATCCAACGAATGAGAGCTGCGGAAAAAATGGCTAAGTCAACAGAC | | AACATG | VVGARIVQTNRVLW |
| | | | | GGAGTAGTCCGAGTTGTCGGGGCCCGCATTGTGCAGACAAATAGAGTT | | ATGATTT | KRAGLAGIELDAARK |
| | | | | TTGTGGAAAAGGGCCGGATTAGCAGGCATAGAACTGGATGCCGCCAGG | | GCGAGA | FCEVKRVNKIGNQTN |
| | | | | AAGTTCTGTGAGGTTAAGAGGGTGAACAAAATTGGCAATCAAACCAAT | | GAAACC | GGALKTIAESSVSRH |
| | | | | GGAGGCGCCCTCAAGACTATAGCAGAGTCCTCGGTGAGCCGGCACTGG | | CACGCTT | WLLEKNIRPGNKILV |
| | | | | TTATTGGAAAAGAATATAAGACCTGGAAACAAAATTCTAGTTTGGAAGG | | TGTCACT | WKAMAGVIPTKINLS |
| | | | | CAATGGCAGGAGTGATTCCAACAAAGATCAATCTGTCTAGAGGCGTAGC | | TATGTG | RGVADQTLKKCRCC |
| | | | | CGACCAGACTCTCAAAAAATGTCGGTGTTGTGGTTTAACAGCAGAAACT | | AGGATA | GLTAETDCHILAGCPT |
| | | | | GATTGTCACATCTTGGCCGGATGTCCTACCAGTCGGGATGCGTACTCGA | | AAATCTC | SRDAYSKRHNLLCDK |
| | | | | AACGTCATAACTTGCTTTGTGATAAACTCGCCAAAGAGCTAAGACTCAAT | | TTGTCCA | LAKELRLNGGPSRRV |
| | | | | GGTGGGCCAAGCAGACGGGTGTGGCGCGAGAGGATGTGTCTCTCTGG | | TATGATC | WRERMCLSGNGRRY |
| | | | | GAATGGCAGGCGTTATAAGCCCGATATTGTTGTGAAAGATGATGGTGT | | CTTTGAA | KPDIVVKDDGVITVID |
| | | | | AATTACTGTCATCGATATGGCATGTCCGTACGAGAAATCGGAAAGACAC | | GGGAAC | MACPYEKSERHLSQC |
| | | | | CTAAGTCAATGCGAAGATGCAAAAGTTGCTAAGTACGAGCCACTAAGG | | AGCGCT | EDAKVAKYEPLRLDR |
| | | | | CTTGATAGGAGTTGGACTCAAGAACTTGAGGGGAATAACGGCAGAAGT | | TTGAGC | SWTQELEGNNGRSA |
| | | | | GCTAATGAAATATCAGTTGTAGGGATTGCAGTAGGGGCGATTGGAACA | | TTGCTC | NEISVVGIAVGAIGTI |
| | | | | ATTACGCGTAAAACCCAGCGGATACTTAGCAAGTTGAAACTGGCCAAGG | | GGCGTT | TRKTQRILSKLKLAKV |
| | | | | TCGGAAGACCGTTACAAATAATTGCATGTAATGAAAGCGCCCAAATTAT | | GGCACC | GRPLQIIACNESAQIIR |
| | | | | AAGACGACATCTTTCGGGATCGAGACTTAGAAATTTGCGGTGAATGCCC | | TTTAGTC | RHLSGSRLRNLR |
| | | | | GAGGTAGTTGGGATAATGATGCACAAGCTCGTAAGGCGACTTGCTGCA | | TGTAAT | (SEQ ID NO: 1392) |
| | | | | CGTATGCCGCTAAACGCTTAGCTCGATGAGTGCATGTCAAGACGGTCGG | | ATTTTCT | |
| | | | | GAGTATGATCAGTGGAGCTGACTTTCCAGACAACTCACGCGGATTCGCG | | TGATATT | |
| | | | | TGCGGTGGATACAACACCTGGTATAACATATGAAGGGTTCCATCTAGTA | | ATGGAC | |
| | | | | CAGGGATAACGATCCATGGGAGCAAACTAATTAGTTGGAGGTAATCCA | | GAAAAA | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACGCCGCTGTTGAGTCAGTTTTTAACCGCCAGTCAACTCTTGTAGGTTAT | | GGTAGT | |
| | | | | CGGTCTTCGGCAGACCTTGGACCGCCTAGCGCCGGCCAACAGTTTGTCG | | ATGGTT | |
| | | | | TCGACTAACATGATGATTTGCGAGAGAAACCCACGCTTTGTCACTTATGT | | GCA | |
| | | | | GAGGATAAAATCTCTTGTCCATATGATCCTTTGAAGGGAACAGCGCTTT | | (SEQ ID | |
| | | | | GAGCTTGCTCGGCGTTGGCACCTTTAGTCTGTAATATTTTCTTGATATTA | | NO: | |
| | | | | TGGACGAAAAAGGTAGTATGGTTGCA (SEQ ID NO: 1546) | | 1270) | |
| R2 | R9Av | GQ398057 | *Adineta vaga* | GAAATAGTTTGCAATGGTAGGTGTATGGCGCCTCTGTGTCTCTCTTTCGC | GAAATAGT | ACTAGT | MNLPIREHAVSVHNI |
| | | | | TGGATATAGTTTGACGATTTTGTACCAGGTATCTGTTTCTTGTGAGTTCA | TTGCAATG | CTCCTTC | NKFNYLCQLCSKSYD |
| | | | | GCACCAGTTTGAACAGGCTTAGCGATAGACCTTCGAACTTGAAACACTG | GTAGGTGT | TTCTATT | TINSVKAHYVACRRQ |
| | | | | TTGTGAAGCTGGCTGGGCCCCTGCAGATTTTCTCGATTAGAACGTGAGT | ATGGCGCC | AGTCAG | KNASSTTAVPTNVIN |
| | | | | GTTACGTCCAGAATGACCCACCAGTGGTTAGTTCTACGTTGCCCTGGAA | TCTGTGTC | TCTAATT | NNQLAINTNQVISRN |
| | | | | AGGAGAAAAGTTGAGCTAAAATCGCACGGCCTAGTTGTTTATCAAATAG | TCTCTTTC | AATTTTT | PLQCVECLMKQVDF |
| | | | | GCACGGTGAGGAACTCTTCTATGTACCCTGACTAAAGTACTCACTTGTGC | GCTGGATA | CTTACAT | YAKDTKALVTHMRTK |
| | | | | GCTGGGTTTGCTCCCCCTCGCATTGACTTATCTGATCGCACTACCCACCA | TAGTTTGA | TCTACAT | HAAAYEESKKVATRR |
| | | | | AACGAAACATAAACTTAGCTCGTGGTATCAGTCCACAGCGTGTGCAGTC | CGATTTTG | CTAGTTC | VAWSPDEDQILAELE |
| | | | | GGATTCAGGGGAGCGTGTTAGTGACAAGCAGGATAATATTAACATAGT | TACCAGGT | CATTATT | VKLKKIQKGQLLSRLV |
| | | | | TAATGTTAAGGCGTTCAACATTCCTTATCCAATTGGAAGAGTTGACTGTG | ATCTGTTT | AAATTG | VEYNKCADKSKAPSR |
| | | | | AAGTTTGTCATGAAGACATTGGACAAATGAATTTGCCGATTCGAGAGCA | CTTGTGAG | GTATGA | SKDAIRTRRQQHDYK |
| | | | | TGCCGTATCTGTACACAATATAAACAAATTTAATTATTTATGCCAGCTAT | TTCAGCAC | TCAGTG | LLLRSLQSQQPPVGS |
| | | | | GTTCTAAGTCTTATGATACTATTAATAGTGTTAAAGCTCACTATGTTGCA | CAGTTTGA | CTATCTC | EDSDSDISSSNNNPLT |
| | | | | TGCAGAAGACAGAAGAATGCCTCATCCACAACAGCTGTTCCAACCAATG | ACAGGCTT | TGCTAC | TTHNVTPTPDSSNVV |
| | | | | TCATCAACAACAACCAACTTGCTATAAATACTAATCAAGTAATATCAAGA | AGCGATAG | ACTCAAT | LLIQKIRESVDSIVKIT |
| | | | | AATCCACTTCAGTGCGTTGAGTGTCTAATGAAACAAGTTGATTTCTATGC | ACCTTCGA | GCTTAAT | NLKLNTNMLNAASA |
| | | | | TAAAGATACAAAGGCACTAGTCACGCACATGCGTACTAAACATGCTGCT | ACTTGAAA | CGTATG | FINQNNNMDPLELS |
| | | | | GCCTACGAGGAATCAAAGAAAGTCGCAACAAGAAGAGTTGCCTGGAGC | CACTGTTG | TTATTGA | MRGIEEDVKAIRDKE |
| | | | | CCTGATGAGGATCAAATTCTTGCTGAACTAGAAGTCAAATTGAAAAAGA | TGAAGCTG | CAGTCT | LQKPTRNVPSSTTSR |
| | | | | TACAAAAAGGTCAATTACTTAGTCGTCTTGTCGTTGAATATAATAAATGT | GCTGGGCC | GACACT | KPTRNAKRLEKSKKY |
| | | | | GCTGATAAATCGAAAGCTCCTTCCAGGTCCAAGGATGCTATTCGTACAA | CCTGCAGA | TGATTAC | GYYQHLYYNNKKKLV |
| | | | | GACGCCAACAACATGATTACAAACTATTGCTTCGCTCACTCCAATCTCAA | TTTTCTCG | TCTTACG | AEILDGETSGAKPPP |
| | | | | CAACCGCCAGTTGGTAGCGAAGACAGTGACAGTGACATATCTTCTAGTA | ATTAGAAC | ACATAT | MNLVEDYYRNIWSR |
| | | | | ATAACAATCCTTTAACAACAACACATAATGTCACTCCAACGCCAGATTCA | GTGAGTGT | GCACTG | STIDDSPVNNIKTVNS |
| | | | | TCCAACGTTGTACTACTAATACAAAAGATCCGTGAATCTGTAGATTCCAT | TACGTCCA | TTTGCTT | DSIFAPISRDEIKLALS |
| | | | | TGTAAAAATAACGAACCTCAAATTGAACACGAATATGCTGAACGCAGCA | GAATGACC | CAGAGA | NTKKDSAAGPDAVTI |
| | | | | AGTGCGTTCATTAATCAAAATAACAACATGGATCCACTTGAACTATCTAT | CACCAGTG | AACCAC | KEAKAIIDNLYVAYNI |
| | | | | GCGTGGTATCGAAGAGGATGTGAAGGCAATTCGAGACAAAGAACTTCA | GTTAGTTC | TGTTCAT | WLGVQGIPEQLKLNK |
| | | | | GAAACCAACCAGGAACGTTCCTTCTTCAACAACTTCGAGAAAGCCAACT | TACGTTGC | ATAGTG | TILIPKGNSDLSLLKN |
| | | | | CGAAATGCCAAAAGGCTTGAGAAATCAAAAAAATATGGCTATTATCAAC | CCTGGAAA | AAGTTC | WRPITISSIILRVYNRL |
| | | | | ATCTGTACTATAATAACAAGAAAAAATTAGTAGCGGAAATCCTCGATGG | GGAGAAA | CTCAGTT | LAYRMNKIFKTNDKQ |
| | | | | CGAAACAAGTGGTGCTAAGCCACCTCCAATGAACCTGGTTGAAGATTAT | AGTTGAGC | TTCTGTT | VGFKPVNGCGINISW |
| | | | | TATAGAAATATTTGGTCACGTTCTACTATTGATGATTCGCCTGTTAACAA | TAAAATCG | GATATA | LHSLLKHARLNKNSIY |
| | | | | TATTAAAACCGTTAATAGTGACTCTATATTTGCTCCAATTTCGCGTGATG | CACGGCCT | TTCTTCT | ACLVDVSKAFDSVSH |
| | | | | AAATCAAATTAGCATTATCAAATACGAAAAAGGATTCAGCAGCTGGACC | AGTTGTTT | TTCATTC | QSIVRALTMNGAPSL |
| | | | | TGACGCTGTAACAATAAAAGAAGCAAAAGCTATTATTGACAATCTTTAT | ATCAAATA | TCGCTTC | LVKLIMDQYTNVNTV |
| | | | | GTTGCATATAATATATGGCTAGGTGTTCAAGGAATTCCTGAACAACTGA | GGCACGGT | TCCTTTT | ITCSGSISNKINISSGV |
| | | | | AATTGAATAAAACTATCTTAATTCCAAAAGGAAATTCCGATCTTAGTCTA | GAGGAACT | CTACTGT | KQGDPLSSLLFNLVID |
| | | | | CTGAAAAACTGGCGACCTATTACAATCTCGTCTATTATCCTAAGAGTATA | CTTCTATG | GTTCTTT | ELFDVIKDQYGYTIDN |
| | | | | CAACAGATTATTAGCATACAGAATGAACAAGATCTTTAAAACTAATGAT | TACCCTGA | TTATCAG | IGTTNARCFADDLTLI |
| | | | | AAACAAGTTGGATTCAAACCTGTTAATGGTTGTGGTATTAATATATCTTG | CTAAAGTA | TTTTTG | SSSRMGMNKLLELTT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCTTCACTCTCTCTTGAAGCATGCACGCTTAAACAAAAATTCAATATATG<br>CTTGTCTTGTCGATGTGTCTAAAGCCTTTGATTCTGTGTCACATCAATCAA<br>TAGTAAGAGCTCTCACAATGAATGGTGCACCATCCTTGCTAGTGAAATT<br>AATAATGGATCAATATACGAATGTAAATACTGTCATCACATGTTCTGGTT<br>CTATATCAAACAAGATAAATATCTCCAGTGGTGTCAAGCAAGGTGACCC<br>ACTATCTAGCTTGTTGTTCAATCTGGTTATAGATGAACTGTTCGATGTAA<br>TAAAGGACCAATATGGTTATACAATTGATAACATTGGCACCACCAATGC<br>ACGATGCTTCGCCGATGATTTAACACTAATATCATCATCTAGAATGGGTA<br>TGAATAAATTGCTTGAGCTCACCACGAAATTCTTCAAAGAACGTGGACT<br>AAATGTAAACCCATCAAAGTGCATGTCTATTGGCATGTCCAAAGGTTAT<br>AAAGGAAAGAAGAGTAAAATCGAATCTGAACCACTCTTCTCTATCACCG<br>ATGCTCAGATACCGATGTTGGGCTATATTGATAAGACAACTCGATATCTC<br>GGTGTAAATTTCACATCTATTGGTGCCATTGATGCAAAAAGAATCAAAA<br>AAGACCTTCAGGACACACTCGATAAGCTTGAACATCTTAAACTCAAAGC<br>TCAGTGCAAAATGGATCTCTTACGAACTTATATGATACCAAGATTCATGT<br>TTCAATTAATTCATACTGAGTTATATCCGAAATTGCTTATTAAAATGGAC<br>ATCTTAATTAGGAAATTAGCTAAACGAATCCTACATCTGCCCATATCAAC<br>GAGTAGTGAATTCTTTTACTTACCCTTCAAAGAAGGAGGTCTTCAACTAA<br>CCTCACTTAAAGAAGCAGTTGGTTTAGCCAAAATAAAATTACACAAGAA<br>GATAATGTCCAGTAATGATCCAATGTTATGCTACTTGATTGAGAGCCAG<br>AGGAGCCGTATTGTCGAACATTTTATGAAAGACCTTAAACTTGGAGATT<br>CTTTAACATTAAACGAAATGAATAACATCAAAGAGTGCTTCATGAAAGA<br>AAAAAGAATCTCATTTGCTCAAAAAATTCACGGTGTCGGCTTCGAAGTA<br>TTCTCATCAAGTCCTTTGACGAACCAATGGATTAATGGCGAAATTAAGA<br>CAATGACAACTAAAACATACATTAACTCAATTAAACTTAGAACAAATACT<br>CTAGAAACTCGGGTAACAACATCTCGGGGACTGAACATCATAAAAACAT<br>GTAGAAGATGCCACGTAGCTGACGAAAGTCTCATGCATGTGCTCCAATG<br>TTGCTCTTCTACCAAAGGTTTACGATACTCTCGTCATCACAAAATATGTG<br>CCAAAGTAGCAAATAAATTGGTAATGAATGGTTATGGTGTATTTCGTGA<br>GAAGAGTTATCCAGATCCAAACAACTCAGGTTCATACCTTCGACCGGAT<br>ATAATTGCAGTAAAAAATGGTCATGTTATTGTTCTTGATGTAACGGTTGT<br>GTACGAAGTAACTGGTGCTACGTTTATTAATGCCTACCAAACAAAAATA<br>AATAAATATAATGCGATTATGGTACAAATCGAGCAAATGTTCAATTGTG<br>TTAATGGTGAATTGCATGGTCTAGTAATTGGATCACGTGGTTCAATTCAT<br>CACAGTCAACTCCACATCTGGCATCAAATGGGATTCTCTTCCATAGAACT<br>TAAATATGTGGCTATAGGATGCATGGAGGATTCGCTCAGAATCATGTCC<br>ACATTCTCAAAAGCTATCACATGAACTAGTCTCCTTCTTCTATTAGTCAGT<br>CTAATTAATTTTTCTTACATTCTACATCTAGTTCCATTATTAAATTGGTATG<br>ATCAGTGCTATCTCTGCTACACTCAATGCTTAATCGTATGTTATTGACAG<br>TCTGACACTTGATTACTCTTACGACATATGCACTGTTTGCTTCAGAGAAA<br>CCACTGTTCATATAGTGAAGTTCCTCAGTTTTCTGTTGATATATTCTTCTT<br>TCATTCTCGCTTCTCCTTTTCTACTGTGTTCTTTTTATCAGTTTTTTGTGGA<br>AAAATTGAGAATAAATAAAGT (SEQ ID NO: 1025) | CTCACTTG<br>TGCGCTGG<br>GTTTGCTC<br>CCCCTCGC<br>ATTGACTT<br>ATCTGATC<br>GCACTACC<br>CACCAAAC<br>GAAACATA<br>AACTTAGC<br>TCGTGGTA<br>TCAGTCCA<br>CAGCGTGT<br>GCAGTCGG<br>ATTCAGGG<br>GAGCGTGT<br>TAGTGACA<br>AGCAGGAT<br>AATATTAA<br>CATAGTTA<br>ATGTTAAG<br>GCGTTCAA<br>CATTCCTT<br>ATCCAATT<br>GGAAGAG<br>TTGACTGT<br>GAAGTTTG<br>TCATGAAG<br>ACATTGGA<br>CAA (SEQ<br>ID NO:<br>1148) | TGGAAA<br>AATTGA<br>GAATAA<br>ATAAAG<br>T (SEQ ID<br>NO:<br>1271) | KFFKERGLNVNPSKC<br>MSIGMSKGYKGKKS<br>KIESEPLFSITDAQIPM<br>LGYIDKTTRYLGVNFT<br>SIGAIDAKRIKKDLQD<br>TLDKLEHLKLKAQCK<br>MDLLRTYMIPRFMF<br>QLIHTELYPKLLIKMDI<br>LIRKLAKRILHLPISTSS<br>EFFYLPFKEGGLQLTS<br>LKEAVGLAKIKLHKKI<br>MSSNDPMLCYLIESQ<br>RSRIVEHFMKDLKLG<br>DSLTLNEMNNIKECF<br>MKEKRISFAQKIHGV<br>GFEVFSSSPLTNQWI<br>NGEIKTMTTKTYINSI<br>KLRTNTLETRVTTSRG<br>LNIIKTCRRCHVADES<br>LMHVLQCCSSTKGLR<br>YSRHHKICAKVANKL<br>VMNGYGVFREKSYP<br>DPNNSGSYLRPDIIAV<br>KNGHVIVLDVTVVYE<br>VTGATFINAYQTKINK<br>YNAIMVQIEQMFNC<br>VNGELHGLVIGSRGSI<br>HHSQLHIWHQMGFS<br>SIELKYVAIGCMEDSL<br>RIMSTFSKAIT (SEQ<br>ID NO: 1393) |
| R2 | R201 | LC349444 | *Oryzias latipes* | CGCACAGGGGACACAGAGCCTGCCCAAGTACCGCTCCCGAGGGAGCGG<br>GAAACGGGGGGGTGACTATCCCCTGGGGTCCGGCGAGAGCGCTGGTCT<br>ACGGACCAGGGGTGGCTGTGGGCAGGCTGCTCCTCAGGCCAGTTGATT<br>AGTTACGCATGGGCTGTACCTCCACGTGGTCCCGCTGGTAACGACTTGT<br>CGGCTAAATCAGCCCGCCCACCATCTGGGATATGGTTGACCGTCTAACC | CGCACAGG<br>GGACACA<br>GAGCCTGC<br>CCAAGTAC<br>CGCTCCCG | GGGGGA<br>CAGCTG<br>GGAGTC<br>TCGGCA<br>TGATTAC | MGTDTVYVGQDYPS<br>GLSKRVPARLVAGP<br>MLRERSCHAHVFRA<br>GHMWNWRTSLPSG<br>RWDQPALEKSRVLTR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCAGTACTCAGGTCACAAACAAAATGGGAACAGATACAGTGTATGTCG | AGGGAGC | AAATCTT | SVATATDPEITSYPGK |
| | | | | GCCAGGACTACCCTTCTGGCTTATCAAAACGGGTACCAGCACGGTTAGT | GGGAAAC | GCGCTG | SVSTSTQVQEEDWC |
| | | | | GGCGGGACCGATGCTGCGAGAGCGAAGCTGTCACGCCCATGTGTTTAG | GGGGGGG | CACTCG | SRESGWISPGLAPEE |
| | | | | GGCTGGACACATGTGGAACTGGCGAACCAGCCTTCCGAGCGGGCGCTG | TGACTATC | GATGTC | PSVVSEITASMVATM |
| | | | | GGACCAGCCCGCTTTGGAGAAGTCTCGGGTCCTAACCCGGTCGGTGGC | CCCTGGGG | GTCCCC | RVATEEVVLEPQPEQ |
| | | | | GACGGCCACCGACCCCGAAATTACCTCTTACCCAGGAAAGTCCGTATCG | TCCGGCGA | GTGACG | VVTILPEHGRNVPPG |
| | | | | ACAAGTACGCAGGTTCAGGAGGAGGACTGGTGTAGCCGGGAGAGCGG | GAGCGCTG | GACACA | LAEQDTASPIEVSVLL |
| | | | | GTGGATCTCGCCAGGACTTGCTCCTGAAGAACCCTCGGTGGTGTCCGAA | GTCTACGG | TTAATCC | PDLAENCPLCGVPSG |
| | | | | ATTACAGCCTCCATGGTAGCGACAATGAGGGTAGCAACCGAGGAGGTC | ACCAGGG | GGAAAG | GLRLLGKHFAVRHAG |
| | | | | GTGCTGGAACCACAGCCTGAACAGGTCGTCACAATACTGCCGGAGCAT | GTGGCTGT | CGAGTG | VPVTYECRKCAWRSP |
| | | | | GGTCGAAACGTTCCTCCGGGGCTGGCAGAACAGGACACCGCCAGCCCC | GGGCAGG | GTGACT | NSHSISCHVPKCRGR |
| | | | | ATAGAAGTCTCGGTGCTCCTCCCAGACCTCGCTGAGAACTGCCCATTGT | CTGCTCCT | CGCCTC | ARMPSGDPGIACDLC |
| | | | | GTGGCGTGCCGAGCGGGGGCCTACGCTTGCTCGGGAAGCATTTTGCTG | CAGGCCAG | AAG | EARFATEVGVAQHK |
| | | | | TCCGACATGCGGGGGTGCCTGTAACGTATGAGTGCCGTAAGTGTGCGT | TTGATTAG | (SEQ ID | RHVHPVEWNKVRLE |
| | | | | GGCGGAGCCCCAACAGCCACTCAATCTCGTGTCACGTCCCCAAATGCCG | TTACGCAT | NO: | RRGARGGGIKATKL |
| | | | | GGGGCGTGCGCGGATGCCCAGTGGCGATCCAGGGATCGCCTGCGATCT | GGGCTGTA | 1272) | WSVAEVETLIRLIREH |
| | | | | CTGTGAAGCCCGGTTTGCCACGGAGGTTGGGGTCGCCCAACACAAGCG | CCTCCACG | | GDSGATYQLIADELG |
| | | | | GCACGTTCATCCGGTGGAGTGGAACAAGGTGAGGCTGGAAAGGAGAG | TGGTCCCG | | RGKTAEQVRSKKRLL |
| | | | | GTGCGCGCGGAGGGGGAATTAAGGCGACGAAGCTCTGGAGTGTAGCG | CTGGTAAC | | RIDTASNSPDDAEVE |
| | | | | GAGGTAGAGACGCTAATCCGGCTCATCCGTGAGCACGGAGATTCAGGT | GACTTGTC | | EERLESLAVRSSSRSP |
| | | | | GCCACTTACCAGCTCATTGCCGATGAGCTGGGAAGGGGCAAGACGGCC | GGCTAAAT | | PSLVATRVREAVARG |
| | | | | GAACAGGTGAGGAGTAAAAAGAGGCTCCTGCGCATAGATACGGCAAGC | CAGCCCGC | | ESEGGEEIRAIAALIRD |
| | | | | AATAGCCCAGATGATGCAGAGGTTGAGGAGGAGAGGTTGGAATCTCTG | CCACCATC | | VDQNPCLIETSASDIIS |
| | | | | GCGGTTCGGTCCTCGTCACGGTCACCCCCGAGCCTGGTGGCGACCAGG | TGGGATAT | | KLGRRVDGPKRPRPV |
| | | | | GTCAGGGAGGCAGTTGCCAGGGGTGAATCAGAAGGTGGCGAGGAGAT | GGTTGACC | | VREQTQEKGWVRRL |
| | | | | CAGGGCTATTGCTGCTCTCATTAGGGACGTAGATCAGAATCCTTGTCTG | GTCTAACC | | ARRKREYREAQYLYS |
| | | | | ATTGAAACCTCGGCGTCGGACATCATCTCGAAGCTGGGAAGGAGGGTG | CCAGTACT | | RDQARLAAQILDGAA |
| | | | | GATGGGCCCAAGAGACCCAGGCCCGTTGTCAGAGAACAGACCCAAGAG | CAGGTCAC | | SQECALPVDQVYGAF |
| | | | | AAGGGATGGGTAAGGCGGCTTGCCCGGCGGAAAAGGGAGTACAGAGA | AAACAAA | | REKWETVGQFHGLG |
| | | | | AGCGCAGTACCTGTACTCAAGGGATCAAGCAAGGCTGGCGGCCCAGAT | (SEQ ID | | EFRTGARADNWEFY |
| | | | | CCTCGATGGTGCCGCCAGCCAGGAATGCGCCCTCCCGGTGGACCAGGT | NO: 1149) | | SPILAAEVKENLMRM |
| | | | | CTACGGAGCGTTCCGTGAGAAATGGGAAACCGTAGGGCAGTTCCACGG | | | ANGTAPGPDRISKKA |
| | | | | ACTTGGTGAGTTCCGGACGGGTGCACGCGCAGACAACTGGGAGTTCTA | | | LLDWDPRGEQLARLY |
| | | | | CTCTCCAATTCTGGCGGCTGAGGTGAAAGAAAACCTAATGAGAATGGCT | | | TTWLIGGVIPRVFKEC |
| | | | | AACGGCACGGCCCCGGGACCAGACAGGATAAGCAAAAAGGCTCTGCTT | | | RTKLLPKSSDPVELQD |
| | | | | GACTGGGACCCCCGGGGTGAGCAACTGGCACGGCTGTACACGACGTGG | | | IGGWRPVTIGSMVT |
| | | | | CTGATCGGTGGGGTCATACCAAGGGTCTTCAAGGAGTGCAGGACTAAG | | | RLFSRILTMRLTRACP |
| | | | | CTGCTACCGAAATCCAGCGACCCGGTCGAGTTGCAGGACATCGGTGGA | | | INPRQRGFLASSSGC |
| | | | | TGGAGGCCGGTGACGATTGGGTCGATGGTGACTAGGCTGTTCAGTCGG | | | AENLLIFDEIVRRSRR |
| | | | | ATTCTAACGATGAGGCTAACCCGAGCCTGTCCGATCAATCCGAGGCAGC | | | DGGPLAVVFVDFAR |
| | | | | GCGGTTTCTTGGCCTCCTCGAGTGGATGCGCGGAAAACCTGTTGATCTT | | | AFDSISHEHILCVLEE |
| | | | | TGACGAGATCGTCAGGCGCTCGAGGCGGGACGGGGGGCCGCTGGCAG | | | GGLDRHVIGLIRNSYV |
| | | | | TGGTGTTTGTGGACTTTGCGAGGGCCTTTGACTCCATCTCACATGAACAT | | | DCVTRVGCVEGMTP |
| | | | | ATCCTGTGTGTTCTCGAAGAAGGCGGGCTTGACAGGCACGTTATCGGGT | | | PIQMKVGVKQGDP |
| | | | | TGATCCGAAACTCGTACGTGGATTGCGTGACCAGGGTGGGTTGTGTCG | | | MSPLLFNLAMDPLIH |
| | | | | AGGGCATGACACCACCAATACAAATGAAGGTTGGAGTGAAGCAGGGA | | | KLETAGTGLKWGDLS |
| | | | | GACCCCATGTCCCCCTTGCTCTTCAACCTGGCTATGGATCCCCTCATCCAT | | | IATLAFADDLVLVSDS |
| | | | | AAACTCGAGACGGCCGGAACTGGACTGAAATGGGGCGATCTTTCAATC | | | EEGMGRSLGILEKFC |
| | | | | GCCACGCTGGCCTTTGCCGACGATCTGGTGCTGGTGAGTGACTCTGAGG | | | QLTGLRVQPRKCHGF |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AAGGCATGGGGAGGAGTCTCGGGATTTTGGAGAAGTTTTGCCAACTGACTGGGCTGAGGGTTCAGCCCAGGAAGTGTCACGGTTTCTTTATGGACAAGGGCGTGGTGAACGGCTGTGGAACCTGGGAAATCTGTGGGTCACCGATCCACATGATTCCCCCGGGGGAATCAGTTCGTTATTTGGGAGTCCAGGTAGGCCCGGGGCGCGGCGTGATGGAACCGGATCTTATCCCTACGGTCCACACGTGGATCGAAAGGATCTCGGAGGCTCCTCTAAAGCCCTCACAACGCATGAGGGTTTTGAACTCATTCGCTCTCCCCCGGATAATTTACCAGGCCGATCTAGGGAAGGTTACGGTAACCAAATTGGCCCAGATAGATGGGATTGTCCGGAAGGCTGTGAAGAAGTGGCTCCATTTGTCACCATCCACGTGCAATGGACTGCTGTATTCACGGAACCGCGACGGTGGTTTGGGCCTCCTAAAGCTGGAAAGACTAATCCCATCCGTGCGCACGAAGCGTATCTATCGGATGTCCAGGTCTCCGGATATCTGGACACGGCGAATGACCAGCCATTCTGTGTCAAAATCTGACTGGGAGATGTTGTGGGTCCAAGCGGGAGGTGAGAGGGGCAGTGCACCTGTAATGGGTGCCGTGGAGGCTGCCCCGACCGATGTGGAGAGATCGCCAGACTACCCAGACTGGCGGCGTGAGGAAAACCTGGCATGGTCGGCCCTGCGGGTGCAGGGTGTGGGTGCAGACCAGTTTCGAGGCGACAGGACCAGCAGCTCTTGGATCGCCGAGCCCGCTTCGGTTGGGTTCGCGCAGCGCCACTGGTTGGCTGCCCTGGCGCTGAGGGCTGGGGTGTATCCGACTCGGGAGTTTCTGGCTCGGGGTAAGGAAAAGTCAGGAGCAGCTTGCAGACGCTGCCCGGCCAGGTTGGAATCATGTTCACACATACTTGGGCAATGTCCGTTCGTTCAGGCGAACAGAATTGCGAGGCACAACAAGGTGTGTGTGCTCTTGGCCACGGAGGCGGAGAGGTTCGGCTGGACGGTAATAAGGGAGTTCCGTCTTGAGGACGCCGCTGGCGGTCTCAAGATACCCGACCTGGTTTGCAAGAAGGCCGACACAGTTCTCATTGTCGACGTGACCGTCCGGTACGAGATGGATGGAGAGACGCTAAAAAGGGCCGCATCGGAGAAGGTGAAACACTATCTCCCAGTAGGGCAACAGATAACGGACAAGGTCGGAGGGCGTTGCTTTAAAGTCATGGGGTTCCCTGTAGGTGCTAGGGGAAAGTGGCCGGCGAGCAACAACACAGTTTTGGCTGAGTTAGGCGTCCCTGCAGGTCGGATGAGGACCTTTGCCAGGCTGGTGAGCCGGAGGACTCTTCTTTATTCTTTGGATATATTGAGGGACTTCATGCGTGAGCCGGCCGGCAGGGGAACTCGGGTTGCTCTCATCCCTGCGGCAACGGGTGCCGCGAATTGAGGGGGACAGCTGGGAGTCTCGGCATGATTACAAATCTTGCGCTGCACTCGGATGTCGTCCCCGTGACGGACACATTAATCCGGAAAGCGAGTGGTGACTCGCCTCAAG (SEQ ID NO: 1026) | | | FMDKGVVNGCGTWEICGSPIHMIPPGESVRYLGVQVGPGRGVMEPDLIPTVHTWIERISEAPLKPSQRMRVLNSFALPRIIYQADLGKVTVTKLAQIDGIVRKAVKKWLHLSPSTCNGLLYSRNRDGGLGLLKLERLIPSVRTKRIYRMSRSPDIWTRRMTSHSVSKSDWEMLWVQAGGERGSAPVMGAVEAAPTDVERSPDYPDWRREENLAWSALRVQGVGADQFRGDRTSSSWIAEPASVGFAQRHWLAALALRAGVYPTREFLARGKEKSGAACRRCPARLESCSHILGQCPFVQANRIARHNKVCVLLATEAERFGWTVIREFRLEDAAGGLKIPDLVCKKADTVLIVDVTVRYEMDGETLKRAASEKVKHYLPVGQQITDKVGGRCFKVMGFPVGARGKWPASNNTVLAELGVPAGRMRTFARLVSRRTLLYSLDILRDFMREPAGRGTRVALIPAATGAAN (SEQ ID NO: 1394) |
| R2 | R2_LP | AF015814 | *Limulus polyphemus* | TGGGAGGAGACCCAAACTATCCTAGGATGGGGCGGAACCGACCATATGAGCCATATTAACATTGCCCACACTATCCTCTGGAGGTACCTCCTCGTGGTACGGCTGGATATAGGTAAATCCTGTAACCAAATCCTCCAACCCGTGAAGGAGAACACTAAAACCCATATAGTGGCCTCGCCAACCACTATATGTCCAACGGCAGGAGAAGCTATCTCCCGGATGGGAAGGAAAACCCTAAACCGTGATGGGAACTTACCGGCCCCATCAGCTATTGGGTACCCGGTAGGGACTTGCAACCCTACCCTGTATTTGCATTTTATAGGGAACCGGTCGGCCCTATATCAGAGTAGACCGTTTATTAAATATGGGTGAAAATATTAACAGTAAAAGCTATGGTTTGGCGTCCGTGTGGTGCCAGGGCGGCGGCCAAACCCGAGCTACTTGGCACCAACTGGGGATGGTAGCTTCCGAGCGATTCCCTGGCGACGTGGGACCGATCGACGATGGAGTCCAAACATCCGGAATAGAGGAATTGAGAAATACCTATTCCACCACCGGCTCACATACCCAAGGTGAACCCGGTGCAACTAGAGTACAACCTATCTGTGGCGGTAGGTGCCGAACCACTCAGGTGACGGGCTTGTTTATTGATGTCTCCCTACGAGACACGAATTGTGACAAATCC | TGGGAGGAGACCCAAACTATCCTAGGATGGGGCGGAACCGACCATATCCTGGAGGTACCTCCTCTGGATA | ATTTGTCTCTTTCCCAATGATGTCTACTAGCACGCTGCCGAAGCTAGATAGATTGAGGAATCTGCGTAATCTGTAATGATTACGCC | GIDGYMFGYARASGSTSVSIQSSSMTEGETNERATPRASDSSSVSIQSSCVTEGECLPPTDNCNPSVENQLPCVTEGRFERVGSLVTVRLPFRKVACDLCSKEFLTYSKFAVHQANFHNSETQACCTYCGKSDGNHHSIACHVPKCPWRRTVTFAANLSNFLCDLCNDSFKTKSGLSQHKRHKHPCSRNAERILSLGVRTPSARPRQVVWS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACTCCGGTGGACAATTACCCGATCTATGAACCTGTTACCGATATTAGACA | TAGGTAAA | TCATGG | EEETRTLREVEVVYSG |
| | | | | AGAAAATAAAGAACTGACAACGCCTAGAGCTTCAGGCAGCATGTCTGTA | TCCTGTAA | GCATCT | QKNINVLCAGHLPGK |
| | | | | AGTATCCAGTCATCGAGCGTGACTGAGGGCGAAATTGATAATAACTCTG | CCAAATCC | ATCGGT | TSKQVSDKRRDLHRI |
| | | | | AAACTGAGGAATTGACGGATATATGTTTGGCTACGCTAGAGCTTCAGGC | TCCAACCC | AGCGTC | RSSNVHGTPTTQSRG |
| | | | | AGCACGTCTGTAAGCATCCAGTCATCGAGCATGACTGAGGGCGAAACTA | GTGAAGG | GACCCT | DPVEQVEEYEELDWE |
| | | | | ACGAAAGGGCCACGCCTAGAGCTTCAGACAGCTCGTCTGTAAGCATCCA | AGAACACT | GACGTT | GMHPFPDPDSKFCSY |
| | | | | GTCATCGTGCGTGACTGAGGGTGAATGTCTACCTCCTACAGACAACTGC | AAAACCCA | AAATTG | LDQLRDQKGLTEPV |
| | | | | AACCCGTCTGTAGAGAACCAGTTACCGTGCGTAACTGAGGGTAGGTTTG | TATAGTGG | GGTAAT | WQEIEIVAQEWVEN |
| | | | | AACGGGTAGGCTCACTGGTGACGGTGCGTCTGCCCTTCAGAAAGGTGG | CCTCGCCA | AAGAAA | LAHVQSSWNHERTT |
| | | | | CATGTGACTTGTGTTCTAAAGAGTTCTTGACATATTCGAAGTTTGCAGTC | ACCACTAT | TATCGA | KQVPENNTPARRPFK |
| | | | | CACCAGGCAAACTTCCACAATTCAGAAACTCAGGCATGCTGCACATATT | ATGTCCAA | (SEQ ID | RRLHRVERYKRFQR |
| | | | | GCGGTAAAAGTGATGGCAATCATCACTCTATAGCCTGTCACGTTCCGAA | CGGCAGG | NO: | MYDLQRKRLAEEILD |
| | | | | ATGTCCCTGGCGGCGAACTGTTACGTTTGCTGCGAACTTAAGCAATTTCT | AGAAGCTA | 1273) | GREAVTCNLKKEEIK |
| | | | | TGTGTGATCTTTGCAATGATAGTTTTAAGACCAAATCAGGGCTTTCGCAA | TCTCCCGG | | DHYDQVYGVSNDRV |
| | | | | CATAAGCGTCATAAGCATCCTTGTTCAAGGAATGCTGAACGCATCCTTTC | ATGGGAA | | SLDDCPRPPGANNT |
| | | | | TCTTGGAGTCAGGACGCCGTCGGCCCGCCCTCGCCAGGTAGTGTGGTCC | GGAAAACC | | DLLKPFTPTEVMDSL |
| | | | | GAAGAAGAAACACGAACCCTCCGGGAAGTGGAAGTAGTGTATTCGGGC | CTAAACCG | | QGMKNGAPGPDKIT |
| | | | | CAAAAGAACATTAATGTCCTCTGTGCGGGGCATCTACCTGGTAAGACTT | TGATGGGA | | LPFLQKRLKNGIHVSL |
| | | | | CCAAACAGGTCTCGGACAAGCGCCGAGACTTGCACAGGATACGGTCTTC | ACTTACCG | | ANVFNLWQFSGRIPE |
| | | | | TAACGTACATGGTACACCCACCACTCAGAGTCGTGGAGATCCTGTTGAA | GCCCCATC | | CMKSNRSVLIPKGKS |
| | | | | CAGGTCGAGGAGTACGAGGAGTTGGACTGGGAAGGAATGCATCCTTTT | AGCTATTG | | NLRDVRNWRPITISSI |
| | | | | CCCGACCCTGACTCTAAGTTTTGCTCGTACCTTGATCAGCTGAGAGATCA | GGTACCCG | | VLRLYTRILARRLERA |
| | | | | GAAGGGACTCACTGAACCGGTATGGCAGGAGATCGAAATCGTGGCACA | GTAGGGA | | VQINPRQRGFVPQA |
| | | | | AGAATGGGTAGAAAACCTTGCCCATGTTCAATCGTCTTGGAATCATGAG | CTTGCAAC | | GCRDNIFLLQSAMRR |
| | | | | AGAACAACCAAGCAGGTGCCAGAAAACAATACACCTGCACGAAGACCA | CCTACCCT | | AKRKGTLALGLLDLSK |
| | | | | TTTAAAAGGCGTCTCCATCGTGTGGAACGTTATAAGCGGTTTCAGAGAA | GTATTTGC | | AFDTVGHKHLLTSLE |
| | | | | TGTACGACCTCCAGCGAAAGCGCCTGGCTGAGGAAATACTAGACGGCC | ATTTTATA | | RFAVHPHFVRIVEDM |
| | | | | GGGAAGCCGTCACATGTAACCTCAAAAAGGAGGAGATCAAAGACCACT | GGGAACC | | YSGCSTSFRVGSQST |
| | | | | ATGATCAGGTCTACGGTGTGTCAAATGATAGAGTTTCTCTAGATGACTG | GGTCGGCC | | RPIVLMRGVKQGDP |
| | | | | CCCCAGGCCACCAGGGGCCAATAACACCGACCTCCTGAAACCGTTTACG | CTATATCA | | MSPILFNIALDPLLRQ |
| | | | | CCAACCGAAGTGATGGACTCACTTCAGGGTATGAAGAACGGGGCGCCT | GAGTAGAC | | LEEESRGFMFREGQA |
| | | | | GGCCCTGATAAGATTACCCTACCGTTCCTCCAAAAACGTCTTAAAAATGG | CGTTTATT | | PVSSLAYADDMALLA |
| | | | | CATCCATGTTTCCTTGGCAAATGTGTTTAACCTTTGGCAATTCTCGGGTC | AAATATGG | | KDHASLQSMLGTVD |
| | | | | GCATCCCCGAATGCATGAAGTCAAATAGGTCAGTCCTCATCCCGAAAGG | GTGAAAAT | | KFCSGNGLGLNIAKS |
| | | | | GAAGAGCAATCTGCGGGATGTCAGAAACTGGCGGCCAATCACAATCTC | ATTAACAG | | AGLLIRGANKTFTVN |
| | | | | CTCGATTGTGTTGCGGCTATACACCAGGATCTTGGCACGCCGTCTCGAG | TAAAAGCT | | DCPSWLVNGETLPM |
| | | | | CGGGCGGTGCAGATTAATCCCCGACAGCGAGGCTTCGTCCCTCAGGCTG | ATGGTTTG | | IGPEQTYRYLGASICP |
| | | | | GGTGTAGGGATAATATATTCCTGCTTCAGTCTGCTATGAGGAGGGCTAA | GCGTCCGT | | WTGINSGPVKPTLEK |
| | | | | GCGAAAGGGAACTCTGGCTCTGGGGCTTCTTGACTTGTCGAAGGCATTT | GTGGTGCC | | WIANITESPLKPHQR |
| | | | | GACACAGTTGGTCACAAACATCTTCTGACCAGCCTAGAAAGGTTCGCTG | AGGGCGG | | VDILCKYALPRLFYQL |
| | | | | TCCACCCGCATTTCGTCCGAATTGTGGAGGACATGTACAGTGGTTGTTC | CGGCCAAA | | ELGTLNFKELKELDS |
| | | | | GACGTCCTTTCGAGTAGGCAGCCAGTCTACTCGCCCCATCGTTCTGATGA | CCCGAGCT | | MVKQAVKRWCHLP |
| | | | | GAGGCGTCAAACAAGGGGACCCCATGTCTCCTATATTGTTCAACATCGC | ACTTGGCA | | ACTADGLLYSRHRDG |
| | | | | TCTGGACCCTCTTCTTCGTCAACTGGAAGAGGAAAGCCGAGGCTTTATG | CCAACTGG | | GLAVVKLESLVPCLKI |
| | | | | TTTAGGGAGGGGCAGGCCCCTGTCTCATCTCTAGCATATGCCGATGATA | GGATGGTA | | KTNLRLVHSTDPVISS |
| | | | | TGGCACTACTGGCTAAAGATCACGCCAGTCTTCAGTCGATGTTGGGCAC | GCTTCCGA | | LAESDGLVGAIEGIAQ |
| | | | | TGTGGATAAATTTTGTTCAGGGAACGGACTTGGCCTTAACATCGCCAAA | GCGATTCC | | KAGLPIPTPDQRSGT |
| | | | | AGTGCCGGACTTCTGATTAGGGGAGCGAATAAGACCTTCACTGTCAATG | CTGGCGAC | | YHSNWRDMERRSW |
| | | | | ACTGCCCTTCCTGGCTAGTAAATGGTGAAACGCTCCCGATGATCGGTCC | GTGGGACC | | ERLALHGQGVELFKG |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGAACAAACTTACCGTTATCTTGGGGCAAGCATCTGTCCGTGGACTGGGATAAACAGCGGGCCTGTTAAACCCACCCTGGAGAAATGGATAGCCAATATCACAGAGTCTCCCCTCAAGCCACATCAGAGGGTCGACATACTCTGTAAGTACGCTTTACCCCGGCTGTTTTACCAACTTGAGCTGGGCACTCTGAATTTCAAAGAACTGAAGGAACTAGACAGCATGGTCAAACAAGCTGTCAAACGTTGGTGCCATCTACCTGCCTGTACGGCTGACGGCCTGCTATACTCCCGTCATCGTGATGGGGGTTTAGCTGTAGTAAAATTAGAGTCTCTTGTCCCTTGTCTAAAGATCAAGACAAATCTCAGACTAGTGCATTCGACCGACCCCGTCATATCATCTTTGGCGGAATCCGATGGTTTAGTGGGTGCCATCGAGGGTATTGCTCAAAAGGCTGGGCTTCCGATCCCTACGCCTGACCAGCGATCTGGAACATATCATTCTAATTGGAGAGATATGGAAAGGAGAAGCTGGGAAAGGTTGGCCCTGCACGGGCAAGGTGTGGAGCTCTTCAAAGGCTCAAGATCTGCCAACCACTGGTTGCCTAGGCCAGTTGGTATGAAGCCACACCACTGGGTGAAGTGTCTGGCAATGAGAGCTAATGTATACCCTACAAAAAGAGGCCTCAGTAGAGGGAATCTATCTAAGAACAAAGATTCCGCCAAGTGTCGGGGATGCACATCAATGAGGGAGACCCTATGTCATCTAAGTGGTCAATGCCCGAAATTGAAGTCGATGAGAATAAGGCGCCACAATAAGATCTGTGAGCACTTGATCGCCGAGGCCAGCTTTAAAGGCTGGAAGGTTCTGCAAGAGCCTACCTTGGTTACAGACAATGGTGAACGTCGGCGACCTGATCTGATCTTCCATCGTGATGATAAAGCGGTGGTTGTTGACGTGACGGTTCGCTACGAAATTTCGAAAGACACGTTGAGAGAAGCTTATGCTTCTAAAGTTCGAAGGTATGGATGTTTGACCGAACAAATTAAAGACCTTACAGGGGCTACCTCCGTTGTTTTTCATGGATTTCCAATGGGTGCCCGCGGTGCCTGGTTTCCTGAAAGCTCGGACGTGATGGCCGACCTGAACATTCGGTCAAAATATTTTGAAGAGTTCTTGTGTAGACGCACCATCCTATATACACTGGACTTATTATGGAAATCGAATAACGAACAATATTTAGAAAGGCTTGCACCATAAATTTTGTCTCTTTCCCCAATGATGTCTACTAGCACGCTGCCGAAGCTAGATAGATTGAGGAATCTGCGTAATCTGTAATGATTACGCCTCATGGGCATCTATCGGTAGCGTCGACCCTGACGTTAAATTGGGTAATAAGAAATATCGA (SEQ ID NO: 1027) | GATCGACGATGGAGTCCAAACATCCGGAATAGAGGAATTGAGAAATACCTATTCCACCACCGGCTCACATACCCAAGGTGAACCCGGTGCAACTAGAGTACAACCTATCTGTGGCGGTAGGTGCCGAACCACTCAGGTGACGGGCTTGTTTATTGATGTCTCCCTACGAGACACGAATTGTGACAAATCCACTCCGGTGGACAATTACCCGATCTATGAACCTGTTACCGATATTAGACAAGAAAATAAAGAACTGACAACGCCTAGAGCTTCAGGCAGCATGTCTGTAAGTATCCAGTCATCGAGCGTGACTGAGGGCGAAATTGATAATAACTCTGAAACTGA (SEQ ID NO: 1150) | | SRSANHWLPRPVGMKPHHWVKCLAMRANVYPTKRGLSRGNLSKNKDSAKCRGCTSMRETLCHLSGQCPKLKSMRIRRHNKICEHLIAEASFKGWKVLQEPTLVTDNGERRRPDLIFHRDDKAVVVDVTVRYEISKDTLREAYASKVRRYGCLTEQIKDLTGATSVVFHGFPMGARGAWFPESSDVMADLNIRSKYFEEFLCRRTILYTLDLLWKSNNEQYLERLAP (SEQ ID NO: 1395) |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| NeSL | NeSL-1 | Z82058 | *Caenorhabditis elegans* | GCTCACTTTCTATCGTGTTAACCGTACGTTTACACTCCCAGTGAGTGTAA | GCTCACTT | CCTCCA | MLRRKGRHRMVMV |
| | | | | TAAAGGTTATTCGATAGAGGGTGTCTCCCTCTTTCTTGGGTAATTCTTCG | TCTATCGT | GGGCAC | NSVKWQPSAHAEAI |
| | | | | GCGGTCCGGGGTCTCTCCCTCGTCTTTTTTTAAACTTTTCTTTCTCATCC | GTTAACCG | GCCGCA | GTGKSWAPQRSQAS |
| | | | | ACTCTTTTGCTCCTTTTTACTAACTCTTGTACTCTATAGTCTTTTCTCATCC | TACGTTTA | CGCCAA | EHGWQSNAMFDPP |
| | | | | CCCATCCGCCGTTGGGCAAAGTTTATTTACTTTGTTAAATCCATATTTTAT | CACTCCCA | AAGTCC | NRILFARDSWSLNQS |
| | | | | CTCTCTCACCCGTACAGAAAGCGTCTCCTTCTCAAACGCTTTTCTGTACTT | GTGAGTGT | TGGCAT | THLQNQRSGSGLGIR |
| | | | | TTTCTTATATTTTCATTAACATATTTTTCCTGTTTATACTAACCTAACCTCC | AATAAAGG | AACTCT | PGQVRNNMVGGGP |
| | | | | ATTGTCAATTACTAACTAACTTGTACAACGGATTTCGATGTTGCGCCGAA | TTATTCGA | GCAAAT | HRAGDPKRRVELVSI |
| | | | | AAGGACGTCACCGAATGGTTATGGTCAATTCTGTCAAATGGCAACCCAG | TAGAGGGT | AACATC | QGSEVTVRTIYPSDEI |
| | | | | TGCACATGCTGAAGCAATTGGAACAGGAAAGTCCTGGGCACCACAGCG | GTCTCCCT | AAACGT | FSCYSKSCDIKTKAGY |
| | | | | GTCCCAGGCATCCGAACACGGCTGGCAATCAAATGCAATGTTTGATCCC | CTTTCTTG | CAATCA | GPEDLKHLTRHIKNE |
| | | | | CCCAACAGGATTCTCTTCGCCAGAGACTCATGGTCGCTCAACCAATCAAC | GGTAATTC | ACTCCAC | HGLKARWAYQCGLC |
| | | | | GCATCTTCAAAATCAAAGGAGCGGATCAGGATTGGGTATAAGACCTGG | TTCGGCGG | AAACTCT | NEKSDPSVSEGHKW |
| | | | | TCAGGTAAGGAACAATATGGTGGGGGGTGGGCCTCACAGAGCAGGGG | TCCGGGGT | CCACTCT | MEAHMVAVHQSSA |
| | | | | ACCCAAAGCGTCGTGTCGAGCTGGTCAGCATACAAGGAAGCGAAGTGA | CTCTCCCT | CTTCAA | EKRIKSYQKCTGARV |
| | | | | CCGTCAGAACAATCTACCCGTCGGATGAAATATTCAGTTGTTACTCCAAA | CGTCTTTT | GTCTTCT | AEQLQAAAPSLTVPG |
| | | | | TCATGTGATATCAAAACAAAAGCTGGCTATGGCCCTGAGGACCTAAAGC | TTTAAACT | CGGTGC | KHKSGSRDAAKDSM |
| | | | | ACCTGACTCGTCATATCAAGAACGAGCATGGTCTCAAAGCTCGCTGGGC | TTTCTTTCT | TTCCAAC | TPTKDDDPKTRIYQT |
| | | | | ATATCAATGTGGATTGTGCAATGAGAAGTCGGACCCAAGTGTATCGGA | CATCCACT | ACCACA | RSVVKKSTQKTAEPT |
| | | | | AGGCCACAAATGGATGGAGGCACACATGGTCGCCGTTCACCAAAGCTC | CTTTTGCT | ATGGTG | DEGSRGPKYASIFQKS |
| | | | | TGCGGAAAAAAGGATAAAGTCCTATCAGAAATGCACGGGTGCAAGAGT | CCTTTTTAC | AAAGCT | VKARKSLALLCELSSP |
| | | | | TGCAGAACAGCTACAAGCTGCTGCTCCATCGCTTACTGTGCCGGGGAAG | TAACTCTT | CCTTCAC | KPMNPLPTNELTLKE |
| | | | | CACAAATCAGGCTCTAGAGACGCTGCCAAAGATTCGATGACACCAACAA | GTACTCTA | CTTTTCC | GNSRELAKEEAPSEGI |
| | | | | AGGATGATGACCCGAAAACCAGGATCTATCAGACACGAAGCGTAGTTA | TAGTCTTT | CTCCAA | DDIVIIDLDESEESPPR |
| | | | | AAAAGTCGACTCAGAAAACAGCAGAGCCAACAGATGAAGGGTCTAGAG | TCTCATCC | AATTCTT | RKRFNTWCLDHESSR |
| | | | | GCCCAAAGTACGCATCCATTTTTCAGAAATCCGTCAAAGCAAGGAAGAG | CCCATCCG | CCCATGT | EAWLDDTAIFWYISY |
| | | | | CTTGGCGCTTCTCTGTGAATTAAGCAGCCCTAAGCCTATGAACCCCCTTC | CCGTTGGG | GGGGAA | LCRGSTKYSALDPCL |
| | | | | CTACAAATGAGCTAACTCTGAAAGAAGGGAATTCAAGAGAGCTCGCCA | CAAAGTTT | GTCCTG | WSMYKVKGSRYILDR |
| | | | | AAGAGGAAGCACCATCTGAAGGTATAGACGACATCGTCATCATCGATCT | ATTTACTTT | TTCTTGT | LESSITYFFPICEEDH |
| | | | | GGACGAATCGGAGGAGTCGCCACCCAGAAGGAAACGATTCAACACCTG | GTTAAATC | AAGCTC | WTLLVLKDNSYYYAN |
| | | | | GTGTCTGGATCATGAGTCAAGCCGTGAAGCATGGCTGGATGACACAGC | CATATTTT | TCCGGA | SLHQEPRGPVRDFIN |
| | | | | AATCTTCTGGTACATCTCCTATCTCTGCAGAGGAAGTACAAAGTACTCAG | ATCTCTCT | GGCTGC | DSKRARKEFKVQVPL |
| | | | | CTTTGGACCCATGCCTCTGGAGTATGTACAAAGTCAAAGGCTCAAGATA | CACCCGTA | AAGAGC | QRDSFNCGVHICLM |
| | | | | CATTCTTGACCGCTTGGAAAGCTCCATCACATATTTTTTCCCGATATGCG | CAGAAAGC | AGAAGA | TNSIMAGGKWHSEE |
| | | | | AGGAGGACCATTGGACACTGTTGGTATTGAAAGACAATTCATACTATTA | GTCTCCTT | AATTCTT | DVRNFRKRLKKTLQE |
| | | | | TGCAAACAGTCTGCACCAAGAGCCACGTGGCCCGGTCAGGGACTTCATC | CTCAAACG | CTTTCTG | EGYELYSVNSLGIPFQ |
| | | | | AACGACTCAAAACGGGCTCGGAAGGAGTTTAAGGTGCAAGTACCTCTTC | CTTTTCTGT | ACAAGG | APTTEQMDYKETRCK |
| | | | | AAAGAGACTCCTTTAACTGTGGAGTGCACATCTGTCTAATGACCAACTC | ACTTTTTCT | TCAGAA | RSYASVLTQISPPAKR |
| | | | | GATTATGGCAGGAGGCAAATGGCACTCTGAAGAAGACGTCAGAAACTT | TATATTTTC | GGAAGT | PDCKPDNNIFVPTKD |
| | | | | CAGAAAAAGACTGAAGAAGACACTCCAGGAAGAAGGCTATGAGCTTTA | ATTAACAT | CCTGTTC | CAAEGNPQEKGRNE |
| | | | | CTCGGTCAATAGTCTGGGTATACCATTCCAAGCCCCAACGACTGAGCAA | ATTTTTCCT | TTGAGG | SPEEINTEHIVVAGKP |
| | | | | ATGGACTACAAAGAAACAAGATGCAAAAGAAGCTATGCCAGTGTTCTTA | GTTTATAC | CGTCCAT | ANNISPRCRSTSEML |
| | | | | CTCAAATAAGCCCGCCGGCCAAAAGGCCGGACTGCAAACCTGACAACA | TAACCTAA | CCCGGG | FEMVKATTSSGRSSL |
| | | | | ACATATTCGTACCAACCAAGGATTGTGCTGCCGAAGGTAACCCGCAGGA | CCTCCATT | CGTCAT | GTMTQDEFIRTSTIAE |
| | | | | AAAAGGCCGAAATGAATCTCCTGAAGAGATCAATACGGAACATATCGTC | GTCAATTA | AGGAGA | AVPLMSIKLPPMELP |
| | | | | GTCGCAGGAAAACCTGCAAACAACATCAGTCCAAGGTGTCGGAGCACC | CTAACTAA | GATCAG | RKILPPIPPRKPTQTN |
| | | | | TCGGAAATGCTGTTTGAGATGGTGAAAGCCACAACCAGCAGTGGAAGA | CTTGTACA | ATGCAC | GGQKGKQQRVPTGK |
| | | | | AGCAGCTTGGGCACCATGACGCAGGATGAGTTCATCCGAACCAGCACA | ACGGATTT | CTTCTAG | PDTLNAKVRNWENN |
| | | | | ATCGCCGAGGCAGTTCCCCTAATGAGCATAAAACTCCCACCAATGGAGT | CG (SEQ ID | CAGGAG | QLESYAMEGRSFQRL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGCCAAGGAAAATTCTGCCACCAATTCCCCCCAGAAAACCAACCCAAAC | NO: 1151) | CTAGAA | EWLTEVLTASIQKAA |
| | | | | CAATGGAGGTCAAAAGGGAAAGCAACAGAGGGTGCCTACAGGAAAAC | | GGGCTG | AGDEGIVDIICKRNPP |
| | | | | CAGACACCCTAAATGCTAAAGTCCGGAACTGGTTCAACAACCAACTTGA | | CCCTGTC | LEVAKGEMCTQTEN |
| | | | | GTCGTATGCGATGGAGGGTCGCAGCTTCCAACGACTGGAATGGCTGAC | | TTGAGA | KRKTTNNAARIADPI |
| | | | | GGAAGTACTCACTGCGTCGATACAAAAGCAGCAGCAGGTGATGAAGG | | TCCCCAC | QSSKGAGDVKASYW |
| | | | | AATAGTTGATATTATTTGCAAACGGAACCCGCCACTTGAAGTTGCGAAG | | GGGGGT | KERARTYNRIIGSKEE |
| | | | | GGTGAAATGTGCACCCAGACCGAAAACAAAAGGAAAACGACCAACAAT | | CAATAG | LCKIPIDQLEDFFKKST |
| | | | | GCAGCAAGAATTGCGGACCCAATCCAGAGCAGCAAGGGAGCTGGTGAT | | ACGGGA | SRTNVQESIMKEKSS |
| | | | | GTGAAGGCATCGTACTGGAAAGAAAGGGCTCGCACTTACAACAGGATT | | GGGGCT | KIPALKIGNWMEKKF |
| | | | | ATTGGTAGCAAGGAGGAACTCTGCAAAATTCCCATCGATCAACTGGAGG | | GCTGGC | IGKEVAFALRKTKDTA |
| | | | | ATTTCTTCAAGAAATCCACGTCCCGCACCAACGTGCAGGAGTCGATCAT | | TTTCTCT | QGADGLRYHHLQWF |
| | | | | GAAGGAGAAAAGCTCCAAAATTCCTGCTCTCAAGATAGGTAACTGGATG | | TTTTAAG | DPSGELLAKVYNECQ |
| | | | | GAGAAGAAGTTTATCGGAAAGGAGGTGGCGTTCGCTCTGCGGAAAACA | | AGGAAG | RHRKIPKHWKEAETIL |
| | | | | AAAGACACCGCGCAGGGTGCAGACGGACTGCGATACCACCACCTTCAA | | CACCAA | LFKNGDQSKPENWR |
| | | | | TGGTTTGATCCCAGTGGTGAGTTATTGGCGAAGGTATATAACGAGTGCC | | TCCGGA | PISLMPVIYKLYSSLW |
| | | | | AACGACACAGGAAGATCCCAAAACACTGGAAGGAGGCCGAGACCATCT | | GATCCTT | NRRIRAVPNVLSKCQ |
| | | | | TGCTGTTCAAAAATGGAGATCAGTCAAAACCAGAAAACTGGCGCCCAAT | | AGGGGT | RGFQEREGCNESLAIL |
| | | | | TAGCCTGATGCCTGTGATCTACAAACTTTACTCCAGTCTGTGGAACCGGA | | CAAAGG | RTAIDVAKGKRRNLA |
| | | | | GAATTAGAGCTGTACCAAATGTGTTGAGCAAATGTCAGCGAGGGTTCCA | | ATTAAA | VAWLDLTNAFGSIPH |
| | | | | GGAGCGCGAAGGTTGCAATGAGAGTCTAGCAATACTCAGAACAGCAAT | | AGGCAG | ELIEYALTAYGFPQM |
| | | | | CGACGTGGCCAAAGGAAAACGAAGAAACCTGGCGGTGGCATGGCTGG | | CAGGTC | VVDVVKDMYQGAS |
| | | | | ATCTGACGAACGCGTTTGGATCCATCCCGCACGAATTGATTGAGTACGC | | CAATTCT | MRVKNATEKSDRIPI |
| | | | | GCTGACAGCGTATGGATTTCCGCAAATGGTCGTCGATGTGGTCAAAGAT | | CCTCACT | MSGVKQGDPISPTLF |
| | | | | ATGTACCAGGGAGCATCAATGAGGGTTAAGAACGCGACGGAAAAAAGC | | GACTTC | NICLETVIRRHLESAN |
| | | | | GATCGAATCCCAATAATGTCTGGGGTGAAACAAGGCGATCCCATTTCAC | | GGTCAG | GHQCLKTRIKVLAFA |
| | | | | CAACACTTTTCAATATATGCCTGGAAACTGTGATTAGAAGACACCTGGA | | AGAGGA | DDMAILTDSPDQLQ |
| | | | | GTCTGCAAATGGTCACCAGTGCCTCAAAACAAGAATTAAGGTACTGGCG | | GTCCCG | RELSKLDNDCTPLNLI |
| | | | | TTCGCCGACGACATGGCGATTTTAACGGATTCCCCCGACCAGCTCCAGC | | CCTTGG | FKPAKCASLVIQKGV |
| | | | | GAGAACTGTCAAAGCTAGACAATGATTGCACGCCCCTGAATCTTATTTTC | | AGACCT | VRSASIKLKGNAIRCL |
| | | | | AAGCCAGCAAAATGTGCATCACTTGTGATCCAAAAAGGAGTTGTGCGG | | CCCCGG | DENTTYKYLGVQTGS |
| | | | | AGCGCATCAATTAAGCTTAAAGGAAACGCCATTCGATGCCTTGACGAGA | | GGAGGT | AARISAMDLLEKVTK |
| | | | | ACACCACTTACAAATATTTGGGAGTTCAGACGGGTTCGGCAGCAAGAAT | | TGCTGA | ELECVVKSDLTPPQKL |
| | | | | TTCAGCAATGGATCTACTGGAGAAAGTCACGAAGGAACTTGAATGCGT | | AGAGGC | DCLKTFTLSKLTYMYG |
| | | | | GGTCAAAAGTGACCTGACGCCGCCGCAAAAGCTGGACTGTCTTAAAACA | | GGAAGC | NSIPLITEIKMFANIVI |
| | | | | TTCACGCTGTCCAAACTGACATACATGTATGGAAATTCCATACCACTGAT | | TCCTTCT | RGVKVMHRIPVRGS |
| | | | | CACGGAGATAAAAATGTTTGCAAATATCGTCATTCGAGGAGTCAAAGTG | | AGCAAG | PLEYIHLPVKDGGLG |
| | | | | ATGCATAGAATCCCAGTCCGAGGGTCACCACTGGAGTACATCCATCTTC | | AGCTAG | VACPKTTCMITFLVST |
| | | | | CAGTGAAGGATGGAGGGCTTGGTGTAGCATGTCCCAAGACAACCTGCA | | AGGGAG | LKKLWSDDEYIKTLFT |
| | | | | TGATTACGTTCCTTGTCTCTACTCTTAAAAAACTCTGGTCAGATGATGAA | | TTCCCAG | SLAEEVVKKESKKSTV |
| | | | | TACATCAAAACATTATTCACATCACTGGCGGAAGAAGTAGTAAAGAAAG | | TCCTGA | TMDDIADYLNVEERI |
| | | | | AGTCAAAGAAGAGCACAGTCACTATGGATGATATAGCCGACTATCTCAA | | AACCCTT | NRSEFGYNSITRLRDV |
| | | | | CGTTGAGGAGAGGATCAATAGGAGCGAATTTGGGTACAATTCCATTAC | | GCGGTT | MRNLAITGDSPLYRL |
| | | | | GAGACTGCGGGATGTGATGAGGAACTTGGCCATCACTGGCGACTCCCC | | GATGAT | KMVVKNGKIALLVQ |
| | | | | ACTTTACAGGCTGAAAATGGTAGTAAAGAACGGGAAAATCGCTTTGCTC | | GGAATG | ATSESMERIYTEEDAK |
| | | | | GTCCAAGCCACAAGCGAAAGCATGGAAAGGATCTACACGGAAGAAGAT | | GAAGAG | KLQRSLKDQVNKALK |
| | | | | GCGAAAAAGCTGCAGCGCTCACTGAAGGATCAAGTGAACAAAGCACTC | | TACTTCG | HRFNTTKVVKSKVVR |
| | | | | AAACATCGATTCAACACCACCAAAGTAGTGAAAAGCAAAGTCGTCCGAG | | GTACTG | VVQQHPASNRFVTK |
| | | | | TCGTGCAACAGCACCCAGCAAGCAACAGGTTTGTCACAAAAGGTGGCA | | CTCGTT | GGNLSLACHRFVHKA |
| | | | | ACCTGAGCCTTGCATGTCACCGCTTTGTGCATAAAGCACGTCTGAATCTA | | GCTCTCT | RLNLLACNYNNYDKS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTGGCCTGCAACTACAACAACTACGACAAATCCAAATCAAAAGTCTGTA | | CTGCGT | KSKVCRRCGKDLETQ |
| | | | | GGCGTTGTGGGAAGGATCTGGAGACGCAGTGGCACATACTGCAAAACT | | TTTACTG | WHILQNCPFGFSKKI |
| | | | | GTCCGTTTGGTTTCTCAAAGAAGATCACTGAGAGGCATGATGCCGTCTT | | CCGAGG | TERHDAVLHKVKTLIE |
| | | | | GCACAAGGTCAAAACTCTCATTGAAAGCGGTGGAAAAAAGAATTGGAC | | GCCGGA | SGGKKNWTMKIDEE |
| | | | | AATGAAGATTGATGAAGAACTTCCAGGATTCAGCAGACTCCGTCCAGAT | | TTTGCTC | LPGFSRLRPDICLKSP |
| | | | | ATCTGCCTCAAAAGCCCTGATGAAAAACAAATCATCTTGGCAGATGTCG | | GAATCG | DEKQIILADVACPYEH |
| | | | | CATGCCCATATGAGCATGGAGTAGAAGCGATGGAAAGGAGCTGGCAG | | CGAAAG | GVEAMERSWQAKID |
| | | | | GCAAAAATCGACAAATACGAGACGGGATTCGCCCACCTGCGGAAATCG | | GTCTCA | KYETGFAHLRKSGTKL |
| | | | | GGAACCAAGCTGACCGTCCTTCCGATTATAATCGGGTCACTTGGATCAT | | ATCGAC | TVLPIIIGSLGSWWKP |
| | | | | GGTGGAAACCGACAGGTGACAGTCTCAAGGAATTGGGAATCAAGGGA | | CATTCAA | TGDSLKELGIKGSVIN |
| | | | | AGCGTGATCAACAGTGCCATTCCAGAACTCTGTGCTACTGTTCTCGAACA | | GATGAC | SAIPELCATVLEHSKN |
| | | | | CAGTAAGAATACGTACTGGAATCACATCTTCGGTGAAGCGTACATACCA | | GGCTTA | TYWNHIFGEAYIPNP |
| | | | | AATCCAATGCGAAACGGACACGCAAAACCTGCTGGAAATGGATGGAAA | | TCTAAG | MRNGHAKPAGNGW |
| | | | | AAGGAAAGATTGCAGAAGGCCCCTGTGAGGCCTACCAACTAGCCTCCA | | GTCCGA | KKERLQKAPVRPTN |
| | | | | GGGCACGCCGCACGCCAAAAGTCCTGGCATAACTCTGCAAATAACATCA | | AAGCAG | (SEQ ID NO: 1396) |
| | | | | AACGTCAATCAACTCCACAAACTCTCCACTCTCTTCAAGTCTTCTCGGTGC | | TTGGGA | |
| | | | | TTCCAACACCACAATGGTGAAAGCTCCTTCACCTTTTCCCTCCAAAATTCT | | GAGTAA | |
| | | | | TCCCATGTGGGGAAGTCCTGTTCTTGTAAGCTCTCCGGAGGCTGCAAGA | | CGTGTT | |
| | | | | GCAGAAGAAATTCTTCTTTCTGACAAGGTCAGAAGGAAGTCCTGTTCTT | | CTCCTAC | |
| | | | | GAGGCGTCCATCCCGGGCGTCATAGGAGAGATCAGATGCACCTTCTAG | | CTTTCAA | |
| | | | | CAGGAGCTAGAAGGGCTGCCCTGTCTTGAGATCCCCACGGGGGTCAAT | | GTTGAA | |
| | | | | AGACGGGAGGGGCTGCTGGCTTTCTCTTTTTAAGAGGAAGCACCAATCC | | TGGTCG | |
| | | | | GGAGATCCTTAGGGGTCAAAGGATTAAAAGGCAGCAGGTCCAATTCTC | | TTTTACT | |
| | | | | CTCACTGACTTCGGTCAGAGAGGAGTCCCGCCTTGGAGACCTCCCCGGG | | GTTTGG | |
| | | | | GAGGTTGCTGAAGAGGCGGAAGCTCCTTCTAGCAAGAGCTAGAGGGA | | GATAGC | |
| | | | | GTTCCCAGTCCTGAAACCCTTGCGGTTGATGATGGAATGGAAGAGTACT | | TGACTT | |
| | | | | TCGGTACTGCTCGTTGCTCTCTCTGCGTTTTACTGCCGAGGGCCGGATTT | | GATGCT | |
| | | | | GCTCGAATCGCGAAAGGTCTCAATCGACCATTCAAGATGACGGCTTATC | | AGTACG | |
| | | | | TAAGGTCCGAAAGCAGTTGGGAGAGTAACGTGTTCTCCTACCTTTCAAG | | CTTCATC | |
| | | | | TTGAATGGTCGTTTTACTGTTTGGGATAGCTGACTTGATGCTAGTACGCT | | TGTGGA | |
| | | | | TCATCTGTGGATGACGCTCCCCAAGCAGTCAAGTAGACTTGAAAGGTGC | | TGACGC | |
| | | | | CCTCGCCCTAGTTAGCTCTTAGACCTTATGGGTCGCCATGGTTGTGGACG | | TCCCCAA | |
| | | | | GGTATGCTTGCCGGAGCCGAGTCGTGTTTCTTAGAACCAACCTCGACGA | | GCAGTC | |
| | | | | GGCGAAAGCTTGCACAAGTTAGCACAATTGTGGTAGGGCCGACTAGAA | | AAGTAG | |
| | | | | AATGAGTCCCTTAGGGGGTTACGCCTTGGCGAAAGTGAGGACAATTGG | | ACTTGA | |
| | | | | CATTGACGGGTGCTTCGGCACTAGGCAAAGGCGCCACCACACTGTCCAA | | AAGGTG | |
| | | | | TCTCTAAAAAGTTCACATTCATCGAAGAACTACCGGAACCAACCACACAT | | CCCTCGC | |
| | | | | GTGTTGAAACCTACACGGTGGAAGGGAAAGGAAAGCTTCGCTGGAACG | | CCTAGTT | |
| | | | | AAAAGAACGGATAGGTTCCCCTTCTTGATGGCTGTGAGGCTTAGGATGG | | AGCTCTT | |
| | | | | ACGGGAAGGCCGTGAGGCCTCAGGGGGTAACTCGGCCAGACGCTAGT | | AGACCT | |
| | | | | TGATCTTCGGATCACGACAGCCCTGGCTAAGAGGAACCCTGGATGGAG | | TATGGG | |
| | | | | TGTGAAGGATGGGCGGGTAGGGGGTTAAGCCTGTTGACAGACCACCGA | | TCGCCAT | |
| | | | | CTGCAGTCACAAAATCAGTGATTATGCGGGTGGACCAATCTGTTGGCGG | | GGTTGT | |
| | | | | GTGTTTCCCTCTACCTGACCCCGCAATATGGTATGTACGATCCTCGGATC | | GGACGG | |
| | | | | TAAAATTCATAATGGCCCACCACAACCATAAACCTCCCTAGCAGCTGGTG | | GTATGC | |
| | | | | GTCCCGATAATTCGGGTTCTTGCCACTACTGCGACCCAGGCTCGCC (SEQ | | TTGCCG | |
| | | | | ID NO: 1028) | | GAGCCG | |
| | | | | | | AGTCGT | |
| | | | | | | GTTTCTT | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | AGAACC<br>AACCTC<br>GACGAG<br>GCGAAA<br>GCTTGC<br>ACAAGT<br>TAGCAC<br>AATTGT<br>GGTAGG<br>GCCGAC<br>TAGAAA<br>ATGAGT<br>CCCTTAG<br>GGGGTT<br>ACGCCTT<br>GGCGAA<br>AGTGAG<br>GACAAT<br>TGGCAT<br>TGACGG<br>GTGCTT<br>CGGCAC<br>TAGGCA<br>AAGGCG<br>CCACCA<br>CACTGTC<br>CAATCTC<br>TAAAAA<br>GTTCAC<br>ATTCATC<br>GAAGAA<br>CTACCG<br>GAACCA<br>ACCACA<br>CATGTG<br>TTGAAA<br>CCTACAC<br>GGTGGA<br>AGGGAA<br>AGGAAA<br>GCTTCG<br>CTGGAA<br>CGAAAA<br>GAACGG<br>ATAGGT<br>TCCCCTT<br>CTTGAT<br>GGCTGT<br>GAGGCT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | TAGGAT<br>GGACGG<br>GAAGGC<br>CGTGAG<br>GCCTCA<br>GGCGGG<br>TAACTC<br>GGCCAG<br>ACGCTA<br>GTTGAT<br>CTTCGG<br>ATCACG<br>ACAGCC<br>CTGGCT<br>AAGAGG<br>AACCCT<br>GGATGG<br>AGTGTG<br>AAGGAT<br>GGGCGG<br>GTAGGG<br>GGTTAA<br>GCCTGT<br>TGACAG<br>ACCACC<br>GACTGC<br>AGTCAC<br>AAAATC<br>AGTGAT<br>TATGCG<br>GGTGGA<br>CCAATCT<br>GTTGGC<br>GGGTGT<br>TTCCCTC<br>TACCTG<br>ACCCCG<br>CAATAT<br>GGTATG<br>TACGAT<br>CCTCGG<br>ATCTAA<br>AATTCAT<br>AATGGC<br>CCACCA<br>CAACCA<br>TAAACCT<br>CCCTAG<br>CAGCTG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GTGGTC<br>CCGATA<br>ATTCGG<br>GTTCTTG<br>CCACTAC<br>TGCGAC<br>CCAGGC<br>TCGCC<br>(SEQ ID<br>NO: 1274) | |
| CRE | Cnl1 | — | *Cryptococcus neoformans* | CCCTCTTAATACCCCATAACACATAACAACCCCCTAATCAACGTTCTCTGC<br>ACCTTAAACACCACCAACATGTCCCTGCAGAGGGCCAAAAACGCCCGTG<br>GAGATCCTGGTCGGTGCAACCTATGCTCTGCCGACTATAGGGACCTCAA<br>AGATCATCTCAATAAACAACATTCCACCCATTTCTTCGTCCCCTCCGACCT<br>CCGTGGCTCTTCCCTAGTCGCTTGCCCTCGCTGCGGCACCCCCTGCTCAG<br>CTGGCACTGGTTTATCTCGTCACCAGAGCCGGTATTGCGGTCTCACCGCT<br>CCTCGAATCCGCCGAAATCGCGTGGGAAACTCAACAAACACATCTCGCT<br>GCCCTCCCTCCAATACTGCAGCTTCACCCATCGTTCCTTCGCCTTCCCCAG<br>AACGCCCAAGCCCCCCTCAGCCTGCTGAAGTTGTTGCCAGTCTCGAACC<br>ATTGTCTGAAGCCGAGGAGGTGCTGGAGGTCGCCCAGGTTGATGCCGA<br>GACTGTTGACACGCTGGAAGGGACCCGGAGAGCTCCGGAATCCGTTCC<br>GAGATCTGCCGAGGAAGGTAGCACGCGAGTTAGGGAGCTAAACATGAC<br>AGCGCCGGAGGAGGAGCATCGTGGGGAGGAGGAGAGTAGTCATACCA<br>ACCCAACTGCCCCAGCAGGGCTCGAGAACGCGGTGAGCTCAACGCTGG<br>GGCCTTCCCCTGGGACGTTGCCTTCCTTACTTCCGTCCCAAGAGTGTGCT<br>AACGAAAGATTCCTGTACCTTGCGCACCTGCCTGTTCGGAGCAAGCCTC<br>TGCCCAACAACCTAGTTACCGACTTCATGGACGCCGCTGAGCGTTGTGC<br>TCTTGCCTACATTGCACAACCCTCGGACTCTACACTGCTGGCATTTCTCG<br>CCCTTCCAAAGGTCGGCCTCACCCAGGCGCTCGCTCCAGAACAGCCCCT<br>CAGGCCGTCAACCTTCCTTAAGCAGTTCCCGCATATCCCCTGGCCAGAAC<br>AGCCACCCGCTCGTCGTCCTCCCAGCAATATTCGTCCAGACACCACCAAA<br>CAAGTCATCAAACTCGTTGAGAATGGGCGCCTAGGTGCGGCAGAGAGG<br>GTGTTGGAGGAGGATGCTTCAGTAGCCGAACTCGATCAAGGGGTCATC<br>GACCAGCTCATCACCAAGCACCCCAAAGGGCCGTCTTGTCCATTCGGCA<br>ATGCAGTGGGTCCAACTCCTGGTAAAGCTCCCGACATCGACACCATCCA<br>AAAGGCCCTCGACTCCTTCAAGCCCGACACAGCACCCGGCGTTAGTGGC<br>TGGTCAGTCCCTCTCTTGAAGACGGCTGCCAAGAGGGAGCCGGTCAAG<br>CAGTTTCTCCAACTCCTCTGCGCCGCCATCGCCAACAACACCGCCCCTGG<br>TCGCTCTATGCTCCGCACTTCTCGTCTCATCCCCTTGAAGAAGGACGATG<br>GCTCTATCCGACCTATCGCTGTTGGTGAACTTATCTATCGGCTGTGTGCG<br>AAAGCTCTCATCATCTCGCATTTCCAACCCGACTTCCTCCTCCCGTTCCAG<br>CTCGGGGTCAAGTCAATCGGTGGTGTAGAGCCGATCGTGAGGCTGACA<br>GAGAGAGTCTTGGAGGGTTCTGCCGGCGCTGAGTTCTCCTTTTTAGCCT<br>CGCTCGATGCTTCTAACGCTTTCAACCGTGTAGATAGGGCCGAGATGGC<br>AGCAGCGGTCAAGACCCATGCGCCGACGCTTTGGAGGACATGCAAATG<br>GGCCTATGGCGACTCGTCCGACCTTGTGTGTGGTGACAAAATCCTTCAA<br>TCCTCTCAAGGTGTTCGACAGGGTGACCCCTTTGGCCCTCTCTTCTTCTC<br>GATCACCCTCCGACCAACCTTGAATGCCCTCAGTCAATCGCTAGGTCCGT | CCCTCTTA<br>ATACCCCA<br>TAACACAT<br>AACAACCC<br>CCTAATCA<br>ACGTTCTC<br>TGCACCTT<br>AAACACCA<br>CCAAC<br>(SEQ ID<br>NO: 1152) | TGAGGA<br>AGAGGA<br>GGTTGG<br>ATTATTT<br>TTTCTTT<br>TCTTTAA<br>TAAGTT<br>GTTTATT<br>TAAGTA<br>GTTTCTT<br>TCATTCG<br>GGCAAC<br>CCACAC<br>GACAAC<br>CCAATA<br>AATTAA<br>ACAACG<br>AAAAAT<br>GCAACC<br>TCTATAA<br>CCC (SEQ<br>ID NO:<br>1275) | MSLQRAKNARGDPG<br>RCNLCSADYRDLKDH<br>LNKQHSTHFFVPSDL<br>RGSSLVACPRCGTPC<br>SAGTGLSRHQSRYCG<br>LTAPRIRRNRVGNST<br>NTSRCPPSNTAASPIV<br>PSPSPERPSPPQPAE<br>VVASLEPLSEAEEVLE<br>VAQVDAETVDTLEGT<br>RRAPESVPRSAEEGS<br>TRVRELNMTAPEEEH<br>RGEEESSHTNPTAPA<br>GLENAVSSTLGPSPG<br>TLPSLLPSQECANERF<br>LYLAHLPVRSKPLPN<br>NLVTDFMDAAERCA<br>LAYIAQPSDSTLLAFL<br>ALPKVGLTQALAPEQ<br>PLRPSTFLKQFPHIPW<br>PEQPPARRPPSNIRP<br>DTTKQVIKLVENGRL<br>GAAERVLEEDASVAE<br>LDQGVIDQLITKHPK<br>GPSCPFGNAVGPTP<br>GKAPDIDTIQKALDSF<br>KPDTAPGVSGWSVP<br>LLKTAAKREPVKQFL<br>QLLCAAIANNTAPGR<br>SMLRTSRLIPLKKDDG<br>SIRPIAVGELIYRLCAK<br>ALIISHFQPDFLLPFQL<br>GVKSIGGVEPIVRLTE<br>RVLEGSAGAEFSFLAS<br>LDASNAFNRVDRAE<br>MAAAVKTHAPTLWR<br>TCKWAYGDSSDLVC<br>GDKILQSSQGVRQG |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTACGCAAGCACTCGCTTACCTCGATGACATCTACCTCTTCTCAAACGAC<br>TCGCAAGTCCTCAGCAAAACTACCCAATTCCTCGCCGACAAGCAGCACA<br>TCATCAAGCTCAATGAAAAGAAATGCAAGTTAATCAGCTTCGATGAGAT<br>CAGGCAGGAGGGCTTCAAGATGCTAGGGACGATGGTAGGAGGTAAGG<br>AGAAGCGAGCGGAGTTTCTGGAAGGCAGGATTCGGAAGGAAATGGCA<br>AAGGTGGGCAAGCTCAAGGATCTTCCACATCAACACGCGCTCCTTCTAT<br>TACGTTTCTGCATTCAGCAAAATCTACGACACCTGCAGAGAAGTCTGCG<br>CTCGGACGACCTTGTAGACCTATGGGAGAGGCTGGACACGATGCTATG<br>GGAGGAGGTGAAAAGGATGAGGATGAGGCAGCGGGAGGATACGGCG<br>GAAGAGGAGGCTCTAGGGAGATCGTTGACGAAGCTACCAGCGCGACTG<br>GGCGGACTAGGTCTACTTTCCTTCAAAGATGTAGCCCCCCTTGCTTACCG<br>CTCGGCAGCCGAGGCCTCCGACACTCTCCTCGATAACCTAGGTCTCCTTT<br>CTTCGCCAGAGGAACCTCCAACTCCGATCCCCCAACGAACTCGATGCGC<br>AGAACTCTGGGAATCGCAACAGGAAGCCATCCTACATAACCTCGGCGAC<br>ACTGAACGCAAGCGACTCACCGAGAATGCCTCCAGACTCGGCCGAAGTT<br>GGTTATCAGTTATCCCTTACCTTCAACCCCTGCGCCTTTCCAATGTCGAG<br>ATTGCCTCTGGTCTCCATGACCGCACCCTGGTCGGCTCCTCGATCCCTGT<br>CTGTCGCTTCTGTGGGTCGGACTCACCTTTGGGTCACGACGAGCTTTGCC<br>GCGCCCGCAACCCCTGGACCCAGCGCCGGCACAATGCCATCAACCGCGT<br>CATTTATCAACACCTCAAACAAATTCAAGGTGCCACGGTTGAGATTGAG<br>CCCCACACGCTGTCGGGACAAAGGAGAAACGACCTTCGGGTCAGAGGT<br>TCCAGCGCTCTGGCCTTCACTGACTACGACCTGAAGGTTTACTCCCTCGG<br>GGACCGAGACGCGAGAAGCACCGTCACACCCTGCGCCCCCAACGGCAA<br>GCTGGCCGACTTCTGCTTGGACCGGTGCGTGAACTGGCTCGACAAGGT<br>GGGTCAGGTCGTCTCTAAGAACGCTCCGAAGGTCACTGGTGGGGTCTTT<br>AAACCAATCATCCTTTCCACTGGTGGCTTGATGAGCAGGAGCACAGCAG<br>ACGAATGGAAGGACTGGAGGGACGCGATGCCGGTGGGGGGGTTCGAG<br>AAAATGGAGAAACGGATTGGTGTCGAGTTAGTAAAGGCAAGGGCGAG<br>GACGCTGGTCTTATGAGGAAGAGGAGGTTGGATTATTTTTTCTTTTCTTT<br>AATAAGTTGTTTATTTAAGTAGTTTCTTTCATTCGGGCAACCCACACGAC<br>AACCCAATAAATTAAACAACGAAAAATGCAACCTCTATAACCC (SEQ ID<br>NO: 1029) | | | DPFGPLFFSITLRPTL<br>NALSQSLGPSTQALA<br>YLDDIYLFSNDSQVLS<br>KTTQFLADKQHIIKLN<br>EKKCKLISFDEIRQEG<br>FKMLGTMVGGKEKR<br>AEFLEGRIRKEMAKV<br>GKLKDLPHQHALLLL<br>RFCIQQNLRHLQRSL<br>RSDDLVDLWERLDT<br>MLWEEVKRMRMRQ<br>REDTAEEEALGRSLTK<br>LPARLGGLGLLSFKDV<br>APLAYRSAAEASDTLL<br>DNLGLLSSPEEPPTPI<br>PQRTRCAELWESQQ<br>EAILHNLGDTERKRLT<br>ENASRLGRSWLSVIP<br>YLQPLRLSNVEIASGL<br>HDRTLVGSSIPVCRFC<br>GSDSPLGHDELCRAR<br>NPWTQRRHNAINRV<br>IYQHLKQIQGATVEIE<br>PHTLSGQRRNDLRVR<br>GSSALAFTDYDLKVYS<br>LGDRDARSTVTPCAP<br>NGKLADFCLDRCVN<br>WLDKVGQVVSKNAP<br>KVTGGVFKPIILSTGG<br>LMSRSTADEWKDW<br>RDAMPVGGFEKMEK<br>RIGVELVKARARTLVL<br>(SEQ ID NO: 1397) |
| CRE | CRE-<br>12_CCri | — | *Chondrus crispus* | ACGCCCCCTATCCATTTCTGCCAGCCTCCCATCGGCTCGCCGTCTCCGCA<br>ACCCCTCTTCCTCGGCTGTACCAGTTCCGCTCCCACAACCTCCCTCGCCAC<br>AATGAGTCAACCTAATATTTCGTCCGCTGAGACCCCCTTGTCTCAGCTGC<br>CCACGCCTGTTCCCACCCCGCCTTCTCCCTCCAATCCCTCTCTCTCTCCC<br>TACTGTGCGTGACCTCCTCCTCTGCCCCATACGCTCCTCCCATGTTTACTC<br>ATCCATCCCTTCCTCGTGCTTACACAGTTTCACGATGCTCCTCATCAAGAC<br>TGTCCGCGCTGCGTCGGCCACAATGACCCCAACTGAATCMCATCGCGCA<br>TTCATTCATCTACACATTCTTCCCATCGCTGTCTTGCGACGCTCGTTCCGT<br>GGAGAAACCGGATGGCGTTCCCGCACAGGGCAACATCATGCCCTCCGC<br>CAACGGATTCGCCGCGCCTCCTCGGGTCGGCATTGGGCTGCCTTGTGGC<br>ACGAAGCCCTTGCTGCACATCAGGTCGACCTTGACTACCGCACGCGTCA<br>CAGCCGTCGTTACCAAGCCTCCGCTACATCGCGCCACCGCATCGGCCGT<br>GCCATGCGTCTGGCCGCCGATGCCCAATATGGACGTGCAATGTCGGCCC<br>TCAAGGCCAAACCGCTGCCCGATCTACATGCTGCCGCCACCCGCGACAC<br>ACTCACCGCGCTTCACCCTCCTCCTGCCAGCCCGGTTCAGCCTCTCTCACC | ACGCCCCC<br>TATCCATT<br>TCTGCCAG<br>CCTCCCAT<br>CGGCTCGC<br>CGTCTCCG<br>CAACCCCT<br>CTTCCTCG<br>GCTGTACC<br>AGTTCCGC<br>TCCCACAA<br>CCTCCCTC<br>GCCACA<br>(SEQ ID<br>NO: 1153) | TAAGTC<br>CTTGAC<br>GCCTGC<br>CCCGTG<br>ATACAG<br>CATCGG<br>TACCCCT<br>AGCATTT<br>GAATAA<br>AAAA<br>(SEQ ID<br>NO:<br>1276) | MSQPNISSAETPLSQ<br>LPTPVPTPPSPSNPSL<br>SLPTVRDLLLCPIRSSH<br>VYSSIPSSCLHSFTML<br>LIKTVRAASATMTPT<br>ESHRAFIHLHILPIAVL<br>RRSFRGETGWRSRT<br>GQHHALRQRIRRASS<br>GRHWAALWHEALA<br>AHQVDLDYRTRHSR<br>RYQASATSRHRIGRA<br>MRLAADAQYGRAM<br>SALKAKPLPDLHAAA<br>TRDTLTALHPPPASP<br>VQPLSPTDLPPVPEIT |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GACTGACCTCCCCCCGGTCCCTGAAATTACGGAAGGTCAAGTCCTCCGA | | | EGQVLRAARALNPTS |
| | | | | GCGGCACGCGCCCTTAATCCCACATCCGCTGCAGGACCGGACCATCTCT | | | AAGPDHLSPRILQLLA |
| | | | | CTCCCCGTATCCTGCAGCTCTTAGCCCGCACCACTATCAGCCCGGAAGCT | | | RTTISPEAGVTGLSAL |
| | | | | GGGGTTACGGGGTTGTCCGCATTGACGAACCTGGTTCGACGTCTCGCCC | | | TNLVRRLARGDIPDR |
| | | | | GAGGTGACATTCCGGATAGAACTGCGCCTCTCCTTGCTGCTGCCACTCT | | | TAPLLAAATLIPLQPR |
| | | | | GATCCCCCTCCAACCCCGCCCTCACAAAATACGGCCGATTGCTGTAGGG | | | PHKIRPIAVGQALRRL |
| | | | | CAGGCTTTGCGCCGTCTGGTCACGAAGGTCCTTCTGCCCCCCGCCATCCA | | | VTKVLLPPAIQDTRD |
| | | | | GGACACCCGCGATCACCTTCTCCCAGAACAGCTCGCCAACTCGGTTGCC | | | HLLPEQLANSVASG |
| | | | | TCGGGCATGGACGCAATCGTCCATGACACGCGCATGCTTATGCATCGTC | | | MDAIVHDTRMLMH |
| | | | | ACGGTCGAAACCCAGACTACATCATGGTCTCCGTAGACGCGCGGAATGC | | | RHGRNPDYIMVSVD |
| | | | | CTTTAACACCTTCTCACGTCAGTCCCTGCTGGATCGTCTCCCTCTGCAGAC | | | ARNAFNTFSRQSLLD |
| | | | | TCCTTCCCTCGCCCGTTTTCTCAATCTAATCTATGGCCGCACCGTTCCTGA | | | RLPLQTPSLARFLNLIY |
| | | | | TCTCGTGCTGCCCTCTTCTCCGCGGTTTCTGATGAAAAGTCAGGAGGGC | | | GRTVPDLVLPSSPRFL |
| | | | | ACCCAACAGGGGGACCCGGCAAGTATGCTCTTATTTTCGCTGGCAATCC | | | MKSQEGTQQGDPAS |
| | | | | AGCCGCTCCTGCGTCGTCTCACCCGCGAGTGCCGTCTCGACCTGAACCG | | | MLLFSLAIQPLLRRLT |
| | | | | CTGGTACGCGGATGACGGCACTCTGGTCGGGCCAATCTCGGAGGTCAT | | | RECRLDLNRWYADD |
| | | | | CAAGGCACTCCGAATTCTTCGTGATGACGGCCCGCAGTCCGGATTTCAC | | | GTLVGPISEVIKALRIL |
| | | | | GTCAATATCAACAAGTGCCGGGCATACTGGCCGACCGTAATGCCAGAAA | | | RDDGPQSGFHVNIN |
| | | | | AGTTGTCCGAATTGCTCCGTATCTTCCCCCTTCACGTCGAGTGCGGCGAA | | | KCRAYWPTVMPEKL |
| | | | | GGCGGTGTCGCCTTGCTGGGTGCCCCGCTCGGCACAGATGCCTTTGTGC | | | SELLRIFPLHVECGEG |
| | | | | GCCGACATCTCATGAACAAGGTTCAATCATGCCATGCCTCCCTCAGCCTC | | | GVALLGAPLGTDAFV |
| | | | | CTTGATGAAATTCCCGACGCGCGTACGCGGTTTCACCTTCACCGTGTAAC | | | RRHLMNKVQSCHAS |
| | | | | AGGCTCGGTATGCAAAGTCGAGCATGTTTTTCGCCTTACACCTCCCCACC | | | LSLLDEIPDARTRFHL |
| | | | | TCTCCCTCCCAGCAGCTACAAAATTTGATGAACAACAAATCGCTGCTTAT | | | HRVTGSVCKVEHVFR |
| | | | | TCTCGGTTGAATGATGTGGCCGTTTCCACATCCATGGCTACACAAATAG | | | LTPPHLSLPAATKFDE |
| | | | | GCCTTCCGTTTCGCCTCGGTGGACACGGCTTCACCCCACTGTCACCATTC | | | QQIAAYSRLNDVAVS |
| | | | | ATCCATGCGTCCTACGCTGCCAGTTTAATTGAGGCGGCACCTGTTCGTGT | | | TSMATQIGLPFRLGG |
| | | | | GAAGGGCCCACATAACCCCTCCGAGTCGTTTTATCGCCGCATGGCCCGT | | | HGFTPLSPFIHASYAA |
| | | | | CGTCATATCGTCCACGTACTAGGGGCCTTGAACCCTGAGGTCCGCACCC | | | SLIEAAPVRVKGPHN |
| | | | | GAGGCATTCTTGGGACCCATTCTCCCCTCGGACCATTTGAACCAGAGGC | | | PSESFYRRMARRHIV |
| | | | | CCTTTTGTCTAGACCTGAACGCGTACACCACACATTAATTCAGGCTATGC | | | HVLGALNPEVRTRGI |
| | | | | AGGGGGCCACTTCTCGACTCTACTGGGAACACACCGCGTGGGACCTTGA | | | LGTHSPLGPFEPEALL |
| | | | | CCCTCTCCCTCGCAACCACAGTGCCGCCTCTGTCCGCCGACGTGCCCGGT | | | SRPERVHHTLIQAM |
| | | | | ACAATTCCCTCCGTGCTCCGGGCGCCGCGTCGTTTCTATGCAGCCACCCC | | | QGATSRLYWEHTAW |
| | | | | TCACTCACTTCTCGAGTCCCTTCTGCGGTGTGGTCCTGTATGCTACGCCG | | | DLDPLPRNHSAASVR |
| | | | | GCATCTGGATACACCCGTCTACTGTGACTCTATTCGGCCTCTCATATGTT | | | RRARYNSLRAPGAAS |
| | | | | CGCATTGCTGTAAGCCAATGGACGCTCGCGGTGATCATGCTGCAATATG | | | FLCSHPSLTSRVPSAV |
| | | | | CCGTCATGGCTTCGGCGTCGTTCACCGTCATAACACTGTACGCAACCTAC | | | WSCMLRRHLDTPVY |
| | | | | TCGCCCGTCACGCGTTCCGCGCCGCCGGTCTCTGCTGCGACCTTGAGGT | | | CDSIRPLICSHCCKPM |
| | | | | CCCTTCTCTCTTGCCGAATACCGCGAACCGCCCCGCCGATATTCTCGTCC | | | DARGDHAAICRHGF |
| | | | | AGCCCGCCCCGCCTCCTTCGGGCGCTCTCCCGGACCGCCCCACTGCGTA | | | GVVHRHNTVRNLLA |
| | | | | CGACGTAACCGTTCGTTCCCCCTACTGTCGCTCTACAATGTCTCTCGCTG | | | RHAFRAAGLCCDLEV |
| | | | | CGAAAGGCCTCGCGGGTGCAGCGGAAGCTGCTGATTTGGACAAGCTTC | | | PSLLPNTANRPADILV |
| | | | | GCGTCCATTCCCGTACAGTGCGTGACGCATTTCACCTCCAGCCTGACTCC | | | QPAPPPSGALPDRPT |
| | | | | CCACTCCCTCTACTCGACTGGCACTTTGTCCCGCTCGCATTTGATACTCTC | | | AYDVTVRSPYCRSTM |
| | | | | GGCGCGACCAGCTCTCGCACGATGGCAGTCCTTGAGTACCTCGCTCACC | | | SLAAKGLAGAAEAAD |
| | | | | GCATTGCCAACCGGACATATTCATCTTACGGGACCGCCAAGATACGTCT | | | LDKLRVHSRTVRDAF |
| | | | | ACTACAACGCATCAGTTTCGCTGTTTGGTCCAGTTTGGCCTCTGCCACCC | | | HLQPDSPLPLLDWHF |
| | | | | TTTCCCGTATGCCCTATCACGGCGCGGCCCTATCGAGCCCCGCCCAAGT | | | VPLAFDTLGATSSRT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTAAGTCCTTGACGCCTGCCCCGTGATACAGCATCGGTACCCCTAGCATT TGAATAAAAAA (SEQ ID NO: 1030) | | | MAVLEYLAHRIANRT YSSYGTAKIRLLQRISF AVWSSLASATLSRMP YHGAALSSPAQV (SEQ ID NO: 1398) |
| CRE | CRE-13_CCri | — | *Chondrus crispus* | CNCCAGCCAMCGATCCCGCCGCCACTCGCMGCCCGGCCGTCTCGACCG CCACCTCCCCGASGCCCCAGCCCATCATGGCCTSTWMGCCCCWGATWT CTCCCCCGGGGGCCCCCCTGCTCCGCTGCGGTACCGGATGTTACAATG TCCACCSCCGCTACCSAAGCSMCASTMGTTKCCGGTCCCCCACCCGATGT CGTCACCCATACGCCKCCGCCTCCCMCACCGGMCGATGAGGGGACCCC CTTCCCSAACCCCTCCCCGAGACATGCACAGACCSCATGGCACCCCCGG WCCGCACTCTCACCGATKCTGTGGCCGCCCTCCCMACCACTGCACCCAT GCCTCCSCACAACCSCGSMSAGCCCMGCACSCTCTCCAAWGGCCGAAA CTSCGCAGCCCACCTCCACATCCGCATGTTTCACCCCTCATCCTCTGCAST GGCCCCCTCCCAACGCCCATGACCCAACCACGCATGAAACGAGCGCTCT CCASAAGCGCCAAGGCGCCCCCTACCAAGCGCCCCTCTGCCTCTCAGGG CCCAGCCGCGTCTTCCCATGACKAATGACCSCGGACGCCCCCACCTCMA CCCCCGCGCCCGCCTCCCTACAGGTTCCCTCCCCCWACTCTCGACCAGCA CTTMTTCGCCCTCTCWTMAGCCTACCCCCACCCGMCTCCCMGGCGCCC ACCCTCMCCTTKCCGTCSGTTGAGGCACTCCTTTCCTCCCCGATTCGGCC STCAGACATTTTCTTCCATTCCGGGACCGCGCCTTCATAGCACTGTATTAC TTCTCATCCGCCTCGTCCGCGCCGCTACAGCCGCCAACACTCCCGAAACC ACCACACTGMATTCTTGCACCTTCACCTGCTCCCGACTGCCSTTCTTCGA GAGGCCTTCCGKGGCGAGSCTGGCTGGAGGTCCTCGCGCGGTCAACTTC ATGCTCTCCGCTTGCKGATACGGAGAGCGTGTACKGGACGAGAGTGGG GWCTCTTATGKAAWGAAGCMCTAGATGCCCACAGCKCCAGGACAGAA TGGCAGCACACGCATGCCCGGCGCCCCTCGCCACCCGTTTCCCCATCGG CACGTGCCGCCCGCGCTATGCGCCTTGCCTCCCAAGCTCAATACGGCCG CGCCATGCGCACATTTACCAACCCCCCTCTAGCTGACCTCAACGACCCGG CCACGATGGAGCGGCTCCAAGCCCTTCACCCCACTCCTACCGTGCCCGTC GTGCCCCTGCCACCCTCCGCACAGCCTCGACCACCCGAAGTCACCGMGG AGGCGGTCWTGCGTGCGGTTCGTCGCCTCAATCCGAACTCGGCGGCCG GCCCTGATCGCATGTCCCCGAAATTGCTTCACCTCCTGGCTCACACTCCC ATAAGCCCAGAAGCGGGCGTCACCGGTCTCTCKGCGCTAACCAACCTCG TCAGCCGCCTGGCTCGCGGCTCCCTCCCACCCTGTACGATCCCACTGGCC AGTGCGGCGACACTTCTKCCGTTGCAGCCCCGACCGGGAAAAATACGCC CGATCGCTATTGGGCAAGCCCTWCGCCGGCTTGTCACAAAAKTMCTTCT TCCTGCCGCCATCGACGACTGTCGGGACCACCTTGCTCCCGAACAAMTG GCMAACGGCATACCMAACGGCATTGACGCTATCGTACACGACGCACGC ATGCTAGTACGACGCCACGGTAACGACCCACACTACKTAATGGTGTCTA TTGACGCTTCCAATGCGTTCAATAATTTCTCACGSCAACAAGTCCTCGAC CAGCTGCCCACTCGAGCACCATCGCTCTCACGATATTTGGATATGGTGTA CGCACGCGCCCCCTCCCCCCTCGTCTTGCCTTCATSCCCGCCTACCATACT CCACAGCCGGGAMGGATCACAACAAGGGGACCCTGCAAGCATGCTCCT TTTCTCGCTTGCCCTCCAGCCGCTCACGCGCCTCATTTCACGTGAGTGTG AMCTWKTAATGAACCGCTGGTATGCGGACGACGGAACTATCATTGGAC GGATTGACGAAGTTKCCAAAGCCCTTGATATCATCACTAAAGAGGGGCC CAGGTTCCAATTCTTCCTCAACCCTTCGAAGACACGCGTCTTCTGGCCAA | CNCCAGCC AMCGATC CCGCCGCC ACTCGCM GCCCGGCC GTCTCGAC CGCCACCT CCCCGASG CCCCAGCC CATC (SEQ ID NO: 1154) | TAATTCA CCTTCAT ATCTGCT AGTGTC TCTGTAA GCGCAC CCCTCAT GCATTG ATAAAA TTACCCC CCA (SEQ ID NO: 1277) | MAXXPXISPPGAPPA PLRYRMLQCPPPLPK XXXXPVPHPMSSPIR XRLPHRXMRGPPSXT PPRDMHRPHGTPGP HSHRXCGRPPXHCTH ASXQPRXAXHXLQXP KLRSPPPHPHVSPLIL CXGPLPTPMTQPRM KRALSXSAKAPPTKRP SASQGPAASSHDXPR TPPPXPPRPPPYRFPP PTLDQHXFALSXAYP HPXPRRPPSPXRXLR HSFPPRFGXQTFSSIP GPRLHSTVLLLIRLVR AATAANTPETTTLXS CTFTCSRLPFFERPSX AXLAGGPRAVNFML SACXYGERVXDESGX SYXXKXHCITSHPPRP RRYSRQHSRNHHTXF LHLHLLPTAXLREAFR GEXGWRSSRGQLHA LRLXIRRACTGREWG LLXXEALDAHSXRTE WQHTHARRPSPPVS PSARAARAMRLASQ AQYGRAMRTFTNPP LADLNDPATMERLQ ALHPTPTVPVVPLPPS AQPRPPEVTXEAVXR AVRRLNPNSAAGPD RMSPKLLHLLAHTPIS PEAGVTGLSALTNLV SRLARGSLPPCTIPLA SAATLLPLQPRPGKIR PIAIGQALRRLVTKXL LPAAIDDCRDHLAPE QXANGIPNGIDAIVH DARMLVRRHGNDP HYXMVSIDASNAFN NFSRQQVLDQLPTRA |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCAGGCAGCMAGACCTCCTCAGCCCGCTCATGACAGTGGGTCCTCTGC<br>GMGTCATCGATGAAGGCGGTGTGGMTCTGCTCGGCGCCCCCATMGGG<br>TCACCAAGCTWTATGGCACAGTACATTCGGGAAAAWTTGAACACTTGC<br>AAAACCGCMCTCGCCCATCTCGACCATATCCCCGAGGCCCGCATGCGCT<br>TTCACCTGCATCGGGTGTCTGCTTCTGCATGCCGCTTGCAGCACCTCTTC<br>CGGTTGGTCCCCCCGGATTTCGCGWTGCCGTTTGCACAACAATTCGACC<br>GTGACCAACTCGMAGCCTATGMGCGCTTTAATAGTGTGACTATGTCGC<br>CAAGAATCGTGCCCAAATACGGCTGCSTTTTTCMCACGGWGGCCACGG<br>CCTCACCTCATTGGCATCTACCATACACGCCTCWTACGCTGCTAGCCTCA<br>TCGATACCGCTCCAGCACGGCTACAAGGTCCCCACTTTCCCGCCGTCTCT<br>CAGTATCAGCGTTTTGCACGAGGCCCGTTGCGGGTCGTTCTTCGAAATTT<br>ACCTTCATTCGTKCAACCCGCACACTTCTCGATGACGGAAWCGGACCTC<br>GGMTGCCTTGAACCAKCTGCGCTACTGGCGCGACCTGAACGCATACAC<br>ACCTTTCTACTTCAGGCGCAATACAGTGCAGCAGCWAGCTCGTACTGGC<br>AAAWACCCCTCTGGGAGTCCTTCCCCAACCCTGGTGATCACAGCGCAGC<br>CTCGCTACGCAAACGAGTACGCTACAACTCCCTGCTTGCCCCWGGGGCC<br>ACCAGTTTTCTCACTGCACACCCSGCCGCCACCTCTCGGGTCCACAACGC<br>AACTTGGTCCACGATGTTACGTCGGCACCTCGACGCCCCCGTGACCAAC<br>GATTCCATATCGCCGTTGCGATGTKCTCACTGCTCCAAGCCTATGGATGC<br>CCGCGGCGACCACGCGWCCATTKGCAGCCACGGGTTTGGTACGTTGCA<br>CCGGCATAACACCGTCAGGAACGTCCTCGCCMGGCAGTTATTCCGMGT<br>CGCTGGCCTCGCCTACTCGCTCGAAGTACCCTTTCTGATTCCCAACACCG<br>CCGCCCGTCCCGCAGATATTCTCGTCCAACCACCTCCTCCAGCCCCTGGC<br>CTACCTCCTGACMAACCCACAGCCTATGATGTCACGATTTGTAGCCCTTT<br>TCGCCGCGGAATGTTATACCATGCCGCCCGTCACCGCGGCGGAGCCGCC<br>GACGCCGCATCTGTAAGGAAGMGCAAAGCCCTCGAGCGCACTATCCGC<br>MACGCTCTCCTTATCGAGGACGACAATCSTCCGCCGCCTCTTGACTGGC<br>ACTTTCAACCGCTTTCCTTCGACGCWCTGGGMGCCCCCTCTCAGTCTAC<br>TGTACACGTTATCGAAGATCACGCTAAGCTCATGGCCCTCCGCAACTCGT<br>GCACMATTGCAACTGCCAAATCACGCATCCAACAACGCCTCAGCTTTGC<br>TATATGGTCCAGTGCTGCCGCCGCTATCCTCTCTCGCCTACCGACACACG<br>CCGCGGACATCTCATACCCGATAGAAGTATAATTCACCTTCATATCTGCT<br>AGTGTCTCTGTAAGCGCACCCCTCATGCATTGATAAAATTACCCCCCA<br>(SEQ ID NO: 1031) | | | PSLSRYLDMVYARAP<br>SPLVLPSXPPTILHSRX<br>GSQQGDPASMLLFSL<br>ALQPLTRLISRECXLX<br>MNRWYADDGTIIGRI<br>DEVXKALDIITKEGPR<br>FQFFLNPSKTRVFWP<br>SRQXDLLSPLMTVGP<br>LRVIDEGGVXLLGAPI<br>GSPSXMAQYIREXLN<br>TCKTALAHLDHIPEAR<br>MRFHLHRVSASACRL<br>QHLFRLVPPDFAXPF<br>AQQFDRDQLXAYXR<br>FNSVTMSPRIVPKYG<br>CXFXTXATASPHWHL<br>PYTPXTLLASSIPLQH<br>GYKVPTFPPSLSISVL<br>HEARCGSFFEIYLHSX<br>NPHTSRCDYVAKNR<br>AQIRLXFSHGGHGLT<br>SLASTIHASYAASLIDT<br>APARLQGPHFPAVS<br>QYQRFARGPLRVVLR<br>NLPSFVQPAHFSMTE<br>XDLGCLEPXALLARPE<br>RIHTFLLQAQYSAAAS<br>SYWQXPLWESFPNP<br>GDHSAASLRKRVRYN<br>SLLAPGATSFLTAHPA<br>ATSRVHNATWSTML<br>RRHLDAPVTNDSISPL<br>RCXHCSKPMDARGD<br>HAXIXSHGFGTLHRH<br>NTVRNVLARQLFRVA<br>GLAYSLEVPFLIPNTA<br>ARPADILVQPPPPAP<br>GLPPDXPTAYDVTICS<br>PFRRGMLYHAARHR<br>GGAADAASVRKXKA<br>LERTIRXALLIEDDNX<br>PPPLDWHFQPLSFDA<br>LGAPSQSTVHVIEDH<br>AKLMALRNSCTIATA<br>KSRIQQRLSFAIWSSA<br>AAAILSRLPTHAADIS<br>YPIEV (SEQ ID NO:<br>1399) |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| CRE | CRE-1_ACas | — | *Acanthamoeba castellanii* | TAACCCTAACCCTCTCCCTCGGCCCCTCTACCCTAAAGCGCCCTAATCGA | TAACCCTA | TAAGCC | MATTTISRSPSSSSSS |
| | | | | CCGGCGACGCCCTAATCGCTACCCTCTACGCCCTAATCGACTTTGGCGCC | ACCCTCTC | GCGCGA | SSARSRASASTSASVA |
| | | | | AAAGCGACTTTCCCCGGCCGATTTTCTTCCTGCCTTTTTCTTTTCTCTCCA | CCTCGGCC | CGAGGA | SIPRLFRDGRFHCPLA |
| | | | | AGCGACGCGCCTTTTACTTTGCCGCCGTTCTGTTTTTTCTTTTCTCTTTGC | CCTCTACC | CGGCCA | HCQTRTSTWQDLSA |
| | | | | ACTTCGCTTCTACTTCACACCTCCTCCTCCTCCTTCTCGACCCGCGCGGCC | CTAAAGCG | GGACGA | HLTRMHDGDVPRDV |
| | | | | TCGAGCGACTTGCTGCAGCGGCTCCCGGCCTCCCCCACGCGGCCTGCTA | CCCTAATC | CCAGGA | AAACGIVQCLHEGCR |
| | | | | CTCCCGCTTTCTAGACGCCCCCGGTCTTGCTCTCAGTCTCCCGCATCGAA | GACCGGC | CGACGG | KWFRGAAGLASHRG |
| | | | | GCGGTAGTCGGGGTACGTGCTCAAGTGACTCAAGCCTCTTTTCAGCCTC | GACGCCCT | CGACGG | KARHAPPPAPRAALA |
| | | | | GGCGCTCTCTCAATCCGCCTCAGTCTTAGCCTTTCAAGTTGCTCGATTAC | AATCGCTA | CGACCA | VAAVPRADSRGRTP |
| | | | | GCTCTCGAATCGCTCTCTCTCTCAGTCTCAGTCTCAGTCTCAATCTCGATC | CCCTCTAC | CCTAGC | APTPSVAPPXAGPPP |
| | | | | TTGCCTTCGCCTTCGTCTCGACGCCTTGCTCTCGWAATCGCTGCCACTAC | GCCCTAAT | ACCGCA | RAAPRAAPSPLPCPP |
| | | | | GTGCCAGCTTTTTCGTGCCTTGTCTTCGTGTCGACCCGGACCGTTTGCAA | CGACTTTG | CGCGCC | ALPHPPPSASPPTSSV |
| | | | | GCCCTCGCCTTCGTACCCCGCTCTCGTAGCCGTTCTCATCGCTGAAGCGT | GCGCCAAA | ACGACA | TSPCSPPTTPPSQPSP |
| | | | | TCTACGCGCTGGCAGCAAGCCTCGGCCCTAGCTTGTAGCGCCGCCGGTG | GCGACTTT | TATTGTC | DLFSGFANAPTTPSP |
| | | | | GCCGCTCGCCAACATGGCTACGACGACCATCTCACGATCCCCTTCGTCTT | CCCCGGCC | GCGCGC | PSTPXSSPAGSPIPAA |
| | | | | CTTCTTCTTCTTCTTCCGCTCGCTCGCGGGCGTCAGCTTCCACGTCCGCCT | GATTTTCT | TGTACA | RRFVLPVATPYPAPA |
| | | | | CAGTTGCGTCGATACCCCGCCTCTTCCGCGATGGCCGCTTCCACTGCCCT | TCCTGCCT | GGCGGC | PRANRPKLSPVARPF |
| | | | | CTCGCCCACTGTCAGACCCGCACGTCCACATGGCAGGACCTCTCCGCGC | TTTTCTTTT | TAGGTC | VPKARAGAIPEASSP |
| | | | | ACCTCACACGCATGCACGACGGTGACGTGCCCCGTGACGTCGCCGCCGC | CTCTCCAA | GAGCCC | VTPQDRAVSRREDA |
| | | | | CTGCGGCATCGTGCAGTGCCTACACGAGGGCTGCCGCAAGTGGTTTCGC | GCGACGC | AGCCGA | AAAPSSAPGLGLADE |
| | | | | GGAGCTGCAGGACTTGCCTCTCATAGGGGCAAGGCCCGTCACGCCCCG | GCCTTTTA | CCGTTCT | HEDDDTYGGDTIALT |
| | | | | CCACCAGCCCCCCGCGCCGCCCTCGCCGTCGCCGCCGTGCCCCGCGCGG | CTTTGCCG | GAGCCT | APHAPRETRAPFEFE |
| | | | | ATTCTCGCGGTAGGACCCCAGCCCCGACCCCCTCGGTAGCCCCGCCCWA | CCGTTCTG | CAGTCG | ACFLEEEAPATAGDL |
| | | | | CGCCGGTCCTCCGCCGCGAGCTGCGCCACGCGCCGCCCCCAGCCCACTG | TTTTTTCTT | GCTTGA | PPYARAFLACPSARL |
| | | | | CCGTGCCCGCCTGCGCTCCCGCACCCGCCCCCCTCTGCCTCTCCTCCCAC | TTCTCTTTG | GCCCCC | QEIPRRLKSAWQAAA |
| | | | | CTCCAGCGTGACGTCCCCGTGCTCCCCGCCCACGACCCCGCCGTCGCAG | CACTTCGC | GGCTTC | KTIAEAALDCHTAGD |
| | | | | CCTTCGCCCGACCTGTTCTCGGGTTTCGCGAACGCGCCTACCACGCCATC | TTCTACTTC | CCAAGG | TQGYNAHLRLFIELPA |
| | | | | GCCGCCCTCCACGCCGWCWTCGTCGCCAGCAGGCTCGCCCATCCCGGC | ACACCTCC | CCTACC | RGLAVPTNCRGAART |
| | | | | TGCCAGACGCTTCGTCCTGCCTGTGGCCACGCCCTACCCGGCCCCCGCG | TCCTCCTC | GGGGCG | KLQRERLLDIAAGRIP |
| | | | | CCGCGTGCTAACAGGCCCAAGCTGTCGCCGGTCGCGCGCCCCTTCGTCC | CTTCTCGA | GCTCTTT | AIPDPPCDAPGADDA |
| | | | | CTAAGGCGCGAGCCGGAGCGATACCTGAGGCGTCCTCACCTGTGACGC | CCCGCGCG | TTCGCCC | LRGFPVSGTTAGDVS |
| | | | | CTCAGGACCGCGCCGTCTCACGCCGCGAAGACGCCGCCGCCGCCCCTTC | GCCTCGAG | TGGTTTT | NDDDSGGVHDRPAA |
| | | | | GTCCGCGCCGGGCCTCGGCCTAGCAGACGAACACGAGGACGATGACAC | CGACTTGC | TGCCGG | TASARQAKRLVEQGL |
| | | | | GTACGGCGGTGACACAATCGCGCTCACTGCCCCCCACGCGCCCCGTGAG | TGCAGCGG | CCTGTTT | SSRALRALERGEPAV |
| | | | | ACCCGCGCCCCCTTCGAGTTCGAGGCGTGTTTCCTCGAGGAGGAAGCCC | CTCCCGGC | TTTCTCT | ASADTLGRLEALHPP |
| | | | | CAGCCACCGCCGGCGACCTCCCGCCTTACGCGCGCGCCTTCCTCGCTTGC | CTCCCCCA | CCCCCTT | NPTDRGLWPGAPKA |
| | | | | CCGTCAGCCCGTCTCCAGGAGATCCCGCGCCGCCTCAAGTCCGCGTGGC | CGCGGCCT | TTCCCCC | AIPRVTAKHLAQVAK |
| | | | | AGGCCGCCGCCAAGACCATCGCGGAAGCCGCGCTGGATTGCCACACCG | GCTACTCC | CTTTTCC | ELPRGSAPGPSGWTF |
| | | | | CGGGCGACACGCAGGGCTACAACGCCCACTTGCGGCTCTTCATCGAGCT | CGCTTTCT | ATTTGTA | ELVQAAIDRQPTGTV |
| | | | | GCCGGCCCGCGGGCTGGCAGTGCCCACCAACTGTCGAGGCGCCGCCCG | AGACGCCC | CTTAGTT | AAFLIDMAQRALRGT |
| | | | | CACCAAGCTTCAACGAGAGCGCCTGCTCGACATCGCCGCCGGAAGGAT | CCGGTCTT | TTTCCTT | LHWRGLLTASRLVAL |
| | | | | CCCGGCCATCCCGGACCCGCCGTGCGACGCCCCGGGCGCCGACGACGC | GCTCTCAG | CGGCCG | KKPDGGVRPIAVGEA |
| | | | | CCTACGCGGTTTCCCCGTATCGGGGACGACAGCCGGCGACGTCAGCAA | TCTCCCGC | CGGCAG | LYRVIGRLVLKADRV |
| | | | | CGACGACGACAGCGGAGGTGTGCACGATCGGCCCGCGGCCACCGCCAG | ATCGAAGC | CTTGTTG | MSSADATQYVGRHQ |
| | | | | CGCCCGGCAAGCCAAACGGCTAGTGGAGCAAGGGCTCTCCTCCCGAGC | GGTAGTCG | CCCGGC | YGVAYPGGVEAPVH |
| | | | | CCTCCGTGCCCTTGAACGGGGCGAGCCCGCGGTCGCCTCGGCAGACAC | GGGTACGT | ATAGTG | AVRELHDSGQLRAVV |
| | | | | CCTCGGGCGTCTCGAGGCGCTCCACCCGCCTAACCCCACCGACAGAGGA | GCTCAAGT | TTAATAT | SLDWRNAFNSLDRV |
| | | | | CTATGGCCCGGCGCCCCGAAGGCCGCGATCCCGCGGGTCACCGCCAAG | GACTCAAG | GTTTAA | HTALLIADRAPALARL |
| | | | | CACCTGGCCCAAGTGGCCAAAGAGCTCCCGCGCGGTAGTGCGCCGGGT | CCTCTTTTC | AAAACG | YEWSYREDSVLVLPR |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCCTCGGGCTGGACGTTCGAGCTCGTGCAGGCGGCCATCGACCGCCAA | AGCCTCGG | TGTAAA | AFEKAGLPASLLSQA |
| | | | | CCCACGGGCACGGTTGCCGCGTTCCTCATCGACATGGCGCAGAGAGCCC | CGCTCTCT | TAAATA | GVRQGDVLGPLFFAI |
| | | | | TCCGGGGCACCCTACACTGGCGGGGATTGCTCACCGCCAGCCGCCTTGT | CAATCCGC | ACTGTTT | GAAPVLDEIDAIPYVT |
| | | | | CGCGCTGAAGAAGCCCGACGGCGGTGTACGACCCATCGCCGTAGGCGA | CTCAGTCT | AACCCT | PRAYLDDIFVTIPHGV |
| | | | | GGCCCTCTATCGCGTCATCGGCCGCCTTGTTCTCAAGGCCGACAGGGTG | TAGCCTTT | AACCCT | TDAATKAAVAATFAT |
| | | | | ATGTCGAGCGCCGACGCCACGCAATATGTCGGGCGGCACCAGTATGGC | CAAGTTGC | AACCCT | AEREGAAAGLRLNRC |
| | | | | GTGGCCTACCCCGGTGGGGTTGAGGCCCCGGTCCACGCCGTCCGCGAA | TCGATTAC | AA (SEQ | KSAVWAADAEALLP |
| | | | | CTGCACGACAGCGGCCAGCTCCGAGCGGTCGTCTCGCTCGACTGGCGTA | GCTCTCGA | ID NO: | PHAAGAREDVESCA |
| | | | | ACGCGTTCAACTCGCTCGACCGCGTGCACACGGCCCTGCTCATCGCCGA | ATCGCTCT | 1278) | PVREGLKILGAPVGSP |
| | | | | CCGCGCACCCGCTCTCGCGCGACTCTACGAGTGGTCCTACCGTGAGGAC | CTCTCTCA | | AFVAKSLDGIIKRAIG |
| | | | | TCAGTCCTCGTGCTGCCGCGCGCGTTCGAAAAGGCGGGGCTGCCGGCC | GTCTCAGT | | TLDLVADAELPLQHK |
| | | | | TCCCTGCTCTCCCAGGCCGGCGTGCGCCAGGGCGACGTCCTGGGACCCC | CTCAGTCT | | LVLLRQCVAQIPTFW |
| | | | | TCTTCTTCGCCATCGGCGCTGCCCCGGTCCTCGACGAGATCGACGCCATA | CAATCTCG | | ARAVPDAGPALAVW |
| | | | | CCGTACGTGACGCCGCGAGCGTACCTCGACGACATCTTCGTCACGATAC | ATCTTGCC | | DTALLRRTGALVGLD |
| | | | | CCCACGGTGTCACGGACGCCGCGACCAAGGCCGCCGTCGCTGCCACCTT | TTCGCCTT | | VRDGSLQADIARLPV |
| | | | | CGCTACGGCGGAACGCGAAGGCGCGGCCGCTGGCTTGCGGCTCAACCG | CGTCTCGA | | RLGGLGLRSMKDTAP |
| | | | | CTGCAAGTCGGCGGTGTGGGCCGCGGACGCAGAAGCCCTCCTTCCCCCC | CGCCTTGC | | RAFVASILFAAALANT |
| | | | | CACGCCGCTGGCGCGCGGGAGGACGTCGAGAGCTGCGCACCAGTGCG | TCTCGWA | | RRSELTCSASTARRLR |
| | | | | CGAGGGCCTCAAAATCCTCGGCGCGCCCGTGGGCTCGCCCGCCTTCGTC | ATCGCTGC | | AALPELARTDACNDE |
| | | | | GCCAAGTCGCTCGACGGCATCATCAAGCGCGCCATCGGCACACTCGACC | CACTACGT | | AAWRRSIARGVFPD |
| | | | | TCGTCGCTGACGCCGAGCTACCGCTGCAGCACAAGCTGGTGCTGCTACG | GCCAGCTT | | VDKLGTTQLQRVLQ |
| | | | | GCAGTGCGTGGCCCAGATACCCACGTTCTGGGCCCGCGCCGTGCCCGAC | TTTCGTGC | | GMADSKSAHRTRRQ |
| | | | | GCAGGCCCGGCCCTCGCCGTCTGGGATACAGCGCTCCTCAGGCGCACG | CTTGTCTT | | VPFLFAAVFEDAATP |
| | | | | GGCGCGCTGGTCGGACTTGACGTGCGGGACGGGTCCCTGCAAGCCGAC | CGTGTCGA | | GSGAWLAAIPSDPTL |
| | | | | ATCGCGCGCCTGCCTGTCCGCCTGGGCGGTCTCGGCCTCCGTTCAATGA | CCCGGACC | | VLPDAELAEAVRIKLL |
| | | | | AGGACACGGCGCCCCGGGCCTTCGTGGCCTCGATCCTGTTCGCCGCCGC | GTTTGCAA | | TTTANAAGVCPACH |
| | | | | GCTCGCCAACACGCGCCGATCCGAGCTCACGTGCAGCGCCAGTACGGC | GCCCTCGC | | KTGIDPSHAYTCVSLS |
| | | | | CCGACGCCTCAGAGCCGCCCTGCCCGAGCTGGCACGCACCGACGCGTG | CTTCGTAC | | HLRTARHDVVVRRVE |
| | | | | CAACGACGAAGCCGCCTGGCGGCGGTCCATCGCCAGGGGAGTCTTCCC | CCCGCTCT | | LACKTEKPVREHVLAI |
| | | | | CGACGTGGACAAGCTGGGCACCACACAACTGCAGCGCGTCCTCCAGGG | CGTAGCCG | | PPVAPTDNNNNGDE |
| | | | | GATGGCGGACTCCAAGTCCGCCCATCGGACCCGCCGCCAAGTGCCCTTC | TTCTCATC | | DGSPVTTADDNADG |
| | | | | CTCTTCGCCGCCGTGTTCGAGGACGCCGCCACGCCGGGATCCGGTGCCT | GCTGAAGC | | HAVATKRRPETRASA |
| | | | | GGCTGGCCGCCATACCCTCCGACCCGACCCTCGTCTTGCCAGACGCCGA | GTTCTACG | | RAAAAAATAAAAAAI |
| | | | | ACTGGCCGAAGCCGTGCGCATTAAGTTGCTCACGACGACGGCCAATGC | CGCTGGCA | | INDNSLLSDDDDDDD |
| | | | | GGCCGGCGTCTGTCCGGCATGCCACAAGACCGGCATCGACCCGTCCCAC | GCAAGCCT | | HDDNCHGEERGEGE |
| | | | | GCGTACACGTGCGTTTCGCTATCCCATTTGCGCACAGCACGCCACGACG | CGGCCCTA | | RNVTCPGHYTATPFA |
| | | | | TGGTCGTTCGCCGAGTCGAGCTCGCCTGCAAGACCGAGAAGCCGGTCC | GCTTGTAG | | ADDTLDNSDEDNED |
| | | | | GCGAACACGTGCTCGCCATCCCCCCCGTCGCGCCCACCGACAACAACAA | CGCCGCCG | | NAHEDDDEDGKDD |
| | | | | CAACGGCGACGAGGACGGCAGCCCAGTCACCACCGCCGACGACAACGC | GTGGCCGC | | NDDDVYNNCNSSSS |
| | | | | AGACGGCCACGCGGTCGCGACCAAACGTCGCCCCGAGACCCGCGCTTC | TCGCCAAC | | DGDEGGDDLDYEYS |
| | | | | AGCCAGAGCCGCCGCCGCCGCCGCCACCGCCGCCGCCGCCGCCGCAAT | (SEQ ID | | DQSVTRSVDAATGES |
| | | | | CATCAACGACAACAGCCTCCTGAGCGACGACGACGACGACGACGACCA | NO: 1155) | | PNPERPTTPTRALLRA |
| | | | | TGACGACAACTGCCACGGAGAGGAAAGAGGAGAGGGAGAAAGGAAC | | | DLWLPATSTAVDVM |
| | | | | GTCACGTGCCCCGGCCACTACACCGCCACACCCTTCGCCGCGGACGACA | | | VAAACRRSRAKAFDR |
| | | | | CGCTCGACAACAGCGACGAGGACAACGAGGACAACGCTCACGAAGACG | | | AVSRKAAKYGPAVA |
| | | | | ATGACGAAGACGGTAAAGATGACAACGACGACGACGTCTACAACAACT | | | DGSIAKVVPFVVSPF |
| | | | | GCAACAGCAGCAGCAGCGACGGGGATGAAGGCGGTGACGACCTGGAC | | | GVLSRPAKAFLKRAM |
| | | | | TACGAGTACAGTGACCAGAGCGTCACTCGAAGCGTCGACGCCGCGACG | | | GDTTAAKQAKARLRL |
| | | | | GGAGAGAGCCCCAACCCCGAGCGCCCTACCACGCCCACCCGCGCACTAC | | | AVAAVRGTARLSYA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TACGCGCGGACCTGTGGCTACCCGCCACCTCCACCGCGGTGGACGTGAT<br>GGTCGCGGCCGCCTGCCGTCGGTCACGCGCCAAGGCCTTCGACCGAGC<br>CGTCAGCCGCAAGGCCGCGAAATACGGCCCTGCGGTAGCCGACGGCTC<br>GATCGCCAAGGTGGTGCCGTTCGTCGTGTCGCCCTTTGGCGTACTCTCG<br>AGGCCGGCCAAGGCCTTCCTCAAGCGCGCCATGGGCGACACGACGGCG<br>GCCAAACAGGCCAAGGCGCGTCTGCGCCTCGCCGTGGCCGCCGTCCGA<br>GGCACGGCCCGCCTCTCCTACGCCTGGGGCGCCTGCGCCGCCCTCATCG<br>TCGGCGGCAACTAAGCCGCGCGACGAGGACGGCCAGGACGACCAGGA<br>CGACGGCGACGGCGACCACCTAGCACCGCACGCGCCACGACATATTGT<br>CGCGCGCTGTACAGGCGGCTAGGTCGAGCCCAGCCGACCGTTCTGAGC<br>CTCAGTCGGCTTGAGCCCCCGGCTTCCCAAGGCCTACCGGGGCGGCTCT<br>TTTTCGCCCTGGTTTTTGCCGGCCTGTTTTTTCTCTCCCCCTTTTCCCCCCT<br>TTTCCATTTGTACTTAGTTTTTCCTTCGGCCGCGGCAGCTTGTTGCCCGGC<br>ATAGTGTTAATATGTTTAAAAAACGTGTAAATAAATAACTGTTTAACCCT<br>AACCCTAACCCTAA (SEQ ID NO: 1032) | | | WGACAALIVGGN<br>(SEQ ID NO: 1400) |
| CRE | Cre-<br>1_FCy | — | *Fragilari-<br>opsis<br>cylindrus* | ATCAATCTAATACTGAAGGCAATACCAAACTCAACCCGAAATCAAAATC<br>GTTAGAATCAATATACGACCCCCGCTGCTGTACATGTCCAGCCGGATCTC<br>GTTGTAAAGAAGATTGCAGCTGTAAAAAAGTTGGACTTCTTTGTTCTTCC<br>TGTGAAGAAGTTGATTGTGGCTGTTCAAATTCTTTTCATAATAAAGAATT<br>AATGGCTCCACTTCCTTGGAATGCTGCGACATCTTCACCACCGTCACCTG<br>TCCCATTAACTAACGATAAGAAAAAGGATTCTACTCTACCTACTGCAACA<br>TCAAAAAATTTATCCAAAAATAATAATAATAAAAATAATAATACTAATAG<br>GATTAATAATATTAAAAATAATGATAATACAAATGATGGTTCTAATAAG<br>ATAAATTTGAAACTGCCCCCGGCAGCTGTTAAAATCACAAATCCTTATAA<br>GAACAAAAAGAAGAACAAGAAGAAGAATAACGCTGGAAAGTCGAACC<br>CCAAAACAAACCAAAATCCAAATTCAAGTCCACTTTCGGATAATGATGAT<br>GATGATACTGATAGCTCAAACATCACCATTAATAGACGACTAAAATTTG<br>GTACTGATGATTTAGCACCTCCAAACCCACCGTCAAATACTAATACTATT<br>GGTACTGCTACTGCTGCCACCGCTGCCACTGCTACAACTACGGCAACCG<br>CAGCGACTGCTACTACTGCTACCAACACTACTACTACTACTACTACTACT<br>AATAACACTACTGGAGACAATCTTGCAAGTAATATTAATAATAATAATAA<br>TAATAATAATAGTGGCAGTAACAATAGCAACACCAATAATATTAACAAT<br>ACCGATGGCAATGGTAGTAATAATCGCCCACCTCCCCGTGTTTACACAG<br>TCGATCCACGAAGCGACCTTCCCGGTGCAGAAATCTCTGCTGCAAATAA<br>AATGTTAGATGAAGTATATGGAGACCATGTCCATGACAACCCCGGCTCC<br>CATCTCAGCGGACTTATTAGCAGCTCTCAAGATCAACTCTGGCAGGGTT<br>ACTTTCGTCGCCTTATACCTCACAACCAATCTCTCTATGACTGCCCTAAGG<br>GAAAACTGGGTAAGGATATAACGAATGAATATTCAAACTTATTTGAGGC<br>AATCATGAATGGCAAGTGTAATATGGAGAAGCTACTCGTGTTTCCAGTA<br>GTGGTTCTACAACGGAGACACGGAGTGACTAAGAATGCCGACGTTAAA<br>CGCCGTCTTCTTAGCCGACTCACCGCTTGGAAGGAAGGCAAATTCAAGT<br>ATCTTGTTGAAGACACACATCGAGATCTTATTGCCAAACAATCCAAAGCA<br>AGAGGAGATACAACCCCCGCGCACAGAGCTAAAGTTTACTCAAGTAAAC<br>TCATGCGTGGACATCTCCAATCAGCCGTCAACTACATCACTGACCGCGA<br>AGGAGGGGGCATCCTTTATCCTTATGACGTCGATGAGAAATCAGGCCAT<br>ACTGTATCAAGAGTGCTACAGGATAAGCATCCCAGCATGCGTGATCCTG<br>GTCCCACAGCCATGCCTGCCTACGAGTCCGTCCCGGAACTTCCAACACTT<br>GAAATTACAGCTGATACAGTTGAGATAGTCGCTGGAAAGCTCAGTGGT | ATCAATCT<br>AATACTGA<br>AGGCAATA<br>CCAAACTC<br>AACCCGAA<br>ATCAAAAT<br>CGTTAGAA<br>TCAATATA<br>CGACCCCC<br>GCTGCTGT<br>ACATGTCC<br>AGCCGGAT<br>CTCGTTGT<br>AAAGAAG<br>ATTGCAGC<br>TGTAAAAA<br>AGTTGGAC<br>TTCTTTGTT<br>CTTCCTGT<br>GAAGAAG<br>TTGATTGT<br>GGCTGTTC<br>AAATTCTT<br>TTCATAAT<br>AAAGAATT<br>A (SEQ ID<br>NO: 1156) | TAGCAC<br>CACCATC<br>TATTCAT<br>ATCCAC<br>ACACTG<br>ACCACCT<br>CCACCTT<br>CACAAC<br>TCCACTC<br>TCAATTC<br>CCCTGA<br>CTACTAA<br>GAAATA<br>TTTCATG<br>GTGGTT<br>ACATTG<br>GAGGTA<br>TCCCAAC<br>ACCAAG<br>CACAAA<br>ATGAAC<br>CCACTA<br>ACCCTCT<br>CATCCTA<br>TCCACG<br>GGGACC<br>ACCTTTG<br>AGCAGA<br>ACACCA<br>TTCATAT<br>TACAAC<br>CTTTAGC<br>TAGATT | MAPLPWNAATSSPP<br>SPVPLTNDKKKDSTLP<br>TATSKNLSKNNNNK<br>NNNTNRINNIKNND<br>NTNDGSNKINLKLPP<br>AAVKITNPYKNKKKN<br>KKKNNAGKSNPKTN<br>QNPNSSPLSDNDDD<br>DTDSSNITINRRLKFG<br>TDDLAPPNPPSNTNT<br>IGTATAATAATATTT<br>ATAATATTATNTTTT<br>TTTTNNTTGDNLASN<br>INNNNNNNNSGSNN<br>SNTNNINNTDGNGS<br>NNRPPPRVYTVDPRS<br>DLPGAEISAANKMLD<br>EVYGDHVHDNPGSH<br>LSGLISSSQDQLWQG<br>YFRRLIPHNQSLYDCP<br>KGKLGKDITNEYSNLF<br>EAIMNGKCNMEKLL<br>VFPVVVLQRRHGVTK<br>NADVKRRLLSRLTAW<br>KEGKFKYLVEDTHRD<br>LIAKQSKARGDTTPA<br>HRAKVYSSKLMRGHL<br>QSAVNYITDREGGGI<br>LYPYDVDEKSGHTVS<br>RVLQDKHPSMRDPG<br>PTAMPAYESVPELPT<br>LEITADTVEIVAGKLS<br>GGAGLSGVDSIQLKH |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGTGCAGGTCTGAGTGGAGTTGATTCAATACAACTCAAGCACCTCCTCC | | AAGATA | LLLHHGQASQRLRNV |
| | | | | TCCATCACGGTCAAGCAAGCCAACGACTGCGCAATGTTTGTGCAAAATT | | ATTATTT | CAKFGRWLANEHPP |
| | | | | TGGTAGATGGCTTGCCAACGAGCACCCCCCCTGGGCCTCGTACCGTGCC | | AGTACA | WASYRAMLANRLIAL |
| | | | | ATGCTAGCAAATAGGCTTATTGCGCTAGACAAAATGCCCGGAATTCGAC | | TATTTTA | DKMPGIRPVGIGDT |
| | | | | CAGTCGGTATAGGTGATACATGGCGTCGTTTCTTCGCCAAACTTGTTCTA | | TACTATT | WRRFFAKLVLAVSM |
| | | | | GCAGTCTCTATGTCTTATGCTACTGACTGTTGTGGGTCAGACCAGCTCTG | | AAAAAA | SYATDCCGSDQLCAG |
| | | | | TGCCGGACTAAGAGCCGGAGTTGATGGTGCCATACATGGACTATCGGC | | AAAAAA | LRAGVDGAIHGLSA |
| | | | | TATGTGGAGGGAGATGGAATCTGAGGAAAACACAGGTTTCGTACTTATT | | AAAA | MWREMESEENTGF |
| | | | | GACGCAGACAATGCATTCAATGAGGTCTCACGCATCAACATGTTATGGA | | (SEQ ID | VLIDADNAFNEVSRI |
| | | | | CGATCCGCCACGAATGGCCTGCTGGAGCTCGATTCGCCTTCAACTGCTA | | NO: | NMLWTIRHEWPAG |
| | | | | TCGGCACCACAGCCTACTAGTGGTACGGAATCCAGGGGGAAACCCTTC | | 1279) | ARFAFNCYRHHSLLV |
| | | | | ACTTTCTTTTCTAAAGAAGGTGTCACACAGGGCGACCCATTTGCGATGAT | | | VRNPGGKPFTFFSKE |
| | | | | AGCATATGGTGTCGCTCTCCTACCACTCATCCGCAAACTGAAAGAATTAA | | | GVTQGDPFAMIAYG |
| | | | | ATGTATTATTAGTTCAATCTTGGTATGCAGATGATGCTAGCGCAGCTGG | | | VALLPLIRKLKELNVLL |
| | | | | CAAATTTGATGAAATACTACGCCTTTTTCAAGATTTATTACGAATGGGAC | | | VQSWYADDASAAGK |
| | | | | CTGATTTTGGGTACTTTCCTAATGCATCTAAGAGTATCCTCATCACCCATC | | | FDEILRLFQDLLRMG |
| | | | | CCGACAATGTGGTTGCAGCTCACCACTTCTTCAACGAGACCCATGGCCT | | | PDFGYFPNASKSILIT |
| | | | | AGGTTTCAAGATCAGCACAGGAAGTCGTTTCCTGGGTGGTTTCATTGGA | | | HPDNVVAAHHFFNE |
| | | | | GATACCACAAGTCGAGATGAATACGTATCAACAAAAATCGCCGACTGGA | | | THGLGFKISTGSRFLG |
| | | | | TCCACGGCACCAAGGAGCTAGCAGCAGTAGCAAGATTGAAGTATCCAC | | | GFIGDTTSRDEYVSTK |
| | | | | ACGCAGCTTACACAGGCATTACCAAGTGTTTGCAGCACAAGTGGAGTTT | | | IADWIHGTKELAAVA |
| | | | | TACTCAACGTGTTATTCCTGGCATTGATGACCTCTTCCAACCACTGGAGG | | | RLKYPHAAYTGITKCL |
| | | | | ATGAACTCACCAATAATTTGCTCCCCGCCCTATTTGGAGACCCCCCATCC | | | QHKWSFTQRVIPGID |
| | | | | ACTATGGATGACAAGCTCAGACTTTTGACCGCTCTGCCAGTCAAACATG | | | DLFQPLEDELTNNLLP |
| | | | | CTGGGCTTGCTCTCCCGAATCCAGTTACCTCCTCCGCAACCAACTACAAG | | | ALFGDPPSTMDDKLR |
| | | | | AATAGCACTCTTATGAGTTCTCATCTTCTGTTGGCTGTTCAAGGCAAGAT | | | LLTALPVKHAGLALP |
| | | | | CAACTTCAGTTTACAGGACCACAGAGATACCTGTCAATCCTCTCTCTCCG | | | NPVTSSATNYKNSTL |
| | | | | CGTCCCGAGAGCTCCGACAAACCGAAAATGATTCTTCATTGACCAACCTC | | | MSSHLLLAVQGKINF |
| | | | | CTTGCAGCTCTCCCTCCAGCTGCTGCAGGTCAACCAAGCACAACAAGAG | | | SLQDHRDTCQSSLSA |
| | | | | CAATCAAGCGTGCTGGGGAAACCGGTCTTTGGCTTACTACTATCCCTAAT | | | SRELRQTENDSSLTNL |
| | | | | CACATCAACGGTAACATTCTCGGATGTGACGAATTTATTGATGCTATTCG | | | LAALPPAAAGQPSTT |
| | | | | ATTGAGATACCAAAAAGTGCCACACAATCTCCCTGCCAAATGTGATGGC | | | RAIKRAGETGLWLTTI |
| | | | | TGTGGCTCTGCATTTGATGTAGGGCACGCGCTCCAATGCAAATCCGGGG | | | PNHINGNILGCDEFID |
| | | | | GCCTAATCATTAGACGTCATGATGAACTCAATCTTGAGCTTGCATCTTTA | | | AIRLRYQKVPHNLPA |
| | | | | GCAAAGATGGCCTTGAGAGAATCTGCAATACGTGCTGAACCTGAAATCA | | | KCDGCGSAFDVGHA |
| | | | | ACCCCAGCGCCTCTATTATGGATTCTCCCACCACCATCACAGCCATCGAC | | | LQCKSGGLIIRRHDEL |
| | | | | ACAAACGGAGACCGAGGAGATTTGTTGATCAAGGGCTTTTGGGACAAT | | | NLELASLAKMALRES |
| | | | | GGAATGGACGCTATCATCGATGTCAGAATAACAGACACAGATGCCAAAT | | | AIRAEPEINPSASIMD |
| | | | | CCTATCGAACAAGAGACCCAAAAAAAGTCCTACAGTCACAAGAGAAGG | | | SPTTITAIDTNGDRG |
| | | | | AGAAAAAGAAGAAATACCTCGATCAATGTCTACTCCAACGTCGAGCCTT | | | DLLIKGFWDNGMDA |
| | | | | TACCCCTTTTGTTGTCTCTGTGGACGGCCTGATTGGTTACGAGGCCAGCA | | | IIDVRITDTDAKSYRT |
| | | | | ATGTGCTAAAGCAATTATCAAAACGTTTAGCAGATAAATGGAATAAGCC | | | RDPKKVLQSQEKEKK |
| | | | | TTATTCAGTTACATGTGGAATAGTCCGCTCACGTATCAGCATTGCATGTG | | | KKYLDQCLLQRRAFT |
| | | | | CGCGAGCTTCCAATCAATGTCTGAGAGGTTCTCGAATACCATTCAAAAC | | | PFVVSVDGLIGYEAS |
| | | | | AATGAGCAGACAAATTCAATGGGAGGACGGTGCAGGCGCCGGCCTCTA | | | NVLKQLSKRLADKW |
| | | | | TAGAATTGTCCGCTAGCACCACCATCTATTCATATCCACACACTGACCAC | | | NKPYSVTCGIVRSRISI |
| | | | | CTCCACCTTCACAACTCCACTCTCAATTCCCCTGACTACTAAGAAATATTT | | | ACARASNQCLRGSRI |
| | | | | CATGGTGGTTACATTGGAGGTATCCCAACACCAAGCACAAAATGAACCC | | | PFKTMSRQIQWEDG |
| | | | | ACTAACCCTCTCATCCTATCCACGGGGACCACCTTTGAGCAGAACACCAT | | | AGAGLYRIVR (SEQ |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCATATTACAACCTTTAGCTAGATTAAGATAATTATTTAGTACATATTTTA | | | ID NO: 1401) |
| | | | | TACTATTAAAAAAAAAAAAAAA (SEQ ID NO: 1033) | | | |
| CRE | Cre- | — | *Hydra* | TTTCTAATGTTACGTGATATGATATGGTTAGTTCATGGTTAGTTTATGTTT | TTTCTAAT | TAACTTG | MNMVSICKRCDRSF |
| | 1_HM | | *vulgaris* | ATGCTTAGTTTATGGAAAATCGTTTATTTATGGCACAATATTGTTTGCTG | GTTACGTG | TATTTTT | TTLKGLNIHKGQCKIF |
| | | | | TTTTTAAATTTATGTAACGTGTGCATTTGATGTATATTCTTGAACTTTTTA | ATATGATA | AAATTG | VSNTNKQINNVVNN |
| | | | | ATCTGAATTTTTACTTGGTTTAATACGTTTATTATATTCTTCGATTGAGCA | TGGTTAGT | TTTTATT | ELTTPNKNKVEINTIL |
| | | | | ATTTATCCTATCAAAGCAATTTATCCTTCGATTCGAGCAATTTATCCTTCG | TCATGGTT | AGTTT | NCDEISVEHYSTNTPY |
| | | | | ATTCGAGCAATTTATCCTTCGATTGAGCAATTTATCCTATCAAAATTAGC | AGTTTATG | (SEQ ID | LPKINICESIIDPNDYL |
| | | | | ATATATACTGCAATTTTCAAATAATCTACGAAATAAGTTCACTTACTGAA | TTTATGCT | NO: | WGHMPFSFLLNHVN |
| | | | | AATCATTAAGTAAAAGAAGAAAGGAAGAAAAAATAAAAATAAAAAGTA | TAGTTTAT | 1280) | TIYDEIVFYHKNLFKV |
| | | | | GTAAATCCTTTCATAACAATAATCATTCTATTATTAAATTTAAAGGAATAT | GGAAAATC | | PSGKGGKMFIEELTF |
| | | | | TTTGGTTTTGTACTAAATCATGCGTTCATATTTCACCGAAGAAGGGGGCT | GTTTATTT | | WLKQFNNRTKLNGI |
| | | | | GCTATATTTTTGTTTGAAGTTGTTTATCTTAAAACTTTAAACTTGTGTTCA | ATGGCACA | | AMKCFMIVPSLMLQ |
| | | | | ACCAACCGTAAACATTAGTTCGCTGTTCGCTCAAATTATCTACAATATAA | ATATTGTT | | KPSIRSKAKEHAECLV |
| | | | | AATTTATCAATCTTTTTTCGTTACGGTAAACAATAAACAATAAAATAACT | TGCTGTTT | | RRITLWRNGNFSELM |
| | | | | ATAGTTATTTTATTGTTTACCGCATATTGTTTAACTATAGTTAAACAAAGT | TTAAATTT | | REIRYIQSKINTSKKKR |
| | | | | ATTTGTTTATGGAACATTACCAGTATCTCTTGTTAAGGTAAACAACAAAA | ATGTAACG | | TFEDISRIFAKLMME |
| | | | | CATAGACGGCATCTCTTTTTAAGGTAATTAAGTATACGGCTAATAATAAA | TGTGCATT | | GKVAAALKVLDRESS |
| | | | | AATATACAGCTAATAATAAAATCTTCAATGAACATGGTTTCTATATGCAA | TGATGTAT | | GILQCSESVLKELKSK |
| | | | | AAGATGTGATCGTAGCTTTACTACCCTTAAGGGACTAAATATTCATAAA | ATTCTTGA | | HPDETPVQDNCLLYG |
| | | | | GGTCAATGTAAGATCTTTGTTTCCAATACAAATAAACAAATAAACAATGT | ACTTTTTA | | PLQNTPECLFDSIDEI |
| | | | | AGTTAACAATGAATTAACAACACCGAATAAAAACAAGGTGGAAATTAAT | ATCTGAAT | | SIFNSALQTKGSAGPS |
| | | | | ACGATATTAAACTGCGATGAGATATCTGTAGAACACTATTCAACCAACA | TTTTACTT | | GMDADLYRRVLCSK |
| | | | | CACCTTACTTACCCAAAATAAATATTTGTGAATCTATTATAGATCCCAAC | GGTTTAAT | | CFGPSCKTLREEIATF |
| | | | | GACTATCTATGGGGTCATATGCCGTTTAGCTTCCTTCTCAACCATGTCAA | ACGTTTAT | | TKNIATKSYQPDIVQP |
| | | | | CACAATATACGATGAAATAGTATTTTACCATAAAAACCTTTTTAAAGTGC | TATATTCTT | | YIACRLIPLDKNPGIRP |
| | | | | CATCAGGAAAAGGTGGTAAAATGTTTATAGAAGAACTGACCTTTTGGCT | CGATTGAG | | IGIGEVLRRIVGKTISH |
| | | | | AAAACAGTTTAATAATCGAACCAAATTGAATGGAATAGCCATGAAATGT | CAATTTAT | | HCQKEIKEAAGPLQT |
| | | | | TTCATGATAGTCCCTTCCCTAATGTTACAGAAGCCCTCAATACGGTCCAA | CCTATCAA | | CAGHGAGAEAAIHA |
| | | | | AGCCAAAGAACATGCAGAATGTTTAGTAAGACGAATTACATTATGGAGA | AGCAATTT | | MQKIFHQEDTDGVL |
| | | | | AACGGGAACTTTAGTGAATTGATGCGGGAAATTAGATATATTCAGAGCA | ATCCTTCG | | LIDARNAFNCLNRSV |
| | | | | AAATTAACACCTCAAAAAAGAAAAGGACATTTGAGGATATCTCAAGGAT | ATTCGAGC | | ALHNIQITCPILAMYL |
| | | | | ATTCGCAAAACTAATGATGGAAGGTAAAGTTGCTGCCGCACTGAAGGTT | AATTTATC | | VNTYRKPAKLFIYGGE |
| | | | | TTAGATAGAGAGTCATCTGGCATCTTGCAATGCTCGGAAAGTGTATTGA | CTTCGATT | | TIFSKEGTTQGDPLA |
| | | | | AAGAATTGAAAAGTAAACACCCAGACGAAACTCCTGTACAAGATAATTG | CGAGCAAT | | MPWYSLSTVTIINTLK |
| | | | | TTTACTATACGGCCCGTTACAAAACACTCCAGAATGTTTATTCGATTCAA | TTATCCTTC | | LVIPDVKQVWLADD |
| | | | | TTGATGAGATAAGTATATTTAACTCAGCTTTACAGACTAAAGGATCTGCA | GATTGAGC | | ATAAGKLQSLKKWYK |
| | | | | GGTCCTTCTGGAATGGATGCAGATCTTTACCGTCGAGTCCTATGCTCAAA | AATTTATC | | CLEDVGGLYGYYVNQ |
| | | | | ATGTTTTGGACCCTCTTGTAAGACTCTACGAGAAGAAATAGCAACATTTA | CTATCAAA | | SKCWLIVKSDNQAEE |
| | | | | CAAAAAATATTGCAACAAAATCCTACCAACCGGATATAGTTCAACCCTAC | ATTAGCAT | | AKLIFGNSINITTQGK |
| | | | | ATTGCATGTCGACTAATTCCCTTAGACAAAAATCCCGGGATTCGCCCCAT | ATATACTG | | RHLGAALGSEAYKKV |
| | | | | AGGAATTGGGGAAGTGTTACGTAGGATTGTAGGTAAAACCATTAGCCA | CAATTTTC | | YCEDLVSKWSKELNN |
| | | | | CCATTGTCAAAAAGAAATCAAAGAGGCAGCTGGACCACTACAAACTTGC | AAATAATC | | LCEIATTQPQAAYSAF |
| | | | | GCAGGACACGGTGCAGGAGCAGAAGCTGCAATACATGCTATGCAAAAG | TACGAAAT | | IKGYRSKFTYFLRTIEA |
| | | | | ATATTTCATCAGGAAGATACAGATGGTGTTTTGTTAATCGATGCTAGGA | AAGTTCAC | | FENFVTPVEKILSEKLL |
| | | | | ACGCGTTTAACTGCCTAAACCGTTCTGTTGCACTACATAATATACAGATA | TTACTGAA | | PVLFGTDCSIIKENRD |
| | | | | ACTTGCCCAATCTTAGCTATGTATTTAGTCAACACTTACCGTAAACCGGC | AATCATTA | | LLALNPSEGGLGICNL |
| | | | | AAAATTATTCATCTACGGTGGAGAAACTATTTTTTCGAAAGAAGGCACA | AGTAAAAG | | ITEAKEQHTASKKITN |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACGCAGGGCGATCCCCTCGCCATGCCATGGTACTCACTTAGCACTGTGA | AAGAAAG | | LHIKSILDQSDVMKEK |
| | | | | CAATCATAAATACATTGAAACTAGTAATTCCTGATGTAAAACAAGTATG | GAAGAAA | | DDFGKTFSEIKTKTN |
| | | | | GTTAGCCGATGATGCTACCGCTGCAGGAAAATTACAGTCTTTAAAAAAG | AAATAAAA | | MDKSKKKKEEVKKIH |
| | | | | TGGTATAAATGCCTAGAGGATGTCGGTGGTTTGTATGGTTATTATGTAA | ATAAAAAG | | AGLPENLKLLVEQAC |
| | | | | ATCAGTCAAAATGCTGGCTAATAGTAAAATCTGATAACCAAGCTGAAGA | TAGTAAAT | | DKGASSWLNTLPIKE |
| | | | | AGCTAAACTTATATTTGGCAACTCCATAAATATAACTACTCAGGGAAAAA | CCTTTCAT | | QHLDLNKEEFKDALR |
| | | | | GGCACTTAGGAGCTGCACTTGGTTCGGAAGCATACAAAAAAGTGTATTG | AACAATAA | | LRYNVPLANLPSYCA |
| | | | | CGAGGATTTAGTAAGTAAATGGTCTAAAGAACTTAACAATCTCTGCGAA | TCATTCTA | | CGEKFDELHAMSCKK |
| | | | | ATCGCCACCACGCAACCACAAGCTGCTTATTCAGCTTTTATTAAAGGGTA | TTATTAAA | | GGFVCNRHDNIRDLL |
| | | | | CAGATCTAAATTCACTTACTTCTTACGCACAATTGAAGCTTTTGAAAATTT | TTTAAAGG | | TVCLNKVCTDVQAEP |
| | | | | CGTAACACCAGTGGAAAAAATTTTATCAGAAAAATTATTACCTGTATTGT | AATATTTT | | HLIPLTNEKFNFKTAN |
| | | | | TTGGAACTGATTGTTCTATAATCAAAGAAAATAGGGATTTATTGGCGCT | GGTTTTGT | | TNDEARLDIKAKGFW |
| | | | | AAATCCATCGGAAGGAGGACTTGGAATTTGTAACTTAATAACTGAGGCC | ACTAAATC | | RKGETAFFDVRVTHV |
| | | | | AAGGAACAGCATACTGCCTCTAAGAAAATAACTAACTTGCACATAAAAT | ATGCGTTC | | NSKSSKKQPTKHIFRR |
| | | | | CAATACTCGATCAGTCAGATGTTATGAAAGAAAAAGATGATTTCGGGAA | ATATTTCA | | HEDAKKREYLERVLE |
| | | | | AACATTTTCAGAAATAAAAACAAAAACAAATATGGATAAATCTAAAAAA | CCGAAGAA | | VEHGTFTPLIFGTNG |
| | | | | AAAAAAGAAGAGGTTAAAAAAATACATGCAGGACTTCCAGAAAACCTT | GGGGGCT | | GFGDECKRFTALLAQ |
| | | | | AAACTTCTGGTTGAACAGGCCTGTGACAAAGGTGCCAGCAGCTGGTTAA | GCTATATT | | KLSLKMGERYGAVIN |
| | | | | ACACCTTACCAATTAAAGAACAACATCTAGATCTGAATAAGGAAGAGTT | TTTGTTTG | | WLRTRLSMEITRASLL |
| | | | | TAAGGACGCACTTAGATTGAGATATAATGTGCCACTTGCCAATTTACCAT | AAGTTGTT | | CLRGSRTPFRHYNTD |
| | | | | CCTACTGTGCTTGTGGAGAAAAATTTGACGAGCTACACGCAATGTCATG | TATCTTAA | | DVGLENVQCGLI |
| | | | | CAAAAAAGGTGGCTTTGTTTGTAACAGACATGATAACATCAGAGATTTA | AACTTTAA | | (SEQ ID NO: 1402) |
| | | | | TTAACTGTTTGCCTAAATAAAGTTTGTACTGATGTTCAAGCGGAGCCGCA | ACTTGTGT | | |
| | | | | TTTAATTCCATTGACAAATGAAAAATTTAATTTCAAAACTGCCAATACCA | TCAACCAA | | |
| | | | | ACGACGAAGCTAGATTGGATATAAAAGCAAAAGGGTTTTGGAGAAAAG | CCGTAAAC | | |
| | | | | GAGAAACTGCATTTTTTGATGTTAGAGTAACGCACGTAAACTCCAAATC | ATTAGTTC | | |
| | | | | CTCCAAAAAACAACCAACAAAACACATATTCCGTAGGCATGAAGATGCA | GCTGTTCG | | |
| | | | | AAAAAACGTGAGTATTTAGAACGAGTTCTAGAGGTTGAACACGGGACA | CTCAAATT | | |
| | | | | TTTACCCCATTAATTTTTGGTACGAATGGTGGGTTTGGAGACGAATGCA | ATCTACAA | | |
| | | | | AACGCTTCACGGCACTACTCGCACAAAAACTGTCCTTAAAAATGGGTGA | TATAAAAT | | |
| | | | | GCGGTACGGAGCTGTTATAAATTGGCTAAGGACACGTCTTTCCATGGAG | TTATCAAT | | |
| | | | | ATTACTAGAGCCTCCCTACTCTGCTTAAGAGGGTCACGAACCCCATTTAG | CTTTTTTCG | | |
| | | | | GCATTATAACACTGACGATGTTGGCCTGGAAAATGTGCAATGTGGACTT | TTACGGTA | | |
| | | | | ATTTAACTTGTATTTTTAAATTGTTTTATTAGTTT (SEQ ID NO: 1034) | AACAATAA | | |
| | | | | | ACAATAAA | | |
| | | | | | ATAACTAT | | |
| | | | | | AGTTATTT | | |
| | | | | | TATTGTTT | | |
| | | | | | ACCGCATA | | |
| | | | | | TTGTTTAA | | |
| | | | | | CTATAGTT | | |
| | | | | | AAACAAAG | | |
| | | | | | TATTTGTTT | | |
| | | | | | ATGGAACA | | |
| | | | | | TTACCAGT | | |
| | | | | | ATCTCTTG | | |
| | | | | | TTAAGGTA | | |
| | | | | | AACAACAA | | |
| | | | | | AACATAGA | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | CGGCATCT<br>CTTTTTAA<br>GGTAATTA<br>AGTATACG<br>GCTAATAA<br>TAAAAATA<br>TACAGCTA<br>ATAATAAA<br>ATCTTCA<br>(SEQ ID<br>NO: 1157) | | |
| CRE | CRE-1_LSa | — | *Lactuca sativa* | ACATTAAATTAGAGAGGTTGATGTTTCAATGGAAGAAGATGAAATTCCA<br>AGAAGCTATTTTTGTTGCCCACCAAGTGTTTGATAAAATGTCCAAACTAA<br>TTTTTCTCTTGTTGCAGCTTTATTGTTCAAGATAATGTAGTTTGCTTAGTT<br>TGAGCGTTCCTTGTGCACACCAACAGTGTGTTGGTGTGCCATTTCCTTTC<br>CTTCCTTTTTAACTATTGCTTCATAGCTTAAGCTTCATCTCGAGGCTTGTT<br>CTCTTGTATGGCTTCTTCTTCTACAAGTTCGAGTGATATTTGTCTGTGCCC<br>GTTCAGAAGCTTCCATTGTTGCCCAAATGGTGAAGTGGGAAGTAAGGG<br>GATTGKCCGTATGATTTCACACATCAAAAGGCATCATCTACTTACTGAAG<br>ATCGTAAATGTGTTTTACGTGAAGCTCTTTCTAGTGATGTTGGTTTATTT<br>ATGGCGGTGGAAGAAACTTTGAAGGCCTTTGGTCAATGGATGTGTGGG<br>AAGTGTATGACTTTGCATGCTCTTAGCCGTTATTGTCATCACCCGGATGG<br>TCGTGTGAGKTTTGTTACAGGGGCTGACGGCTCGAGTCGTTACATTGTC<br>GGTATTCTAAAGCCGTCTACTAAAGAGTCGGTGACAAATGCTCTTGGAG<br>GTTTGGTTTTTGATGTTGGGCTCCTTGATCGTGTTTTTAAAGAGCCTATC<br>ACTACTGTCAAGAGTATCCCCCATAGTTGTCGCCTTGCTTTCTCTCAGGC<br>TTTGAAAACTGCTCTTTACAAGGTGATTGCCCAACCTGGCTCGGTTGATG<br>CATGGATTTGTTTGTTACTTCTTCCTCGCTGCACACTGCAGGTGTTTAGG<br>CCCAAAAATAGACAAGAATGTAGGTCTGGGAATAGAAAATCCTTACAAC<br>AAAGCTCCATCCTGAAGTCCTTGGATACATGGGGGAAAGAGGATGGTA<br>TCAGGAAGTTAGTTCAAAATATGTTAGACAATCCCGAGGTTGGGGCCAT<br>GGGACAGGGTGGAGGCATCCTTCAGAAGGAGTCTACATCAAGTAACAC<br>CAACATCAGGCAGTGTCTCCGTAAGGTTGCAGATGGKCATTTTACCGCA<br>GCAGTGAAAGTGTTATGCTCATCGGGTGTTGCGCCATATAATGGTGATA<br>CTATTAAAGCTTTGGAGGACAAACACCCTTTCAGGCCACCCCCATCCATG<br>CCGAGCCCCATAATTTCTGAACCTCCCCTTGTAGCAGACTTTGACTGTGT<br>ATTTGGTTGCATCAAATCCTTCCCTAAAGGAACTTCWTGCGGGAGAGAT<br>GGCTTGAGGGCTCAACACWTACTAGATGCCCTTTGTGGAGAAGGGTCT<br>GCTATAGCCACAGATCTCATACGTGCTATCACTTCAGTGGTTAATTTATG<br>GTTAGCGGGAAGATGTCCGACCATTTTGGCAGAGTTTGTTGCATCCGCT<br>CCTCTCACGCCTCTGATTAAACCTGACAACGGGATCCGTCCAATTGCAGT<br>AGGCACTATATGGAGACGTCTGGTTTCCAAGGTTGCCATGAAAGGTGTG<br>GGTAAAGAAATGGCCAAGTACCTTAATGATTTTCAGTTCGGGGTTGGTG<br>TGTCCGGGGGTGCTGAGGTTGTGTTACACAGTGCCAATAGGGTGTTGA<br>GTGAACACCACGCTGATGGGTCTCTTGCAATGCTGACAGTGGATTTCTC<br>GAATGCCTTTAACCTGGTGGATAGATCAGCCTTGCTCCACGAGGTTAAG<br>AGGATGTGCCCTTCTATTTCTTTGTGGGTGAATTTCTTGTACGGGCAAGC<br>AGCGAGACTTTATATAGGAGACCAACATATATGGTCTGCCACTGGGGTG | ACATTAAA<br>TTAGAGAG<br>GTTGATGT<br>TTCAATGG<br>AAGAAGAT<br>GAAATTCC<br>AAGAAGCT<br>ATTTTTGTT<br>GCCCACCA<br>AGTGTTTG<br>ATAAAATG<br>TCCAAACT<br>AATTTTTCT<br>CTTGTTGC<br>AGCTTTAT<br>TGTTCAAG<br>ATAATGTA<br>GTTTGCTT<br>AGTTTGAG<br>CGTTCCTT<br>GTGCACAC<br>CAACAGTG<br>TGTTGGTG<br>TGCCATTT<br>CCTTTCCTT<br>CCTTTTTA<br>ACTATTGC<br>TTCATAGC<br>TTAAGCTT<br>CATCTCGA<br>GGCTTGTT<br>CTCTTGT<br>(SEQ ID<br>NO: 1158) | TGAACT<br>ATATTTT<br>ATATATT<br>AAAAAA<br>A (SEQ<br>ID NO:<br>1281) | MASSSTSSSDICLCPF<br>RSFHCCPNGEVGSKG<br>IXRMISHIKRHHLLTE<br>DRKCVLREALSSDVG<br>LFMAVEETLKAFGQ<br>WMCGKCMTLHALS<br>RYCHHPDGRVXFVT<br>GADGSSRYIVGILKPS<br>TKESVTNALGGLVFD<br>VGLLDRVFKEPITTVK<br>SIPHSCRLAFSQALKT<br>ALYKVIAQPGSVDA<br>WICLLLLPRCTLQVFR<br>PKNRQECRSGNRKSL<br>QQSSILKSLDTWGKE<br>DGIRKLVQNMLDNP<br>EVGAMGQGGGILQK<br>ESTSSNTNIRQCLRKV<br>ADGHFTAAVKVLCSS<br>GVAPYNGDTIKALED<br>KHPFRPPPSMPSPIIS<br>EPPLVADFDCVFGCIK<br>SFPKGTSCGRDGLRA<br>QHXLDALCGEGSAIA<br>TDLIRAITSVVNLWLA<br>GRCPTILAEFVASAPL<br>TPLIKPDNGIRPIAVG<br>TIWRRLVSKVAMKG<br>VGKEMAKYLNDFQF<br>GVGVSGGAEVVLHS<br>ANRVLSEHHADGSLA<br>MLTVDFSNAFNLVD<br>RSALLHEVKRMCPSIS<br>LWVNFLYGQAARLYI<br>GDQHIWSATGVQQ<br>GDPLGPLLFALVLHPL<br>VHKIRDNCKLLLHAW |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAGCAAGGCGACCCCTTGGGCCCTCTTCTTTTTGCCCTCGTTTTGCACCC | | | YLDDGTVIGDSEEVA |
| | | | | GCTTGTGCACAAGATTAGAGACAATTGTAAGCTCCTTCTCCATGCTTGGT | | | RVLNIIRVNGPGLGLE |
| | | | | ATCTAGATGATGGGACTGTCATTGGGGATTCAGAGGAGGTGGCTAGAG | | | LNIKKTEIFWPSCDGR |
| | | | | TGTTGAACATTATTCGGGTGAATGGTCCAGGCTTGGGTCTTGAGTTGAA | | | KLRADLFPTDIGRPSL |
| | | | | CATCAAGAAAACGGAGATTTTTGGCCCTCCTGTGATGGTAGGAAGCTT | | | GVKLLGGAVSRDAGF |
| | | | | CGTGCCGATTTATTCCCAACGGATATAGGGAGACCTTCTTTGGGGGTGA | | | ISGLAMKRAVNAVDL |
| | | | | AGCTCCTTGGGGGGGCTGTTAGCAGAGACGCAGGGTTTATTAGCGGGC | | | MGLLPQLCDPQSELL |
| | | | | TGGCCATGAAGAGAGCGGTCAATGCTGTTGATTTGATGGGTCTTCTTCC | | | LLRSCMGIAKLFFGLR |
| | | | | ACAACTATGTGACCCGCAGAGTGAGCTCCTTTTGCTTCGATCATGTATGG | | | TCQPVHIEEAALFFDK |
| | | | | GCATTGCAAAACTTTTCTTTGGTTTAAGGACATGCCAGCCGGTGCACATA | | | GLRRSIEDMVVCGGP |
| | | | | GAAGAGGCAGCTTTGTTCTTTGACAAAGGATTGCGCAGGTCTATCGAGG | | | FFGDIQWRLASLPIRF |
| | | | | ATATGGTGGTATGTGGAGGCCCCTTCTTTGGAGACATCCAGTGGCGTCT | | | GGLGLYSAYEVSSYAF |
| | | | | GGCTTCCTTACCTATTCGTTTCGGTGGTTTGGGTTTGTACTCGGCATACG | | | VASRAQSWALQDHI |
| | | | | AGGTTTCCTCCTACGCATTTGTAGCCTCGAGGGCCCAATCTTGGGCATTA | | | LRDSGICGMDSDYLC |
| | | | | CAAGACCACATCTTACGTGACAGTGGCATATGTGGTATGGACTCTGATT | | | AMTRLRDTIPGFDCS |
| | | | | ACCTATGTGCTATGACTCGTCTTCGCGATACGATTCCGGGATTCGACTGT | | | GFTNKDTPPKSQKAL |
| | | | | AGCGGTTTCACTAATAAGGACACCCCCCCTAAATCCCAAAAAGCATTGG | | | ACALFSKIVKDMEVD |
| | | | | CGTGTGCCCTTTTTAGCAAAATCGTCAAAGATATGGAAGTCGACTTCGA | | | FDMTVRQKAVFECL |
| | | | | CATGACTGTTAGACAGAAAGCAGTTTTTGAGTGTCTTCGGGCACCTCAT | | | RAPHAQDFLLTIPIDG |
| | | | | GCTCAGGATTTTCTGCTAACTATCCCTATTGATGGCCTTGGCCAGCATAT | | | LGQHMSPVEYRTILR |
| | | | | GTCTCCTGTGGAGTACCGAACTATCCTTCGTTACCGCCTCATGATTCCTCT | | | YRLMIPLFPIDEICPVC |
| | | | | ATTCCCAATTGACGAGATATGCCCAGTTTGCCGCAAGGCATGTTTGGAT | | | RKACLDTFGEHAVHC |
| | | | | ACCTTTGGGGAACATGCGGTTCATTGTAGAGAGCTCCCTGGTTTCAAGT | | | RELPGFKYRHDVVRD |
| | | | | ACAGACATGATGTGGTTAGGGATGTTCTCTTTGATGCTTGTCGGCGTGC | | | VLFDACRRAGISAKKE |
| | | | | TGGTATTTCTGCGAAGAAAGAAGCGCCAGTGAACTTTTTGACGGACCCG | | | APVNFLTDPQDGRST |
| | | | | CAGGATGGAAGATCCACACTTAGACCGGCTGACATTTTGGTCTTTGGAT | | | LRPADILVFGWVGGK |
| | | | | GGGTAGGAGGGAAGCACGCGTGTGTGGATCTTACTGGGGTCTCTCCTC | | | HACVDLTGVSPLVGL |
| | | | | TCGTCGGTTTGAGGAGCGGGGGTTTCACAGCAGGGCATGCCGCTTTGA | | | RSGGFTAGHAALKA |
| | | | | AAGCCGCTGCGTGCAAAGTGGCAAAGCACGAGAATGCATGTATAGAAA | | | AACKVAKHENACIEN |
| | | | | ATCAACATGTGTTTGTACCTTTTGCATTTGATACATTTGGTTTTCTCGCAC | | | QHVFVPFAFDTFGFL |
| | | | | CAGAGGCGGTGGAGCTCCTCAACAGAGTCCAACGGGTCATGCATTCTA | | | APEAVELLNRVQRV |
| | | | | ATGTCATATCTCCTAGATCCACAGATGTTGTTTTCAAAAGAATTAGTTTT | | | MHSNVISPRSTDVVF |
| | | | | GCCATCCAGAAAGGGCTAGCGGCGCAGCTTGTTGCCCGTTTGCCTTCCA | | | KRISFAIQKGLAAQLV |
| | | | | TCGATATGTATTGAACTATATTTTATATATTAAAAAAA (SEQ ID NO: | | | ARLPSIDMY (SEQ ID |
| | | | | 1035) | | | NO: 1403) |
| CRE | Cre- | — | *Monosiga* | CATCTTGGCGTGAACCACGTTGTCAGACAAAATCTGCAACCCCGCTCTTT | CATCTTGG | TAGGTA | MATESGGEDSWTQ |
| | 1_MB | | *brevicollis* | GCGGCCCGCGTTTTGGCGGCGCCCTCGCTCCCACCGTGTCCGCTCGCTT | CGTGAACC | GGCACC | VRGAKRPSAESPPSN |
| | | | | GCTCGCTTGCTTGCCCCGCGGACATGGCCACTGAGTCCGGCGGCGAGG | ACGTTGTC | GTCTCG | TTTSPSQTHRSAKHT |
| | | | | ATTCTTGGACCCAGGTCCGCGGTGCTAAACGCCCGAGTGCCGAATCACC | AGACAAAA | GGGGTC | KHGSARHDRNHVFP |
| | | | | TCCAAGCAACACCACCACCTCGCCTTCCCAAACTCATCGTTCTGCAAAAC | TCTGCAAC | CCTCTGT | DPMTTPLRPHARHS |
| | | | | ACACAAAACATGGCAGCGCTCGCCACGACCGTAACCATGTTTTCCCTGA | CCCGCTCT | GGGGAT | VPTARASSHVPSTSP |
| | | | | CCCCATGACCACCCCGCTTCGCCCTCACGCCCGCCACTCTGTCCCTACCG | TTGCGGCC | CCCTGT | AAGATESSARAVVPA |
| | | | | CCCGTGCCTCGTCTCATGTGCCCTCGACGTCCCCCGCTGCCGGTGCGACC | CGCGTTTT | GTGCAC | AEPVTRTSNGGGEQ |
| | | | | GAGTCTTCGGCACGTGCCGTCGTGCCCGCGGCCGAGCCAGTGACCAGG | GGCGGCG | CTGTCG | HPIIGNTSNASPRTPR |
| | | | | ACGTCAAACGGCGGCGGGGAGCAACATCCCATCATCGGAAACACTTCC | CCCTCGCT | CTCCCTA | TPSSPRSFAQVAAA |
| | | | | AATGCTTCTCCCCGCACCCCTCGCACGCCATCCAGCCCTCGCTCCTTTGCT | CCCACCGT | GGTGGT | MPAAATATSSAPMT |
| | | | | CAAGTTGCTGCGGCAATGCCTGCCGCCGCCACTGCCACATCTTCGGCCC | GTCCGCTC | TCCTCGT | EDLSASVPSEPNGSG |
| | | | | CTATGACCGAGGATTTGTCAGCATCGGTGCCCTCTGAGCCAAATGGCAG | GCTTGCTC | TGTGTCT | EQQPSPESTGQTHHS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGGGGAGCAACAACCCTCGCCCGAGTCCACAGGGCAGACACATCATTC | GCTTGCTT | TTTGATG | IPNTPSDFLTMSSDES |
| | | | | GATTCCTAACACACCATCGGATTTTTTGACCATGTCTTCGGATGAAAGCG | GCCCCGCG | GCTTGA | DSPPRSTALRAPTPIA |
| | | | | ACTCCCCTCCTCGCTCCACCGCACTCCGCGCGCCCACCCCTATCGCCCCTC | GAC (SEQ | CTTGTAT | PPAHDGDGDTNGSA |
| | | | | CCGCGCATGATGGTGACGGTGACACAAACGGCAGTGCCACGCCTGAGC | ID NO: | TTTTGTT | TPEPLVQSPTPAQM |
| | | | | CATTGGTGCAATCACCTACACCCGCTCAAATGGTGCTGCCATATCCATCG | 1159) | TTAATTT | VLPYPSGTQQTHSDP |
| | | | | GGTACACAACAAACCCATTCCGATCCCTCTCCGCCCTCTGCTTCACCCCCT | | TGCTTTA | SPPSASPPATTILPAAI |
| | | | | GCCACTACCATTTTGCCCGCTGCCATTTCACATCCTGTCGAACACAGTGA | | ATTTTTG | SHPVEHSEHANSAPL |
| | | | | GCATGCAAACTCAGCCCCACTTGGCGAAGTCAGTGAGAGTGAAACACA | | CTGTATT | GEVSESETHNTAGEH |
| | | | | CAATACAGCGGGCGAACACAGTGAGAGTGAGCAAGATGTTCTTCTCAG | | TGTGTG | SESEQDVLLSDPAPPI |
| | | | | CGATCCCGCTCCGCCCATCGCTGCCAACGTGCTGGATGCCCAGCGCAAG | | GTATTTT | AANVLDAQRKVLLKT |
| | | | | GTCCTGCTGAAGACATCTGGCCACAGGCAACTCCTCGCCTGCCCATTTG | | TGCTGA | SGHRQLLACPFGLCK |
| | | | | GGCTTTGCAAATGCAAGGGGCCCCGCCTTGACCGCAAAGCCTGGGTCA | | ATTTTTG | CKGPRLDRKAWVNH |
| | | | | ATCATGTACTACGCGAGCACCCCTACGACGAGCAAGCCACTGATCTGGT | | TAAGGT | VLREHPYDEQATDLV |
| | | | | CAAGCAGGTGATGGAGGCCAAATTGGTCGCCCAGTGCAACAAGTGTCA | | CCTTTGT | KQVMEAKLVAQCNK |
| | | | | CCTCTTCTTCGAAGCTGCTGGTATCAGTCAACACCGCTCCCGATGTGGTG | | ATGATG | CHLFFEAAGISQHRS |
| | | | | CCAATCTGAAGCGAGCGACCGAGGCGTTGTTTCATGCGGCTGGACACG | | TCTTTGT | RCGANLKRATEALFH |
| | | | | ACCTGCTTGAGATTATGCGTGGCGCTTGGCCCCAACAGTGTGTAGGGTC | | CTTCTGT | AAGHDLLEIMRGAW |
| | | | | TCGCATCAGTGTCTGCGAGCTGCTCAAGCTCGCCCGGCATCCACTGATG | | GGTCGG | PQQCVGSRISVCELLK |
| | | | | CAGCGCAGCCGCTACCCATCCAACGCCACCGAGACCAAGCTGATGGCTG | | TTGTTTT | LARHPLMQRSRYPSN |
| | | | | CCACCCTGAGCCAGCTGTATTGGTCTGCCGTCCACTCGGACTATACCGCT | | CCTCAAT | ATETKLMAATLSQLY |
| | | | | GAAGAGCGAGAGATGTGCTGGGCTTTGATTTTGGCCTTGCCTAGCATGT | | CCGACG | WSAVHSDYTAEERE |
| | | | | TGTTGTCTGCTCCCTCGACCGCACTGTCTACGATTGACCTGCGCAATATG | | TTGTGTC | MCWALILALPSMLLS |
| | | | | TTTCACGATCGTCTCCGTTGGCTTGTGACGGGGCAACTAGGTCGGGTCG | | TCGTTG | APSTALSTIDLRNMF |
| | | | | TGGACGCCATGCGCAAGGCAGTCGCACGCAAGCAGAGCCGTCGAGGAC | | GATGTG | HDRLRWLVTGQLGR |
| | | | | AGCTGAACGCCGGCGCGGGCGCCCACCCGAACGACGCAGTCGACCAGA | | AGCGTG | VVDAMRKAVARKQS |
| | | | | GCCTCAGGTCGCTCGTCCGCGACCCGGACCTGGCGGACGAAGCCTGGG | | CCGTGG | RRGQLNAGAGAHPN |
| | | | | CAAACCACGTCACGAACCGTCTGAACCGAGGTCAGATTGCCAAAGCATT | | TGTTCTT | DAVDQSLRSLVRDPD |
| | | | | TGATGCCGACAAGGCTCGTGCCGTGATTGGTAATTCTGAGGTTCAGGCC | | TGTGTTT | LADEAWANHVTNRL |
| | | | | GTGCGCGACCTCTTGGTACCGCCCGGGCTGACCCCGTACATTGCTTCGA | | GTGCTG | NRGQIAKAFDADKA |
| | | | | CACCCGCCTCCACGTCTACACTGGCACCAGCCACGGCTGTGAGCTCCCC | | TGATGG | RAVIGNSEVQAVRDL |
| | | | | AACCGTGTCCTTCACCAAGGGTGAGCTCCCCAAGGCGTTGGCGGCCACC | | CTTGTA | LVPPGLTPYIASTPAS |
| | | | | AAGGGTGTCACCGACCCCTATGGTTGGTCTGGTGAGCTTCTTGCCTCCAT | | GTTGTG | TSTLAPATAVSSPTVS |
| | | | | CTACCGCATCAAGGAGCACTTCAGTCAAGTCTTGGGCCCACGCCAGGGT | | ATGTGT | FTKGELPKALAATKG |
| | | | | TCTACCAGCGACCCGACTGCTCCTTCTGATGGAGACGCGCCTCAGGGCC | | GACTGC | VTDPYGWSGELLASI |
| | | | | CCACCACCGCCACTGGAGGTCCTCAGGTTGCCTTGAACAAGATCTTTCAC | | CTTTTTG | YRIKEHFSQVLGPRQ |
| | | | | CACATTGCCAACAACACCGTGCCCGAGTCGATTCGACATGCCCTTTGCTC | | GGTGTC | GSTSDPTAPSDGDAP |
| | | | | CATCAACTACACTATCCTGGAGAAGGCCAATGGCAAGTTTCGACCCGTG | | TTGTGTT | QGPTTATGGPQVAL |
| | | | | GGCACGGATTCCATCTTCAACAAGGTTGTCAACCGCGCTCTGCTCGAGC | | TGAAAT | NKIFHHIANNTVPESI |
| | | | | AACAGCAGCCCCATATTGCCCACTTGCTACAGGCCAGTCCAGAGCTGGC | | GGCCGT | RHALCSINYTILEKAN |
| | | | | CGTCGGAGTCAAGGACGGCATTTCAGCAGCGGTTGGCATGGCCTTTGG | | ATCTCTG | GKFRPVGTDSIFNKV |
| | | | | TGAGCTTCAAGCCTGTGAGTCTACCCCGGGCTGGACCATGCTCTCCCTC | | GTTATAC | VNRALLEQQQPHIAH |
| | | | | GATTTCAAGAGTGCCTTCAACTACACCGACCGAGCACGGCTGCACGAGA | | TTGGTC | LLQASPELAVGVKDG |
| | | | | TTGTGGCCGACAAGGTCCCTGGCCTCTTGCGCGCCTTTGAACGACACTA | | GTTTTGT | ISAAVGMAFGELQAC |
| | | | | TGCTCGACCCACTACCCACTGCATTGTCGACAAGTTCTTCAAGGTGATTG | | ACGATTT | ESTPGWTMLSLDFKS |
| | | | | ACATTGATGTTGGCCAAGGCATTGTGCAGGGCAACGAGCTATCGCCCTT | | TTGTTTC | AFNYTDRARLHEIVA |
| | | | | CTTCTTTGCCCTGTACTCCTGTGAGGTCCTGGGTCTCCTCGACGCCACCA | | TATGTG | DKVPGLLRAFERHYA |
| | | | | CTGACTACCGCTGCAAGGTCATCAAGTACCTCGACGACATTGTACTGAT | | CGTGAT | RPTTHCIVDKFFKVIDI |
| | | | | GGGTCCCGCGGAGGACGTGGCGGCCGACGTGGAGATTGTCAAGGCTC | | TCTTCGC | DVGQGIVQGNELSPF |
| | | | | GTGCAGAGTCTGCTGGCCTTCATCTGCAGCCCAGTAAGAGCCGCTTCTA | | GCTTGT | FFALYSCEVLGLLDAT |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CATGCCTCGCCACCATTCGGCTTCCATCACTGCTATCAAGTCTGTATTGC<br>CAGATGCCGTGCGCGAGACGGCCAACACGGGCATGACGGTCTTGGGAA<br>CGCCGATTGGCCGTCGCGAGTGGATGAAGAAGCAGCTGAACGACAAG<br>GCAAAGCACATTGCTGGCAAGCTCAATGACATGCTGACGACCGGTGTCT<br>CGCTTCAGGCCCTCCTCACGGCCATGCAGTACGTGCCTAGCCTCATCAAC<br>CACCTCTACACGCTGCCCCCAAGTCTCACGTCGGGCTTGTCCGAGCTCTT<br>GAACCGTGCTTGCAAGGACACCTTTGTCAAAGCCTTTTTTGCCAAGGTA<br>AACCTGTCTGCACCGGCTGGAGCTGAAGGTCATGACGTTACGCTGGAAC<br>AGCTCCTTGAGGCTCGCCTCTTCACACGGGCCAACACCGGGGGCTTTGG<br>CCTGCACGACTTGGTTGAGCGCGGTCCGGTGGCTTATGTCTGCAACATG<br>GCCAAGCTGGCCACTCGCTACCCTCGGGTCTACGATCGACTTTTGGAGG<br>ATGCATCGAGGGCTGCCGACTTTGAGGCCCACGTGCAGCGAGCTGGCT<br>TCCAGATGGCCACGGTCAAGGACGCGGCGACCCAGCGACCAGCTGAGA<br>TCATTGCCCTCCGCTCCAAGGCGGCACTGGACGACCTGATGGCCAAGTG<br>CGCGCTGGACCTGCAGCAGGCATATCTGGCCTCACGCGAGTGGGGCGT<br>CAGCACTGTCTTGACCATGCGGGGTCGGGACAAGTTGCGTCGCTTGAGC<br>GACACGACCTTTGCCATTGCGGTCGTGTCCATGATGGGTTTTGGCCTCCA<br>TGAACTCATCAACGTCAAGCCGACGGACAAGTGCCCGCTCTGCAGCAGC<br>AAGACACCTCAGCCGCGACTGACCCGCGAGCACCTGCTGACCTGCCGTC<br>CCATCAAGCGTCACAACGCCCTTCGCGACGAGATGGGCCGCCTGCTCAG<br>GTACGCCACCCTCTCCCATGTCTGGGTGGAAAAGTCTGGCTACAACGCC<br>AACGGTCAGAGCTGCCGCATCGACCTGCACTGCCGCAACCCCTTTCCCG<br>GCGGTGCTCTGGGCCCAGCTCTGCCCGACCTGGGCATTGACGTGACTGT<br>GCGCACAGCCCAACCCCCGACCACCTCGCAAGCCTGCATCAAGGTGGGC<br>GCTGCCCTTCGCCGAGCCGAAAAGGAGAAGCGCGACTACTACACCGGT<br>TTCAACCATGGAAAAACTCTGATCGTCCCTGCGGCGATGACGACAACCG<br>GTGGGTTCGCCTCCTCCTTTGTGGATCTGCTTGGTCAGCTCGCCCGCTGC<br>GCCGAGGCCCGTGGTGTGTACCAGCCGGGGCTGGATGAGGCCTTTGTT<br>CCTCGGTGGAAGGGTCGCTTTGCGGCGCTGGTCCATCAGATGAACGCT<br>GACCACATCCAGCGCCACTTTGGCGGTGTCTGCCTGCGCTCGTCGTAGG<br>TAGGCACCGTCTCGGGGGTCCCTCTGTGGGGATCCCTGTGTGCACCTGT<br>CGCTCCCTAGGTGGTTCCTCGTTGTGTCTTTTGATGGCTTGACTTGTATTT<br>TTGTTTTAATTTTGCTTTAATTTTTGCTGTATTTGTGTGGTATTTTTGCTGA<br>ATTTTTGTAAGGTCCTTTGTATGATGTCTTTGTCTTCTGTGGTCGGTTGTT<br>TTCCTCAATCCGACGTTGTGTCTCGTTGGATGTGAGCGTGCCGTGGTGTT<br>CTTTGTGTTTGTGCTGTGATGGCTTGTAGTTGTGATGTGTGACTGCCTTT<br>TTGGGTGTCTTGTGTTTGAAATGGCCGTATCTCTGGTTATACTTGGTCGT<br>TTTGTACGATTTTTGTTTCTATGTGCGTGATTCTTCGCGCTTGTACTTCTT<br>GGCATGATAGAAGCCAATGAATGTGTCTTGTTCTCTTGTGTTGTTTTGCG<br>TGCCGTCGTGATTTTGATGTCGGGGTTGCACAGCTTTGCTTTCAGCTCTG<br>AGGTTCAAACACCTAATTTA (SEQ ID NO: 1036) | | ACTTCTT<br>GGCATG<br>ATAGAA<br>GCCAAT<br>GAATGT<br>GTCTTGT<br>TCTCTTG<br>TGTTGTT<br>TTGCGT<br>GCCGTC<br>GTGATTT<br>TGATGT<br>CGGGGT<br>TGCACA<br>GCTTTG<br>CTTTCAG<br>CTCTGA<br>GGTTCA<br>AACACC<br>TAATTTA<br>(SEQ ID<br>NO:<br>1282) | TDYRCKVIKYLDDIVL<br>MGPAEDVAADVEIV<br>KARAESAGLHLQPSK<br>SRFYMPRHHSASITAI<br>KSVLPDAVRETANTG<br>MTVLGTPIGRREWM<br>KKQLNDKAKHIAGKL<br>NDMLTTGVSLQALLT<br>AMQYVPSLINHLYTL<br>PPSLTSGLSELLNRAC<br>KDTFVKAFFAKVNLS<br>APAGAEGHDVTLEQ<br>LLEARLFTRANTGGF<br>GLHDLVERGPVAYVC<br>NMAKLATRYPRVYD<br>RLLEDASRAADFEAH<br>VQRAGFQMATVKD<br>AATQRPAEIIALRSKA<br>ALDDLMAKCALDLQ<br>QAYLASREWGVSTVL<br>TMRGRDKLRRLSDTT<br>FAIAVVSMMGFGLH<br>ELINVKPTDKCPLCSS<br>KTPQPRLTREHLLTCR<br>PIKRHNALRDEMGRL<br>LRYATLSHVWVEKSG<br>YNANGQSCRIDLHCR<br>NPFPGGALGPALPDL<br>GIDVTVRTAQPPTTS<br>QACIKVGAALRRAEK<br>EKRDYYTGFNHGKTL<br>IVPAAMTTTGGFASS<br>FVDLLGQLARCAEAR<br>GVYQPGLDEAFVPR<br>WKGRFAALVHQMN<br>ADHIQRHFGGVCLRS<br>S (SEQ ID NO:<br>1404) |
| CRE | CRE-<br>2_HMa | — | *Hydra vulgaris* | AATTTAAAAAAAAAAATCGTTTATTTATGGCATAATACTGTTTGTAATT<br>TTTGAAAATTCGTGCAACAACTGCAGTTAAATTGAAGAGCTGAAATTTA<br>AGATCTGAGCTTTTCAATCAGAGTTTTTTACCCTAAAACATTAAATTTTAT<br>CATAACAAAAATCGTTCTAATATTATTAAACTTAAAGAAATTCGTTCTTAT<br>ATCAAATCTTATTTCAGTGTTTCACAGACGAAGGGTTTTACTAGATTTTT<br>ATTTTTTCAACTTTTGAATTTGTTTATTATAAAACTGTAAACTAGTGTGCA<br>ACCAACCGTAAAAAWTAGTTAGCTGTTCACCCAAAATATTATTCAGTAT | AATTTAAA<br>AAAAAAAA<br>ATCGTTTA<br>TTTATGGC<br>ATAATACT<br>GTTTGTAA<br>TTTTTGAA | TGAGCT<br>CTTATAA<br>ATTTATA<br>TTATAGC<br>ATTTTGT<br>TTTA<br>(SEQ ID | MSSCKVTIPHVCPYC<br>KVELKTICGINRHILKC<br>KKNPLQIPSLQKTNTS<br>LTLEPNTKVIPSITKQ<br>NDIIIASTSSNNLAFN<br>QKKDYTLTPTYSRKTT<br>PVSILSSMKMTPISITS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAAAATATTTAATCTTCTTTATTCGCAGTAAACAATAAAATATCTAGTTA | AATTCGTG | NO: | HIVRRKLPELPSQTTN |
| | | | | AACAAAATATTTCTTAATAATAAAAAACAAAAACTTTTTCTTAACAAGTA | CAACAACT | 1283) | HLFNENFINVPFLPEI |
| | | | | CAATGAGCAGCTGCAAAGTTACTATACCTCATGTGTGCCCTTATTGTAAA | GCAGTTAA | | MNHLPVPNNNVM |
| | | | | GTAGAACTTAAAACAATATGCGGAATAAACCGTCACATTTTAAAATGCA | ATTGAAGA | | WGVYSYQQFKLFVD |
| | | | | AAAAGAATCCTTTACAAATACCCAGTCTACAAAAAACTAATACCTCTTTA | GCTGAAAT | | STYDEIVNYRRNIFNI |
| | | | | ACACTCGAACCAAATACTAAAGTAATACCCTCAATTACAAAACAAAACG | TTAAGATC | | PSGKAGKEFIEELTFW |
| | | | | ATATTATAATAGCATCCACTTCGTCTAACAACTTAGCGTTTAATCAAAAA | TGAGCTTT | | LRKFNSTSSLNSIALK |
| | | | | AAGGACTACACATTAACACCTACATATTCTAGAAAAACGACACCCGTAA | TCAATCAG | | VTMILPNLLLQKPSAK |
| | | | | GCATACTGTCTTCTATGAAAATGACACCCATAAGTATAACATCACATATA | AGTTTTTT | | SKSKEHTLCLTRRIDL |
| | | | | GTTCGCAGAAAACTACCTGAGCTTCCTTCTCAAACAACAAATCATTTATT | ACCCTAAA | | WKKGDTSLLLKEVRN |
| | | | | TAATGAGAATTTTATAAATGTTCCCTTCTTGCCTGAAATAATGAACCATC | ACATTAAA | | IQKKFVNSKXKRSMD |
| | | | | TACCAGTTCCAAATAACAATGTCATGTGGGGAGTATACTCATATCAACA | TTTTATCAT | | DISRIFAKLIMEGKITA |
| | | | | ATTTAAATTGTTTGTGGATTCTACCTATGATGAGATCGTAAATTACCGAA | AACAAAAA | | ALKFLEKEASSGILPLS |
| | | | | GAAATATTTTCAACATTCCATCTGGAAAGGCAGGTAAAGAATTTATAGA | TCGTTCTA | | DNTLKDLKSKHPEPS |
| | | | | GGAGCTAACCTTTTGGTTAAGAAAGTTTAATTCCACTTCTAGTTTAAATT | ATATTATT | | RVEDYSLLFGPIDLIPK |
| | | | | CAATCGCGCTGAAAGTTACAATGATTTTGCCGAATCTTCTTTTGCAAAAA | AAACTTAA | | CFFDCIDEQLVMKAA |
| | | | | CCCTCCGCCAAATCAAAGTCCAAAGAACATACATTATGTTTAACTCGTAG | AGAAATTC | | FATKGSAGPSGMDA |
| | | | | GATTGACCTTTGGAAAAAAGGAGATACTAGTTTACTGTTAAAAGAAGTT | GTTCTTAT | | DIYRRILCSKNFIKEGK |
| | | | | CGAAATATACAAAAAAAATTTGTAAATTCCAAAAAKAAAAGATCTATGG | ATCAAATC | | ELRKEIAKMTQNLLTE |
| | | | | ACGATATATCTAGAATATTTGCCAAATTAATTATGGAAGGCAAAATCACT | TTATTTCA | | TYEPTFLEAFTACRLIP |
| | | | | GCAGCGCTGAAATTTTTAGAAAAAGAGGCATCATCCGGCATACTACCAC | GTGTTTCA | | LDKNPGIRPIGVGEVL |
| | | | | TATCAGACAACACATTAAAAGACCTTAAAAGCAAACACCCTGAACCCTC | CAGACGAA | | RRIIGKVISWSFNSEIK |
| | | | | CCGAGTAGAAGATTATAGCTTACTGTTTGGTCCGATTGATTTAATCCCAA | GGGTTTTA | | EAAGPLQTCAGHGA |
| | | | | AATGTTTCTTCGATTGTATTGATGAGCAACTAGTTATGAAAGCAGCATTT | CTAGATTT | | GAEAAVHAMKEIFD |
| | | | | GCAACTAAAGGATCTGCTGGACCATCAGGAATGGATGCCGATATTTATC | TTATTTTTT | | NVQTDAILLIDAKNA |
| | | | | GCCGCATCTTATGTTCTAAAAACTTCATCAAAGAAGGTAAAGAACTCCG | CAACTTTT | | FNCMNRQVALHNIQ |
| | | | | AAAAGAAATTGCTAAAATGACACAAAACTTACTAACAGAAACATATGAA | GAATTTGT | | IICPLISIYLINTYRNPS |
| | | | | CCAACATTTCTAGAAGCTTTCACTGCTTGTCGATTAATTCCTCTAGATAAA | TTATTATA | | RLFVAGGKEISSQEGT |
| | | | | AATCCAGGTATTAGGCCAATTGGAGTAGGAGAAGTATTAAGGCGTATC | AAACTGTA | | TQGDPLAMPWYSC |
| | | | | ATAGGTAAAGTAATTAGCTGGAGTTTCAACAGTGAGATAAAAGAGGCA | AACTAGTG | | NTTIIIEHLLVNYPQV |
| | | | | GCCGGGCCATTACAAACATGTGCTGGACATGGGGCAGGAGCCGAAGCG | TGCAACCA | | KQVWLADDAAASGS |
| | | | | GCTGTACATGCCATGAAGGAAATATTCGACAATGTGCAAACAGATGCAA | ACCGTAAA | | IANLHSWYQHLIDEG |
| | | | | TACTTTTGATTGACGCAAAGAACGCTTTTAATTGTATGAATCGACAAGTC | AAWTAGT | | CKHGYYVNQSKCWLI |
| | | | | GCCTTACACAACATCCAGATCATTTGTCCATTAATTTCAATTTACTTAATC | TAGCTGTT | | VKSPSLAENAGIVFGK |
| | | | | AATACTTATCGAAATCCATCGAGGCTCTTTGTGGCAGGGGGTAAAGAAA | CACCCAAA | | SVNITTEGQRHLGSVI |
| | | | | TATCATCCCAAGAAGGCACAACTCAAGGTGATCCCCTTGCTATGCCATG | ATATTATT | | GSQNFKNKYCTEKVA |
| | | | | GTACTCTTGTAACACCACGATTATTATAGAACACTTACTTGTAAATTACC | CAGTATGA | | KWLTELKQLCKVAET |
| | | | | CACAAGTTAAGCAGGTGTGGTTAGCAGACGATGCTGCAGCTAGTGGAA | AAATATTT | | QPQAAFIAFTKGFRS |
| | | | | GCATTGCAAACTTACATAGCTGGTATCAACACCTTATTGATGAAGGATG | AATCTTCT | | KFTYFLRTIPKFEQYLA |
| | | | | TAAACATGGCTACTATGTAAACCAATCTAAATGCTGGTTAATTGTAAAAT | TTATTCGC | | PVDEILSHLLLPTLFGK |
| | | | | CCCCCTCGTTAGCAGAGAATGCAGGCATAGTATTTGGTAAATCGGTCAA | AGTAAACA | | DTPFEDHIRKLFTLTP |
| | | | | CATAACTACAGAGGGTCAACGACATTTGGGTTCAGTAATAGGTTCGCAA | ATAAAATA | | RDGGLGIPILVEEAPH |
| | | | | AATTTTAAGAACAAATATTGCACTGAGAAAGTAGCAAAATGGTTAACCG | TCTAGTTA | | QFLSSVKLTKNLVQQI |
| | | | | AGTTAAAACAACTTTGTAAAGTAGCAGAGACGCAACCACAGGCCGCTTT | AACAAAAT | | IDQDKILKTKNSSGNV |
| | | | | TATTGCGTTTACAAAAGGATTTCGTTCAAAATTTACATATTTCCTAAGAA | ATTTCTTA | | LEDLEKILTTDRLKHR |
| | | | | CTATTCCAAAATTTGAACAATATCTAGCGCCCGTAGACGAAATACTTAGT | ATAATAAA | | KEKIIAVDSMQPDSM |
| | | | | CATTTGTTGTTGCCAACTCTTTTTGGAAAAGATACGCCCTTTGAGGATCA | AAACAAAA | | LRNIQQTRSECASTW |
| | | | | CATTAGAAAACTTTTTACATTAACTCCTCGAGATGGAGGATTGGGTATAC | ACTTTTTCT | | LNALPLENQGFVLNK |
| | | | | CTATACTAGTTGAAGAAGCGCCTCACCAGTTTTTATCATCTGTTAAATTA | TAACAAGT | | EEFRDALCLRYNFDLK |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACTAAAAATCTTGTACAGCAAATTATAGATCAAGATAAAATTTTAAAAAC | ACA (SEQ | | NIPRICECGEPFNVTH |
| | | | | AAAAAACTCTTCCGGGAATGTTCTAGAAGATCTTGAAAAAATATTAACT | ID NO: | | ALSCKKGGFISSRHD |
| | | | | ACTGACAGACTTAAGCATCGCAAAGAGAAAATAATTGCAGTTGATTCAA | 1160) | | NIRNLFTTLLKRVCIN |
| | | | | TGCAACCAGATTCAATGTTAAGAAACATACAGCAAACAAGAAGCGAAT | | | VQSEPHLIPLDNENFY |
| | | | | GTGCTAGCACCTGGTTAAACGCCTTACCACTAGAAAACCAAGGTTTTGTT | | | FHTANKSNQARLDIK |
| | | | | TTAAATAAAGAAGAATTTCGAGATGCACTTTGCTTACGTTATAATTTTGA | | | ANGFWRNGQTAFF |
| | | | | CTTGAAAAATATCCCTCGTATTTGTGAATGCGGAGAACCTTTCAATGTAA | | | DVRVTHVNSMSNKN |
| | | | | CTCATGCATTGTCGTGTAAGAAAGGTGGCTTCATTTCAAGTCGTCATGAT | | | LDIAAIFRKHEKEKKR |
| | | | | AACATAAGAAATTTGTTCACCACATTGCTTAAAAGAGTGTGCATAAATGT | | | EYGERVREVEHGSLT |
| | | | | TCAATCCGAACCACACCTCATACCCCTTGATAATGAGAATTTTTATTTCCA | | | PLVFGTNGGMGKEC |
| | | | | TACAGCAAATAAAAGTAACCAAGCTCGTTTAGATATTAAAGCAAATGGT | | | HRFVRRLAEKLAEKQ |
| | | | | TTTTGGCGAAATGGACAGACAGCATTTTTTGACGTAAGAGTTACGCATG | | | NEKYSVVMTWLRTK |
| | | | | TCAATTCCATGAGCAACAAAAATCTAGATATAGCTGCTATATTCAGAAAA | | | LSFEILRSTILCLRGSRT |
| | | | | CACGAAAAGGAAAAAAAAAGAGAGTATGGCGAACGAGTTCGTGAAGT | | | PWTKKNDFEIGVDFK |
| | | | | CGAACATGGCAGCTTGACACCACTAGTGTTTGGTACAAATGGAGGTATG | | | MDALEARI (SEQ ID |
| | | | | GGTAAAGAATGTCATCGGTTTGTTAGAAGGCTAGCGGAGAAACTAGCG | | | NO: 1405) |
| | | | | GAAAAACAAAATGAAAAATACTCAGTTGTTATGACATGGTTAAGAACAA | | | |
| | | | | AGTTATCTTTTGAGATACTTCGCTCAACTATCCTTTGTTTAAGAGGCTCAA | | | |
| | | | | GAACACCCTGGACTAAAAAAAACGATTTTGAAATCGGTGTTGATTTTAA | | | |
| | | | | GATGGATGCTCTAGAAGCAAGAATCTGAGCTCTTATAAATTTATATTATA | | | |
| | | | | GCATTTTGTTTTA (SEQ ID NO: 1037) | | | |
| CRE | MoTeR1 | JQ747487 | *Magnaporthe* | CCCGAACCCGAACCCAAACCCAAACCCAAACCCAAACCCAAACCCAAAC | CCCGAACC | TAATAG | MVCPTCNGVYADYN |
| | | | *oryzae* | CCAAACCCAAACCCGGAGGGTTCCCAAGTCGCCTAAACCCGAAGGGTTT | CGAACCCA | GTAACG | DHIRKKHPDERYTAL |
| | | | | AGGATATTATTTCGTTTATTAGAATTGGATAATTATTTACCCCTGTTGGA | AACCCAAA | TCCCTAT | QLQPLGLTPCPICKTA |
| | | | | CAGGGGGGTTGCAGGGGTTAAATTAAGGTTTTTATTATTTATGCGCCG | CCCAAACC | TTTTGTC | CKNDLGVKTHLSKIH |
| | | | | TTTATTTGTTTACCCCCCCAAATATTATAAAAGCGCGTTCCATCCTCTTAG | CAAACCCA | TTTGGTT | KISGASKISTQPRIRTE |
| | | | | GAAAAGCGAAGCTTTTCCTTGTAAAAGTCGCTAGACTTTTACTATAAAA | AACCCAAA | TTGTTTT | NTDNTNSVPTSSFNP |
| | | | | GTCGCTAGACTTTTATACCAATCTTTTAACAAAAAGCGTAGCTTTTTGTT | CCCAAACC | TATCTTT | VLPEIQTLTPGLNNSR |
| | | | | GCCAATCTATTAAAAAAAGCGGAGCTTTTTTTAACTTTTTCTTTTTTTTTTT | CAAACCCG | GTTTTTG | WADNPRKRRADTPS |
| | | | | TTTTTCTTTTTTTTTTTTTTTTTCTTTTTTTTTTTTTTTTTTTTTTTATATATAT | GAGGGTTC | TTTTTGT | PTRGRNTRPRRFSYT |
| | | | | TATTATTATTATTATTAGCGGTGGGGCTATTTATGCGCTTTAATTTGTGC | CCAAGTCG | TTTCGTT | DIDLTNDEPADNPRA |
| | | | | GGGGCTATTTATGCGCTTTAATTTGTGCGGGGCTATTAATGCGCTTTAAC | CCTAAACC | TTTGTTT | NNPRVNNPRVNNEP |
| | | | | TTTACAAATTTTATTTATGCGCTTTAATTGCTGCGGGCCTGTTAATGCGCT | CGAAGGG | TTGTTTT | PSSPNSLPSISEFHTP |
| | | | | TTAATTTACAAATTTCATTAATGCGCTTTAACTTTTATATTTACTAATGCG | TTTAGGAT | CGTTTTT | GTLPLTNSNISLKDQH |
| | | | | TTATTTATATAATTGCTATTATTATCGTTGCTATTATTATTATTGCTATTAT | ATTATTTC | GTTTTTT | DKITGPILQKPLIQKLI |
| | | | | TATCGTTATTATTATTGCAATTTTATTATATAAACCCTCGTTTGTCCCTCG | GTTTATTA | TTTTTGT | EYSKIPIPEHHLHARQ |
| | | | | ATTTATCCCGTTTCTTTTCCATCCCATCGCGCGTTTTCGTAAGCTTTGGTT | GAATTGGA | TTTTGTT | AKIFADAANRIAKNFI |
| | | | | TTCGTAGGATTTGCTTTCGTAGGCTTTGCTTTCGTAGGCTTTCGTCAGCTT | TAATTATTT | TTTGTTT | QSPTEKTLFNLLILPRI |
| | | | | TTACCTGCTTTTATTTTTTCTTTTTCTTTTTATTCCCCCCCCTTTTTTTTACCT | ACCCCTGT | TTGCCTT | FGIGLINGKVTKIMQ |
| | | | | GGTTTATTAGCGGTTTACCTGCTTTTATTACCTGGTTCCCCTTTACCTGTT | TGGACAG | TGTTTTT | NFPSQIPPIPKIDFPSE |
| | | | | TTATTAGCGGTTTACCTGCTTTTATTACCTGGTTCCCCTTTACCTACTTTAT | GGGGGTT | GTTTTTA | KTDSDPVLNAKKLLE |
| | | | | AAGCGGTTTACCTGCTTTTATTACCTGGTTCCCCTTTACCTGTTTTATTAG | GCAGGGG | TCTTTAT | KGYIGRAAKAIIDPTP |
| | | | | CGGTTTACCTGCTTTTATTACCTGGTTCCCCTTTACCTGTTTTATTAGCGG | TTAAATTA | TTTTGTT | VAPETPESLNILREKH |
| | | | | TTTACCAGCTTTTATTACCTGGTTCCCCTTTACCTACTTTATTAGCGGTTTA | AGGTTTTT | TTTGTTT | PIGQNNPFNTKSQPI |
| | | | | CCCGTTTCTATTAGTGGGCATTTATTTCCCGTTTTTATTAGCAGTTAAATT | TATTATTTA | TTACTTT | SGRQITEKAILLAISSI |
| | | | | TACCCTTTTAAGGTTATTTACCTGCTTTTATTCACAGGGCACCCCTGTTTT | TGCGCCGT | GTTTTAT | GREKAPGLSGWTRSL |
| | | | | TACTAGCAGTTAAATTTACCTTTTTAAGGTTATTTACCTGCTTTTATTCAC | TTATTTGTT | TTGTTTT | LDAAIKIPTQNDVIPA |
| | | | | AGGGCACCCCTGTTTTTACCAGCAGTTAAATTTACCTTTTTAAGGTTATTT | TACCCCCC | ATATTTA | LRLLTDMIRQGTAPG |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACCTGCTTTTATTAACAACCCTTTATTTTTTCCTATTAACGGGTATTTATTT | CAAATATT | CCTTTTG | RELLCASRLIGLSKPD |
| | | | | ACCTGTTTTATTGGAATTCACCCGTTGGACGGCATGGTTTGCCCAACCTG | ATAAAAGC | ATTTTTT | GGVRPIAVGDLLYKIA |
| | | | | TAACGGCGTTTACGCCGATTACAACGACCATATCCGGAAAAAACACCCG | GCGTTCCA | CTATTTT | FKAILNTLWSPNCLLP |
| | | | | GACGAACGTTATACCGCCCTCCAACTCCAACCATTGGGTTTAACCCCCTG | TCCTCTTA | TCCCACC | YQLGVNSIGGVEPAIF |
| | | | | CCCTATATGCAAAACCGCTTGCAAAAACGATTTGGGCGTTAAAACCCAC | GGAAAAG | CTTATTA | TLEEAIMGPNINGIKS |
| | | | | CTATCCAAAATCCACAAAATATCCGGTGCATCGAAAATTTCAACCCAACC | CGAAGCTT | TTATAAC | ITSLDLKNAFNSVSRA |
| | | | | GCGTATACGAACGGAAAATACGGATAATACCAATTCGGTCCCCACGTCG | TTCCTTGT | CCCAAC | AIASSVAKYAPTFYRS |
| | | | | TCGTTTAACCCTGTCCTTCCCGAAATCCAAACGTTAACCCCGGGGTTAAA | AAAAGTCG | CTACTAA | TCWAYNQPSILITEN |
| | | | | TAACAGCCGTTGGGCCGATAACCCCAGAAAACGACGGGCCGATACCCC | CTAGACTT | TATTTTT | GSVLASAQGIRQGDP |
| | | | | CTCCCCAACACGGGGTCGGAATACACGCCCACGTCGATTTTCATATACG | TTACTATA | TCTTTTT | LGPLLFSLAFRPTLETI |
| | | | | GATATCGATTTAACAAACGACGAACCGGCGGATAACCCCAGGGCTAATA | AAAGTCGC | TCTTTTT | QKSLPYTYIAAYLDDV |
| | | | | ACCCCAGGGTTAATAACCCCAGGGTTAATAACGAACCCCCCTCCAGCCC | TAGACTTT | TCTTTTT | YILSKTPVKDKIAKIIEK |
| | | | | AAATTCGTTACCTTCGATTTCCGAATTTCACACCCCTGGGACCCTACCCCT | TATACCAA | ACGGTT | SPFTLNSAKTTETDID |
| | | | | AACCAATTCGAATATATCGTTAAAAGACCAGCACGACAAAATTACCGGC | TCTTTTAA | TTATTTT | TLKTNGLKTLGSFIGP |
| | | | | CCTATATTGCAAAAACCGTTAATCCAAAAATTAATCGAATATTCGAAAAT | CAAAAAGC | CCCGTTT | TELRKEFLQNKIQNFE |
| | | | | CCCAATCCCAGAACACCACCTCCACGCCAGGCAGGCTAAAATTTTTGCTG | GTAGCTTT | GTTTTTT | SSINALKKLPKQYGLLI |
| | | | | ACGCCGCAAATCGAATCGCCAAAAATTTTATACAAAGCCCAACGGAGAA | TTGTTGCC | CTATTTT | LRKSTQLLLRHLLRTL |
| | | | | AACATTATTTAATTTACTTATATTACCCCGCATATTCGGTATCGGGTTAAT | AATCTATT | ATTTGTA | NSQDLWELWEKTDK |
| | | | | AAACGGAAAAGTAACTAAAATAATGCAAACTTCCCATCCCAAATACCC | AAAAAAA | CGACAA | LIADFVINLTVTKRKK |
| | | | | CCTATTCCAAAAATTGATTTTCCATCCGAAAAAACCGATTCCGACCCGGT | GCGGAGCT | AACCCTT | RPITDFVTPLITLPIKD |
| | | | | TTTAAACGCCAAAAAATTATTGGAAAAAGGGTATATTGGCCGTGCGGCA | TTTTTTAAC | AGCAAA | GGFGLLRHNGIAQDI |
| | | | | AAGGCTATTATCGATCCAACCCCCGTTGCCCCAGAAACCCCGGAATCGT | TTTTTCTTT | TAAGCTT | YFAAKDLTTEIRHKIQ |
| | | | | TAAATATTTTACGGGAAAAACACCCTATTGGCCAAAATAACCCGTTTAAT | TTTTTTTTT | AGAATA | RISNDFPQNQSPTAT |
| | | | | ACAAAATCCCAACCAATATCAGGCAGGCAAATTACCGAAAAAGCTATTT | TTTTCTTTT | TAATAA | EILHLLHNGVLADCK |
| | | | | TATTAGCTATTTCGTCTATTGGCCGGGAAAAAGCTCCGGGCCTTAGCGG | TTTTTTTTT | AGCGCG | NGLTNAQLNALTEN |
| | | | | GTGGACGAGATCGTTATTAGATGCAGCCATTAAAATACCTACCCAAAAC | TTTTTCTTT | AATTAA | ASYLGRKWLNILPIQK |
| | | | | GACGTAATTCCGGCTTTACGACTCTTAACGGATATGATTCGCCAGGGTA | TTTTTTTTT | AA (SEQ | SNRLTDWEMAEAVR |
| | | | | CCGCACCGGGTAGGGAATTATTATGCGCTTCGCGTTTAATAGGGCTATC | TTTTTTTTT | ID NO: | LRLLAPVKPLTHPCN |
| | | | | CAAACCCGACGGCGGCGTACGCCCAATAGCCGTTGGGGACCTATTATAT | TATATATA | 1284) | HCGNRTNINHEDVC |
| | | | | AAAATAGCCTTTAAAGCTATTTTAAATACCCTATGGTCCCCAAACTGTTT | TTATTATTA | | KGAVRKYTARHDQIN |
| | | | | ATTACCTTACCAATTAGGTGTAAATAGTATAGGTGGCGTCGAACCCGCT | TTATTATTA | | RSFVNSLKSRPEIDVEI |
| | | | | ATTTTTACCCTCGAAGAGGCTATAATGGGCCCTAATATTAACGGTATAAA | GCGGTGG | | EPDLNNENNVNNAN |
| | | | | ATCGATTACCTCCCTCGATTTAAAAAACGCGTTTAATAGCGTATCCAGGG | GGCTATTT | | TTTENPTPSPNGQN |
| | | | | CTGCAATAGCCTCGTCGGTAGCTAAATACGCACCAACTTTCTACCGTTCT | ATGCGCTT | | DTGCLFTTPIRSGTRN |
| | | | | ACCTGTTGGGCCTATAACCAACCTTCGATTTTAATAACGGAAAACGGTTC | TAATTTGT | | GQNGLRADFAVING |
| | | | | CGTCCTGGCTAGTGCACAAGGTATACGCCAAGGCGATCCGTTAGGCCCG | GCGGGGC | | VSKYYYDVQIVAINKD |
| | | | | TTGTTATTCAGCCTTGCTTTTCGACCTACGTTGGAAACGATCCAAAAATC | TATTTATG | | SGNTNPLNTLADAA |
| | | | | GCTTCCATATACGTATATAGCGGCTTATTTGGACGACGTTTATATTTTATC | CGCTTTAA | | NNKRRKYQFLDPFFH |
| | | | | CAAAACGCCCGTTAAAGATAAAATAGCCAAAATAATCGAAAAAAGCCC | TTTGTGCG | | PIIISAGGLMEKDTAQ |
| | | | | GTTTACCCTAAATTCCGCCAAAACGACAGAAACGGATATCGATACGTTA | GGGCTATT | | AYKQIQKLIGPVAAH |
| | | | | AAAACCAATGGTTTAAAAACGCTCGGCTCGTTTATTGGACCAACGGAAT | AATGCGCT | | WLDTSISLILLRSRTTA |
| | | | | TACGGAAGGAATTTTTGCAAAATAAAATTCAAAATTTCGAATCGTCCATT | TTAACTTT | | AISIAKNRPRA (SEQ |
| | | | | AACGCCCTGAAAAAACTCCCTAAACAATACGGATTGCTAATCTTGCGTA | ACAAATTT | | ID NO: 1406) |
| | | | | AAAGTACACAATTACTTTTACGCCATTTGCTCCGTACTTTAAATTCCCAG | TATTTATG | | |
| | | | | GACCTGTGGGAATTATGGGAAAAAACAGATAAATTAATAGCGGATTTC | CGCTTTAA | | |
| | | | | GTTATAAATTTAACTGTTACAAAACGGAAAAAACGGCCAATTACGGATT | TTGCTGCG | | |
| | | | | TCGTTACGCCGTTAATTACGTTACCTATAAAGGACGGAGGTTTTGGATTA | GGCCTGTT | | |
| | | | | TTACGGCATAACGGAATAGCCCAAGATATTTATTTTGCGGCCAAGGATT | AATGCGCT | | |
| | | | | TAACAACCGAAATTCGGCACAAAATCCAACGTATATCCAACGATTTTCCA | TTAATTTA | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAAAATCAAAGCCCTACCGCCACCGAGATTTTGCATTTGTTGCATAACG | CAAATTTC | | |
| | | | | GGGTTTTAGCAGATTGCAAAAACGGGTTAACAAACGCCCAATTAAACGC | ATTAATGC | | |
| | | | | TTTAACCGAAAACGCTAGTTATTTAGGTCGAAAATGGCTTAACATTTTAC | GCTTTAAC | | |
| | | | | CTATCCAAAAATCAAATCGATTAACGGATTGGGAAATGGCTGAAGCCGT | TTTTATATT | | |
| | | | | TCGATTAAGATTATTAGCCCCGGTTAAACCGTTAACCCACCCCTGCAACC | TACTAATG | | |
| | | | | ATTGCGGAAATCGGACCAATATAAACCACGAGGACGTTTGCAAAGGTG | CGTTATTT | | |
| | | | | CCGTACGCAAATATACGGCCCGTCACGACCAAATAAACAGAAGTTTCGT | ATATAATT | | |
| | | | | CAATTCGTTAAAAAGTCGACCAGAAATCGACGTCGAAATCGAACCCGAT | GCTATTAT | | |
| | | | | TTAAATAACGAAAATAACGTAAATAACGCCAATACAACCACCGAAAATC | TATCGTTG | | |
| | | | | CCACCCCTAGCCCCAACGGCCAAAACGATACCGGATGCCTTTTTACAACC | CTATTATT | | |
| | | | | CCTATTCGCTCCGGGACCCGTAACGGCCAAAACGGCCTTAGGGCGGATT | ATTATTGC | | |
| | | | | TTGCCGTTATTAACGGCGTATCCAAATATTATTACGACGTGCAAATCGTT | TATTATTAT | | |
| | | | | GCAATTAATAAGGATTCCGGTAATACAAATCCGTTAAATACGTTAGCAG | CGTTATTA | | |
| | | | | ACGCAGCAAATAACAAACGACGTAAATACCAATTTTTGGATCCATTTTTC | TTATTGCA | | |
| | | | | CATCCAATTATAATAAGCGCCGGAGGCCTTATGGAAAAGGATACAGCAC | ATTTTATTA | | |
| | | | | AGGCGTACAAACAAATCCAAAAATTAATAGGCCCCGTTGCGGCCCATTG | TATAAACC | | |
| | | | | GTTGGATACGTCGATTTCGTTAATTTTGTTACGGTCCAGAACGACGGCA | CTCGTTTG | | |
| | | | | GCAATTTCTATTGCTAAAAACCGCCCTCGTGCGTAATAGGTAACGTCCCT | TCCCTCGA | | |
| | | | | ATTTTTGTCTTTGGTTTTGTTTTTATCTTTGTTTTTGTTTTTGTTTTCGTTTT | TTTATCCC | | |
| | | | | TGTTTTTGTTTTCGTTTTTGTTTTTTTTTTTGTTTTTGTTTTTGTTTTTGCCTT | GTTTCTTTT | | |
| | | | | TGTTTTTGTTTTTATCTTTATTTTTGTTTTTGTTTTTACTTTGTTTTATTTGTT | CCATCCCA | | |
| | | | | TTATATTTACCTTTTGATTTTTTCTATTTTTCCCACCCTTATTATTATAACCC | TCGCGCGT | | |
| | | | | CAACCTACTAATATTTTTTCTTTTTTTTTTTTCTTTTTACGGTTTTATTTTC | TTTCGTAA | | |
| | | | | CCGTTTGTTTTTTCTATTTTATTTGTACGACAAAACCCTTAGCAAATAAGC | GCTTTGGT | | |
| | | | | TTAGAATATAATAAAGCGCGAATTAAAA (SEQ ID NO: 1038) | TTTCGTAG | | |
| | | | | | GATTTGCT | | |
| | | | | | TTCGTAGG | | |
| | | | | | CTTTGCTTT | | |
| | | | | | CGTAGGCT | | |
| | | | | | TTCGTCAG | | |
| | | | | | CTTTTACCT | | |
| | | | | | GCTTTTAT | | |
| | | | | | TTTTTCTTT | | |
| | | | | | TTCTTTTTA | | |
| | | | | | TTCCCCCC | | |
| | | | | | CCTTTTTTT | | |
| | | | | | TACCTGGT | | |
| | | | | | TTATTAGC | | |
| | | | | | GGTTTACC | | |
| | | | | | TGCTTTTA | | |
| | | | | | TTACCTGG | | |
| | | | | | TTCCCCTTT | | |
| | | | | | ACCTGTTT | | |
| | | | | | TATTAGCG | | |
| | | | | | GTTTACCT | | |
| | | | | | GCTTTTAT | | |
| | | | | | TACCTGGT | | |
| | | | | | TCCCCTTT | | |
| | | | | | ACCTACTT | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | TATAAGCG | | |
| | | | | | GTTTACCT | | |
| | | | | | GCTTTTAT | | |
| | | | | | TACCTGGT | | |
| | | | | | TCCCCTTT | | |
| | | | | | ACCTGTTT | | |
| | | | | | TATTAGCG | | |
| | | | | | GTTTACCT | | |
| | | | | | GCTTTTAT | | |
| | | | | | TACCTGGT | | |
| | | | | | TCCCCTTT | | |
| | | | | | ACCTGTTT | | |
| | | | | | TATTAGCG | | |
| | | | | | GTTTACCA | | |
| | | | | | GCTTTTAT | | |
| | | | | | TACCTGGT | | |
| | | | | | TCCCCTTT | | |
| | | | | | ACCTACTT | | |
| | | | | | TATTAGCG | | |
| | | | | | GTTTACCC | | |
| | | | | | GTTTCTAT | | |
| | | | | | TAGTGGGC | | |
| | | | | | ATTTATTTC | | |
| | | | | | CCGTTTTT | | |
| | | | | | ATTAGCAG | | |
| | | | | | TTAAATTT | | |
| | | | | | ACCCTTTT | | |
| | | | | | AAGGTTAT | | |
| | | | | | TTACCTGC | | |
| | | | | | TTTTATTCA | | |
| | | | | | CAGGGCAC | | |
| | | | | | CCCTGTTT | | |
| | | | | | TTACTAGC | | |
| | | | | | AGTTAAAT | | |
| | | | | | TTACCTTTT | | |
| | | | | | TAAGGTTA | | |
| | | | | | TTTACCTG | | |
| | | | | | CTTTTATTC | | |
| | | | | | ACAGGGC | | |
| | | | | | ACCCCTGT | | |
| | | | | | TTTTACCA | | |
| | | | | | GCAGTTAA | | |
| | | | | | ATTTACCT | | |
| | | | | | TTTTAAGG | | |
| | | | | | TTATTTAC | | |
| | | | | | CTGCTTTT | | |
| | | | | | ATTAACAA | | |
| | | | | | CCCTTTATT | | |
| | | | | | TTTTCCTAT | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | TAACGGGT<br>ATTTATTTA<br>CCTGTTTT<br>ATTGGAAT<br>TCACCCGT<br>TGGACGGC<br>(SEQ ID<br>NO: 1161) | | |
| HERO | HERO-<br>2_BF | — | *Branchiostoma floridae* | TTTTCAGTCTGGCTCAGCCAGTGACCGCCGGGAAAGTCCGGCTGACTAC<br>CACGAATAGGGTGGTGACAGCTGGATAGACAGACGACAGCTCGGAAA<br>GACGGCATTGGGGCAGTATGGGTTGGCACCCCTAACTGCATCTCCCCTA<br>GGAGAGCATCCCGCAACACGCTACAAAGAACCACAAAGAGCAATACCC<br>CCAGGGATGCCCGAGAGGGGGGGAGGATGAGCATCCCATTCGGACGG<br>TCCAATCGGTATTGACCCCAGCAAACGGAGAATCGACAATGAATGCAGT<br>CTGTGTGTGTGGCAAGGTATGTAAGAACCAGAGAGGTTTGAGAATCCA<br>CCAAACAAAGATGGCCTGCTTAAGGAGGGTGCAGGCGGAGCACCGCTC<br>AGGGGCTGTGGCAACCACTGTAGAACCAGTGTTGTCAGCATCAGCCCCT<br>GGTCAGACGGAGGAGGATCAGGGCCCGGAAGCTCCCCACAGTGCCCG<br>GAACCTCCGCGCAACGCCTGCCCCTCCACAAGGCAGGAAGTCAGATCAT<br>CACCGAGTGAAGTGGCCAGCCGCAAACTCCAAGGAGTGGTCGCAGTTT<br>GACGAGGACGTTGACATGATCTTGGAGTCGGTGTCAAGAGGTAGTACA<br>GACCAAAAGCTTCAGTCCATGTGCACAGTGATTATGTCCATGGGGGCAG<br>AACGATTTGGCACGATTGGGCAGAGGAAACCGACAGACACAATGAAGC<br>CAAATCGCCGGGAAGTAAAGATCCGTCAACTGAGGCAGGAGCTAAAGT<br>CGTTGAGGCGGAGCTTTAAGGCGAGTACGTCGGGAGAGGAGAGAGCT<br>GCTCTTGCAGAGCTCACACACCACCTTAGGGAGAAGCTTAGGACCCTCA<br>GAAGGGCAGAGTGGCACAAGAAGAAGGGTAAAGAAAGAGCCCGGAA<br>GCGCAGTGCTTTCATCACCAACCCTTTCGGCTTCACCAAGCGACTCCTAG<br>GGCAGAAGAGGAGTGGGAACCTGACCTGCCCAGTCGAGGAGATCAACC<br>TCCACCTCAGCAATACCTTCAGTGATGCCTCGAGAGATGTGGATCTTGG<br>TCCTTGCCCTTTGCTGGTGACTTCACCTGAGCCGGAAGTGCACTTTGACA<br>TCTCTGAACCAACTCTGAAGGAGGTCAGAGAGACAGTCAAGGCGGCGA<br>GGTCCAGTTCGGCGCCAGGTCCCAGTGGCGTGGTATACAAGGTCTACA<br>AACATTGCCCACGGCTTGTGGTGCGCCTCTGGAGGATCCTAAAGGTGGT<br>CTGGCGCAGAGGTAAAGTGGCGGCTGATTGGAGGCAAGCCGAGGGGG<br>TTTGGATCCCAAAGGAAGAGGAGTCAAGTAAGGTAGACCAGTTCCGCT<br>TAATTTCTCTGCTCAGTGTTGAGGGAAAGATCTTCTTCAAGATTGTGGCC<br>CAGCGTCTAATAAAGTACCTTCTGGACAACCAGTATATTGACACATCTGT<br>GCAGAAGGGGGGAGTTCCTGGTGTCCCAGGATGTCTTGAACACACGGG<br>CGTAGTGACCCAGCTCATCCGGGAGGCTAAGGAGAACAGAGGGGACTT<br>GGCAGTCTTGTGGCTGGATCTCGCGAATGCGTATGGTTCGATCCCCCAC<br>AAGCTTGTGGAAACAGCACTGACCAGACACCATGTTCCAGAGTCAATTC<br>AGAACCTCATCTTAGATTACTACAGCAACTTCTGGCTAAGAGCTGGCTCC<br>AGTACAGCAACTTCAGCATGGCAACGGTTAGAGAAGGGCATCATTACTG<br>GATGTACGATTTCAGTGCCCCTCTTTGCACTAGCGATGAACATGATTGTT<br>AAAGGAGCGGAAGCAGGATGTAGGGGTCCCGTGTCTAGGTCTGGAACC<br>AGGCAGCCGCCGATTCGAGCCTTCATGGACGATCTGACGGTGATGACT<br>GCAACAGTCCCGGTGTGTAGATGGCTCCTACAGGGATTAGAGCGTCTCA | TTTTCAGT<br>CTGGCTCA<br>GCCAGTGA<br>CCGCCGGG<br>AAAGTCCG<br>GCTGACTA<br>CCACGAAT<br>AGGGTGG<br>TGACAGCT<br>GGATAGAC<br>AGACGACA<br>GCTCGGAA<br>AGACGGC<br>ATTGGGGC<br>AGTATGGG<br>TTGGCACC<br>CCTAACTG<br>CATCTCCC<br>CTAGGAGA<br>GCATCCCG<br>CAACACGC<br>TACAAAGA<br>ACCACAAA<br>GAGCAATA<br>CCCCCAGG<br>GATGCCCG<br>AGAGGGG<br>GGGAGGA<br>TGAGCATC<br>CCATTCGG<br>ACGGTCCA<br>ATCGGTAT<br>TGACCCCA<br>GCAAACG<br>GAGAATCG<br>ACA (SEQ<br>ID NO:<br>1162) | TGATTA<br>AAGACC<br>CGAAAC<br>ACCCAA<br>TGACCC<br>CGGGTT<br>CATCACT<br>GATGAT<br>GTGTCC<br>CTGTTC<br>GCACTA<br>CCAGAG<br>TGTATTC<br>TAGAG<br>(SEQ ID<br>NO:<br>1285) | MNAVCVCGKVCKN<br>QRGLRIHQTKMACLR<br>RVQAEHRSGAVATT<br>VEPVLSASAPGQTEE<br>DQGPEAPHSARNLR<br>ATPAPPQGRKSDHH<br>RVKWPAANSKEWS<br>QFDEDVDMILESVSR<br>GSTDQKLQSMCTVI<br>MSMGAERFGTIGQR<br>KPTDTMKPNRREVKI<br>RQLRQELKSLRRSFKA<br>STSGEERAALAELTH<br>HLREKLRTLRRAEWH<br>KKKGKERARKRSAFIT<br>NPFGFTKRLLGQKRS<br>GNLTCPVEEINLHLSN<br>TFSDASRDVDLGPCP<br>LLVTSPEPEVHFDISE<br>PTLKEVRETVKAARSS<br>SAPGPSGVVYKVYKH<br>CPRLVVRLWRILKVV<br>WRRGKVAADWRQA<br>EGVWIPKEEESSKVD<br>QFRLISLLSVEGKIFFKI<br>VAQRLIKYLLDNQYID<br>TSVQKGGVPGVPGC<br>LEHTGVVTQLIREAKE<br>NRGDLAVLWLDLAN<br>AYGSIPHKLVETALTR<br>HHVPESIQNLILDYYS<br>NFWLRAGSSTATSA<br>WQRLEKGIITGCTISV<br>PLFALAMNMIVKGA<br>EAGCRGPVSRSGTRQ<br>PPIRAFMDDLTVMT<br>ATVPVCRWLLQGLER<br>LITWARMSFKPAKSR<br>SLVLKKGKVAERFRFT<br>LGGTQIPTVSEKPVKS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTACATGGGCACGGATGAGTTTCAAGCCGGCCAAGTCAAGATCTCTTGT | | | LGKVFNSSLKDTASV |
| | | | | CCTGAAGAAGGGGAAGGTGGCTGAAAGGTTCCGTTTCACCCTGGGAGG | | | QQTRSDLTTWLEGID |
| | | | | CACTCAGATTCCCACAGTGTCAGAGAAACCAGTCAAGAGTCTGGGCAAG | | | KTGLPGSFKAWMFQ |
| | | | | GTGTTCAACAGCTCTCTGAAGGACACCGCTTCAGTTCAGCAGACTAGGA | | | HGVLPRVLWPLLVYE |
| | | | | GTGACCTGACAACGTGGCTCGAGGGAATTGACAAGACAGGGCTACCTG | | | VPMTMVEQLERTISR |
| | | | | GTAGCTTCAAGGCCTGGATGTTCCAGCATGGAGTCTTGCCAAGGGTACT | | | FLRKWLGLPRSLSNIA |
| | | | | CTGGCCTCTTCTTGTGTACGAGGTGCCGATGACCATGGTGGAGCAACTG | | | LYGRSTKLQLPLSGLT |
| | | | | GAGAGAACCATCAGCAGGTTCCTTCGCAAATGGTTGGGGCTCCCGAGG | | | EEFKVTRAREVLMYR |
| | | | | TCCTTAAGCAACATTGCCCTGTACGGTAGATCCACCAAGCTGCAGCTTCC | | | DSSDSKVSSAGIHVR |
| | | | | CTTGAGTGGCCTGACTGAAGAGTTCAAGGTTACCCGTGCAAGAGAAGT | | | TGRKWKAQEAVDQ |
| | | | | GTTGATGTACCGGGACTCCTCAGACTCCAAGGTCTCTTCAGCCGGCATC | | | AEARLRHSVLVGSVA |
| | | | | CATGTCAGGACTGGAAGAAAATGGAAGGCACAGGAAGCAGTGGATCA | | | VGRAGLGSCPKPRYD |
| | | | | GGCAGAGGCAAGGTTGAGACACAGTGTCCTCGTGGGGTCCGTGGCAGT | | | KVSGKEKRLLIQDEIR |
| | | | | AGGACGGGCAGGACTGGGCAGCTGCCCAAAGCCTCGGTACGACAAAGT | | | AGEEEDRRCRMVG |
| | | | | CAGCGGGAAGGAGAAGCGTCTACTGATCCAGGATGAGATAAGGGCTG | | | MRKQGAWTRWEH |
| | | | | GGGAAGAGGAGGATCGGCGATGCAGGATGGTAGGCATGCGCAAGCAA | | | ADSRKVTWPELCRAE |
| | | | | GGTGCGTGGACTAGGTGGGAACATGCTGACTCCCGCAAGGTCACATGG | | | PSRIKFLISSVYDVLPS |
| | | | | CCAGAGTTGTGCAGAGCTGAGCCTTCTCGGATCAAATTTCTCATCTCTTC | | | PANLHVWGLAETPS |
| | | | | AGTGTACGACGTGCTTCCAAGTCCAGCTAACTTGCATGTCTGGGGCTTG | | | CQLCQRRGTLEHILSC |
| | | | | GCAGAGACCCCCTCATGCCAACTCTGTCAGAGGAGAGGTACCCTTGAAC | | | CPKALGEGRYRWRH |
| | | | | ACATTCTCAGTTGTTGTCCGAAAGCACTAGGGGAAGGGAGGTACCGCT | | | DQVLRVLADTVSNAI |
| | | | | GGCGGCATGACCAGGTTCTTAGGGTGTTGGCAGACACAGTTAGCAACG | | | QSSRSQQPPKKSIVF |
| | | | | CCATCCAGAGTAGCAGGAGTCAGCAACCCCCCAAGAAGTCAATTGTCTT | | | VRAGEKTRQQPTSA |
| | | | | TGTCAGGGCCGGAGAGAAAACCCGACAACAACCCACTTCCGCAGGTGG | | | GGLLSTARDWQLLV |
| | | | | GCTTCTCTCCACTGCTAGAGATTGGCAGCTTCTAGTCGACCTTGGGAGA | | | DLGRQLKFPEHIVATS |
| | | | | CAGCTCAAGTTTCCAGAACACATTGTAGCCACGTCACTTCGCCCTGACAT | | | LRPDMVLVSESTRQV |
| | | | | GGTACTCGTGTCAGAATCCACCAGACAAGTGGTTCTGCTGGAGCTAACT | | | VLLELTVPWEERISEA |
| | | | | GTTCCCTGGGAGGAGCGGATAAGCGAAGCCAACGAGCGGAAGAGGGC | | | NERKRAKYAELVVQS |
| | | | | GAAGTATGCCGAACTGGTAGTACAAAGCCAGAGTAATGGGTGGAGAGC | | | QSNGWRARCVPVEV |
| | | | | CCGGTGTGTACCAGTGGAGGTTGGTTGCCGGGGTTTCGCAGGGCAGTC | | | GCRGFAGQSLAYVLK |
| | | | | TTTGGCTTATGTGTTAAAACTCCTTGGAGTAAGAGGTTTCCGTCTTCGGA | | | LLGVRGFRLRKSIRDIL |
| | | | | AATCCATCAGGGATATTCTAGAGGCTGCGGAGAAAGCCTCACGTTGGTT | | | EAAEKASRWLWFRR |
| | | | | GTGGTTCCGTAGGGGGGAACCGTGGAAGCCACACGGACACAGGTCGG | | | GEPWKPHGHRSGN |
| | | | | GGAATGATCAACCTCGGCTGGGTCGCCCGGGCGAGGGTGTATGGTGAT | | | DQPRLGRPGEGVW |
| | | | | TAAAGACCCGAAACACCCAATGACCCCGGGTTCATCACTGATGATGTGT | | | (SEQ ID NO: 1407) |
| | | | | CCCTGTTCGCACTACCAGAGTGTATTCTAGAG (SEQ ID NO: 1039) | | | |
| HERO | HERO-2_DR | — | *Danio rerio* | TTCAAGCCTGGCGCAGCCAGTGACTCCTAGGAATAGACTAGGTGGCAA | TTCAAGCC | TGATCA | MTHANEQTTNKIYVT |
| | | | | CCAAGAATAGTTTGGTCGACTACTGGAGAGACAGTTGACGGCACGGAA | TGGCGCAG | ACCCCG | CICGKLCKNHWGLKI |
| | | | | AGACGGCACTTGGGACAGTATGGGTTAGCACCCCAGCCTGTGTCTTTCG | CCAGTGAC | GCTGGG | HQARMKCLEQESKV |
| | | | | TGAGAGAGAACCCAAACAAGCTACGGAAAGCCCCACAGAGATATACCC | TCCTAGGA | TCACCTG | QRTGPEPGETQEEPG |
| | | | | CCAGGAGATCCCGAGAGGGGGGGAGGATGAGATCTCCAATCGGACGG | ATAGACTA | GGTGAG | PEATHRAKSLHVPEP |
| | | | | ATCAAAGGTTAATGACCCATGCAAACGAACAGACGACGAACAAAATAT | GGTGGCA | AGTGTA | QTPSEVVQQRIKWP |
| | | | | ATGTGACATGCATTTGCGGAAAGCTGTGTAAGAACCATTGGGGCCTAAA | ACCAAGAA | TGATGTT | PASKGSEWLQFDED |
| | | | | AATCCATCAGGCCAGAATGAAATGTTTGGAGCAGGAGAGTAAGGTGCA | TAGTTTGG | GAGAGA | VSNIIQAIAKGDADSR |
| | | | | ACGCACAGGTCCTGAACCTGGTGAGACGCAGGAGGAGCCCGGCCCGG | TCGACTAC | CCCGAA | LKTMTTIIFSYALERFG |
| | | | | AGGCAACCCACAGAGCCAAGTCCCTCCATGTACCAGAGCCTCAAACTCC | TGGAGAG | ACACTC | CIEKGKTKPTTPYTM |
| | | | | AAGCGAAGTAGTTCAACAGCGGATTAAATGGCCCCCAGCCAGCAAAGG | ACAGTTGA | AATGAT | NRRATQIHHLRQELR |
| | | | | AAGTGAGTGGCTGCAGTTCGATGAAGATGTGTCCAACATCATTCAAGCC | CGGCACG | CCCAGG | SLKKLYKKATDEEKQP |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATAGCCAAAGGAGATGCAGATAGCCGACTCAAAACGATGACTACCATC | GAAAGAC | ATACATC | LAELKNILRKKLMILR |
| | | | | ATCTTCAGCTATGCTCTAGAAAGATTCGGTTGCATAGAGAAAGGAAAGA | GGCACTTG | ACTGAT | RAEWHRRRGRERAR |
| | | | | CCAAGCCCACCACCCCCTACACTATGAACCGTAGGGCTACCCAGATACA | GGACAGTA | GATGTG | KRAAFITNPFGFTKQL |
| | | | | TCACCTGCGTCAGGAGCTTCGCTCCCTCAAGAAACTGTATAAGAAAGCT | TGGGTTAG | TCCCAA | LGDKRSGRLECSIEEV |
| | | | | ACGGATGAGGAGAAGCAACCATTAGCGGAGTTGAAAAACATTTTGCGG | CACCCCAG | ATGCAT | NRFIEETVSDPLREQE |
| | | | | AAGAAGCTGATGATCCTACGCAGGGCAGAGTGGCATCGGAGACGAGG | CCTGTGTC | CCATGA | LEPNKALISPTPPARE |
| | | | | GCGAGAGAGAGCCAGGAAGCGAGCTGCCTTCATCACCAATCCCTTTGG | TTTCGTGA | GATGTTT | FSLRGPSLKEVKEIIKA |
| | | | | CTTCACAAAACAGCTGCTCGGGGACAAGCGGAGCGGTCGACTTGAATG | GAGAGAA | CTTGCAT | SRSASTPGPSGIPYLV |
| | | | | CTCAATAGAGGAAGTGAATCGCTTCATTGAGGAAACAGTGAGTGATCCA | CCCAAACA | AA (SEQ | YKRCPGLLLHLWKILK |
| | | | | CTGAGAGAGCAGGAGCTGGAGCCCAACAAAGCTCTTATCAGCCCCACCC | AGCTACGG | ID NO: | VIWQRGRVAEQWR |
| | | | | CTCCAGCAAGAGAGTTCAGTTTGAGGGGGCCAAGTCTGAAGGAGGTCA | AAAGCCCC | 1286) | CAEGVWIPKEENSKN |
| | | | | AGGAAATCATTAAGGCATCTCGCTCAGCATCTACTCCAGGCCCTAGTGG | ACAGAGAT | | INQFRIISLLSVEGKVF |
| | | | | CATACCTTACCTTGTCTATAAGCGCTGCCCAGGGCTTCTCCTGCATCTGT | ATACCCCC | | FSIVSRRLTEFLLENNY |
| | | | | GGAAGATCTTGAAGGTGATTTGGCAACGAGGAAGAGTTGCTGAGCAGT | AGGAGATC | | IDPSVQKGGIPGAPG |
| | | | | GGAGGTGTGCCGAGGGAGTGTGGATTCCTAAAGAGGAAAACTCGAAA | CCGAGAG | | CLEHTGVVTQLIREA |
| | | | | AACATCAACCAGTTTCGAATCATCTCTCTATTGAGTGTTGAAGGGAAGG | GGGGGGA | | HENRGDLVVLWLDL |
| | | | | TGTTTTTCAGCATCGTCTCACGAAGACTGACAGAGTTCCTCCTCGAGAAC | GGATGAG | | ANAYGSIPHKLVELAL |
| | | | | AATTATATTGACCCTTCAGTGCAGAAGGGAGGGATTCCTGGAGCTCCCG | ATCTCCAA | | HRHHVPSKIKDLILDY |
| | | | | GCTGCTTGGAACACACTGGAGTAGTTACACAACTCATCAGAGAGGCCCA | TCGGACGG | | YNNFKMRVTSGSETS |
| | | | | TGAGAACAGAGGGGACTTGGTTGTCTTGTGGTTGGACTTGGCAAATGC | ATCAAAGG | | SWHRIGKGIITGCTIS |
| | | | | CTATGGGTCCATACCCCACAAGCTGGTTGAGCTCGCTCTACACCGCCACC | TTA (SEQ | | VILFALAMNMVVKS |
| | | | | ACGTTCCTAGTAAGATTAAGGACCTAATTCTGGATTACTACAATAATTTC | ID NO: | | AEVECRGPLTKSGVR |
| | | | | AAGATGCGGGTCACATCTGGGTCAGAAACATCAAGCTGGCATCGCATC | 1163) | | QPPIRAYMDDLTITTT |
| | | | | GGGAAAGGAATAATAACAGGCTGCACCATCTCAGTTATTCTTTTCGCTCT | | | TVPGSRWILQGLERLI |
| | | | | CGCCATGAACATGGTGGTCAAGTCAGCCGAAGTGGAATGCAGAGGGCC | | | AWARMSFKPSKSRS |
| | | | | CTTAACTAAGTCAGGTGTGCGACAGCCCCCTATTAGAGCATATATGGAT | | | MVLKKGKVVDKFHF |
| | | | | GACCTTACCATCACAACAACAACGGTCCCAGGGAGCAGGTGGATCTTAC | | | SISGSVIPTITEQPVKS |
| | | | | AAGGACTTGAGAGACTCATCGCCTGGGCTAGAATGAGTTTTAAGCCCTC | | | LGKLFDSSLKDSAAIQ |
| | | | | CAAGTCTAGGTCCATGGTGCTGAAGAAGGGGAAAGTGGTTGACAAGTT | | | KSKKELGAWLAKVDK |
| | | | | CCATTTTTCCATCTCAGGAAGTGTCATCCCAACCATCACGGAGCAACCTG | | | SGLPGRFKAWIYQHS |
| | | | | TCAAGAGTTTGGGGAAGCTCTTTGACTCCAGCCTAAAAGACTCTGCAGC | | | ILPRVLWPLLIYAVPM |
| | | | | CATCCAGAAGTCCAAAAAAGAACTTGGAGCTTGGCTGGCGAAGGTTGA | | | STVESLERKISGFLRK |
| | | | | CAAATCCGGCCTGCCTGGTAGATTCAAAGCCTGGATCTATCAGCATTCA | | | WLGLPRSLTSAALYG |
| | | | | ATTCTGCCCCGAGTTTTGTGGCCTCTGCTGATCTATGCAGTCCCAATGTC | | | TSNTLQLPFSGLTEEF |
| | | | | AACAGTTGAGTCCCTAGAAAGGAAGATCAGTGGCTTTCTTCGAAAATGG | | | MVVRTREALQYRDS |
| | | | | TTGGGCCTCCCACGCAGTCTTACCAGTGCTGCACTATACGGGACAAGTA | | | RDGKVSSACIEVRTG |
| | | | | ACACCTTGCAGCTACCATTCAGTGGCCTCACAGAGGAATTCATGGTTGT | | | RKWNAGKAVEVAES |
| | | | | ACGCACCAGAGAAGCCCTACAGTACAGGGACTCTAGAGATGGCAAGGT | | | RLQQKALVGTVATG |
| | | | | GTCATCAGCCTGCATCGAGGTGAGGACAGGCAGGAAATGGAATGCAG | | | RAGLGYFPKTLVSQV |
| | | | | GGAAAGCAGTGGAGGTGGCAGAGTCACGCCTGCAACAAAAGGCTCTG | | | KGKERHHLLQGEVRA |
| | | | | GTGGGCACTGTAGCGACAGGCAGAGCGGGCTTGGGCTATTTTCCAAAG | | | SVEEERVSRVVGLRQ |
| | | | | ACCTTAGTAAGCCAGGTCAAAGGCAAGGAAAGACACCACCTACTCCAG | | | QGAWTRWNTLQRRI |
| | | | | GGAGAGGTTCGAGCAAGTGTGGAGGAAGAGAGAGTCAGTAGGGTGGT | | | TWANILQADFQRVR |
| | | | | AGGACTCCGGCAGCAGGGAGCATGGACTAGGTGGAATACACTGCAACG | | | FLVQAVYDVLPSPSN |
| | | | | TAGGATCACCTGGGCGAACATCTTGCAGGCGGATTTCCAACGTGTCCGT | | | LHVWGKNETPSCLLC |
| | | | | TTCCTAGTACAAGCTGTCTACGATGTACTGCCAAGCCCATCAAACCTCCA | | | SGRGSLEHLLSSCPKA |
| | | | | CGTTTGGGGAAAGAATGAGACACCTTCCTGCCTTCTTTGCTCTGGAAGA | | | LADGRYRWRHDQVL |
| | | | | GGCTCTCTAGAACATCTCCTCAGCAGTTGCCCCAAGGCTCTGGCTGATG | | | KAIAASLASAINTSKN |
| | | | | GTCGCTATCGTTGGCGCCATGACCAGGTGCTTAAGGCAATTGCTGCGAG | | | HRAPRKAVHFIKAGE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTTAGCTTCAGCCATTAACACGAGCAAGAACCATCGTGCTCCAAGGAAG | | | KPRALPQLTTGLLHK |
| | | | | GCAGTCCACTTCATCAAAGCTGGAGAAAAACCCCGGGCCCTCCCACAAT | | | ASDWQLEVDLGKQL |
| | | | | TAACAACAGGCCTCCTTCACAAAGCCTCGGACTGGCAGCTGGAGGTCGA | | | RFPHHIAATRLRPDII |
| | | | | CCTGGGAAAACAGCTGAGGTTTCCTCATCACATCGCTGCAACACGTCTC | | | AISEASRQLIILELTVP |
| | | | | CGTCCAGACATTATAGCTATCTCAGAAGCTTCAAGACAGCTAATTATTCT | | | WEERIEEANERKRAK |
| | | | | GGAGCTTACAGTGCCGTGGGAAGAGCGTATTGAAGAAGCAAATGAGA | | | YQELVEECRERGWRT |
| | | | | GGAAGCGCGCTAAGTACCAGGAATTAGTGGAGGAGTGCAGGGAGAGA | | | YYEPIEIGCRGFAGRS |
| | | | | GGCTGGAGAACTTACTATGAGCCCATAGAAATTGGATGCAGAGGCTTT | | | LCKVLSRLGITGVAKK |
| | | | | GCAGGGCGTTCACTTTGCAAAGTCCTCAGTCGTTTGGGCATTACAGGCG | | | RAIRSASEAAEKATR |
| | | | | TGGCGAAGAAAAGGGCCATTCGATCCGCAAGCGAAGCCGCAGAGAAG | | | WLWIKRADPWTAV |
| | | | | GCCACAAGGTGGCTGTGGATTAAGAGGGCAGATCCGTGGACTGCTGTT | | | GTQVGT (SEQ ID |
| | | | | GGGACACAAGTCGGGACTTGATCAACCCCGGCTGGGTCACCTGGGTGA | | | NO: 1408) |
| | | | | GAGTGTATGATGTTGAGAGACCCGAAACACTCAATGATCCCAGGATACA | | | |
| | | | | TCACTGATGATGTGTCCCAAATGCATCCATGAGATGTTTCTTGCATAA | | | |
| | | | | (SEQ ID NO: 1040) | | | |
| HERO | HERO- | — | *Branchiostoma* | CTGACCAGCAGACGGGAAGCCCGCGACCAACTAGTCTCCGCAAATATTG | CTGACCAG | TAGAAA | MALPAVRSGPASTW |
| | 3_BF | | *floridae* | CACACAGGGCGACCCTATGGAGCTGATTCAGTCAAATTTCCTCTGAGAT | CAGACGG | CCCACA | TLLITLVIVAAKGTDG |
| | | | | ATACCGATAACTATCTACAGAAACTGCACAGTTAGTTTGGAAAGAGCTT | GAAGCCCG | AGGCTG | FMSFKLPLLSTDTWS |
| | | | | TTCTACTGAAAGACAGCAAAATCCGCCACTTTAGACGAGCGTCAAGACT | CGACCAAC | AGAAAT | GYNNDVKTLLGPLHH |
| | | | | GCCCTCCCCATAACCAATATGGCGCTACCTGCTGTACGTTCTGGACCAGC | TAGTCTCC | GTAGAG | ELATNEMSPKLAGEG |
| | | | | CAGCACCTGGACACTGTTAATCACGCTGGTCATCGTCGCTGCTAAAGGT | GCAAATAT | CATCTGT | FSDIMCDFMASKPEF |
| | | | | ACAGATGGTTTTATGTCTTTTAAACTGCCACTGCTGTCTACTGATACCTG | TGCACACA | ATGGAC | SHTTEESHSEGYISHE |
| | | | | GTCTGGGTATAACAATGATGTGAAAACCCTGCTAGGCCCGCTCCACCAC | GGGCGAC | AATATT | PQSLAQVKRLKNKLR |
| | | | | GAACTGGCCACAAATGAAATGTCCCCCAAACTAGCTGGGGAGGGATTC | CCTATGGA | GATGAT | KKAFRADATPEDRKA |
| | | | | AGTGACATCATGTGCGACTTTATGGCCAGTAAACCAGAGTTCAGCCACA | GCTGATTC | TGAAAT | FRDAIKTYSFMKRQQ |
| | | | | CTACCGAAGAAAGTCACTCAGAAGGCTATATAAGCCACGAACCACAGTC | AGTCAAAT | GTTGTG | KRKETTKSAAHQEKE |
| | | | | TCTCGCACAAGTAAAACGCCTGAAAAACAAGCTACGTAAGAAGGCATTC | TTCCTCTG | ATTTTAG | YHKNFWKFAGKCAK |
| | | | | AGAGCTGACGCAACACCTGAGGATCGAAAGGCTTTCAGAGATGCAATT | AGATATAC | ATCAAA | GQLDIPPVKPAFSVYY |
| | | | | AAAACATACTCCTTCATGAAGCGACAACAGAAACGAAAGGAAACTACA | CGATAACT | TTTAGA | ANEYYKNKYSHPTRV |
| | | | | AAATCGGCAGCACACCAAGAGAAAGAATATCATAAGAACTTTTGGAAG | ATCTACAG | AATATG | DFNKLLWFPHLPVEE |
| | | | | TTTGCCGGAAAATGTGCAAAAGGACAGCTCGATATCCCCCCAGTAAAAC | AAACTGCA | AAAACC | QLPANSFDMSPVRP |
| | | | | CGGCATTCTCTGTTTATTATGCAAATGAGTACTACAAAAACAAATACTCA | CAGTTAGT | GAACTA | KDIKAVLSKRCATSAP |
| | | | | CACCCAACCCGTGTTGACTTCAACAAACTGCTCTGGTTTCCTCATTTGCC | TTGGAAAG | AACTAA | GPDGIMYGHLKHLP |
| | | | | GGTGGAGGAACAACTACCTGCGAACTCTTTTGACATGTCACCTGTCAGG | AGCTTTTC | ATATAAT | ACHLFLSTLFSKLLESG |
| | | | | CCGAAAGACATTAAGGCAGTCTTATCCAAACGATGCGCTACATCTGCAC | TACTGAAA | GTTTTTT | DPPTSWSSGNVSLIH |
| | | | | CTGGCCCGGACGGGATCATGTATGGCCACCTCAAGCACCTGCCAGCTTG | GACAGCAA | TTAAAG | KDGSPEAAENFRMIC |
| | | | | TCACCTGTTCCTTAGTACACTGTTCTCCAAACTGCTTGAGTCCGGAGACC | AATCCGCC | TAATGA | LTSCVSKIFHQILSER |
| | | | | CACCGACATCATGGTCATCTGGCAACGTGTCACTTATACACAAGGATGG | ACTTTAGA | TAAGCA | WAKYMTCNDLIDPE |
| | | | | TAGTCCAGAAGCTGCCGAAAACTTTCGAATGATCTGCCTTACTTCCTGCG | CGAGCGTC | ATACCC | TQKAFLTGINGCVEH |
| | | | | TCTCCAAGATTTTCCACCAAATACTCTCGGAACGATGGGCAAAGTACAT | AAGACTGC | ACATTGT | VQVMREILAHAKKN |
| | | | | GACTTGCAATGATCTGATAGACCCAGAAACACAAAAGGCATTCCTGACC | CCTCCCCA | GCAATA | RRTVHITWFDLADAF |
| | | | | GGAATCAACGGCTGTGTGGAGCATGTCCAAGTTATGCGGGAGATCTTA | TAACCAAT | CTATCTA | GSVEHELIYYQMERN |
| | | | | GCACATGCCAAGAAAAACCGCCGAACAGTCCACATTACATGGTTTGACC | (SEQ ID | TGTTATG | GFPPIITTYIKNLYSRL |
| | | | | TCGCGGATGCCTTTGGTTCTGTAGAACACGAACTGATCTACTACCAGAT | NO: 1164) | TCCTTTG | KGKVKGPGWESDPF |
| | | | | GGAGAGAAACGGCTTCCCGCCAATTATCACCACGTACATTAAAAACCTG | | TCCCCCC | PFGRGVFQGDNLSPII |
| | | | | TATTCTCGCCTGAAAGGGAAAGTGAAGGGTCCAGGCTGGGAAAGTGAT | | TGCATG | FLTVFQPILQHLKGVE |
| | | | | CCGTTCCCGTTCGGAAGAGGAGTGTTCCAAGGAGACAACTTGTCACCCA | | TTTGGTC | QQHGYNLNDKHYVT |
| | | | | TCATCTTCCTAACGGTGTTCCAGCCTATTCTACAGCATCTCAAGGGAGTA | | AATAAT | LPFADDFCLITTNKRQ |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAGCAGCAACATGGCTACAACCTCAATGACAAGCATTATGTTACACTGC<br>CTTTCGCAGACGACTTTTGTCTCATAACCACAAACAAACGACAGCATCAG<br>AAACTAATTACTCAAATTTCTTCCAACACAAAGTCAATGAACCTAAAGCT<br>AAAACCACGCAAGTGTAAGTCTATGTCTATAGTGAGCGGAAAGCCATCG<br>GACATCAGCTTCACAATAGATGGGGACCCTGTCAAAACGACCAAAGATG<br>CACCGGAGAAATTCCTAGGTGGCTACATCACCTTCCTGAGTAAAACAAA<br>AGAGACCTATGACATCCTAGCAAAGACAATAGAAACGACTGTTGAAAAC<br>ATAAACAAATCAGCGATAAGGAACGAATACAAACTCAGGGTTTACATG<br>GAGTACGCCTTCCCATCTTGGAGGTACATGCTGATGGTACACGACCTGA<br>CAGACACCCAGCTACAAAAACTCGATTCCATCCACACAAAGGCGATCAA<br>AACATGGCTCAGAATGCAACCTAGTGCAACAAATGCAATTCTGTACAAC<br>ACAAGGGGTCTCAACTTCAAAAGCATCTCAGACTTGTACCTAGAAGCCC<br>ACGCTCTGGCCTACAGTAGGTCAGTCCTCAAAGCAGATGAGAAGGTAA<br>AACACGCTTTACAAGCCAAACTGGACCGCGAATCGCAATGGACTAGGA<br>AAATGCAGAAATGGGGTATTGGAAAGTGTCACACCATCCACCAGCAAG<br>CCATCCATGTAGCAAAGGACTCAGAATGGACATCAGTACGCAAACATGT<br>CAAACAACAAGTCACAGATATGCGTCATGACGTCTGGACTAAACATCAG<br>GAAAACCTTCTACAGCAAGGGCAGATGCTACAACTGCTTGAGGAAGAA<br>AAATGCGACCTGACATGGCGGTCCGCTATGTACAACCTGCCGAGGGGC<br>ATCCTCAGTTTCGCTGTGCGTGCCTCCATCGACGCCCTCCCCACACTCTG<br>TAACCTGACCACCTGGGGAAAACGTAACACTGACAAATGTAAACTGTGT<br>GGCAACCGGGAAACACTCCACCACGTTCTGAACCACTGCGGTGTCGCTC<br>TCCAACAAGGACGGTACACATTCCGACACAACTCGGTATTGAAGCACAT<br>AACGGACACCATCATAGAGTCCATTGACACCTCTCGGATCAACGCCACC<br>ATCTATGCGGACATACAAGGTTACACAACTAACGGAGGTACCATCCCGG<br>TCCATACAATACCCACTACCCAGAAACCAGACCTGATCATATATTTACCA<br>GAACAGAAGACCCTCCACATCCATGAACTGACTGTACCCTTTGAAAAGA<br>ACATCAAAACAAGTCATGACCGAAAGGTCAACAAATACAGCACCCTAGC<br>GGCAGATTTAGAAACTGCTGGCATTTCCGCTACACTAACCTGCTTTGAA<br>GTCGGATCAAGGGGACTCGTCACGCCAGAGAACAAGACCAGGCTTAGA<br>ACACTGTTCAAAATAGTTAAAGCCAAACCACCGAAGACTCTGTTTACTGA<br>TATAAGCCGCATTGCGATGTTATCGTCATATGCTATTTGGAACTCACGCC<br>ACGAACCGTATTGGGAGTCAGAAACGCTATTGTAGAAACCCACAAGGCT<br>GAGAAATGTAGAGCATCTGTATGGACAATATTGATGATTGAAATGTTGT<br>GATTTTAGATCAAATTTAGAAATATGAAAACCGAACTAAACTAAATATA<br>ATGTTTTTTTTAAAGTAATGATAAGCAATACCCACATTGTGCAATACTAT<br>CTATGTTATGTCCTTTGTCCCCCCTGCATGTTTGGTCAATAATGACCATCG<br>TGTCCTGGGCTCCGTGTACCTTTCTTTACTATGAATAAAGAATGATTTTA<br>CTAC (SEQ ID NO: 1041) | | GACCAT<br>CGTGTC<br>CTGGGC<br>TCCGTG<br>TACCTTT<br>CTTTACT<br>ATGAAT<br>AAAGAA<br>TGATTTT<br>ACTAC<br>(SEQ ID<br>NO:<br>1287) | HQKLITQISSNTKSM<br>NLKLKPRKCKSMSIVS<br>GKPSDISFTIDGDPVK<br>TTKDAPEKFLGGYITF<br>LSKTKETYDILAKTIET<br>TVENINKSAIRNEYKL<br>RVYMEYAFPSWRYM<br>LMVHDLTDTQLQKL<br>DSIHTKAIKTWLRMQ<br>PSATNAILYNTRGLNF<br>KSISDLYLEAHALAYS<br>RSVLKADEKVKHALQ<br>AKLDRESQWTRKMQ<br>KWGIGKCHTIHQQAI<br>HVAKDSEWTSVRKH<br>VKQQVTDMRHDVW<br>TKHQENLLQQGQML<br>QLLEEEKCDLTWRSA<br>MYNLPRGILSFAVRA<br>SIDALPTLCNLTTWG<br>KRNTDKCKLCGNRET<br>LHHVLNHCGVALQQ<br>GRYTFRHNSVLKHIT<br>DTIIESIDTSRINATIYA<br>DIQGYTTNGGTIPVH<br>TIPTTQKPDLIIYLPEQ<br>KTLHIHELTVPFEKNIK<br>TSHDRKVNKYSTLAA<br>DLETAGISATLTCFEV<br>GSRGLVTPENKTRLR<br>TLFKIVKAKPPKTLFT<br>DISRIAMLSSYAIWNS<br>RHEPYWESETLL<br>(SEQ ID NO: 1409) |
| HERO | HERODr | — | *Danio rerio* | AAAGCAGTAGAGATGACGACACATCGCGCAGAAGTTACAACTTCTGGT<br>AAGACGCAGGAGGAGCCAGGCCCGGAGGCAACCCACAGTGCCCAGAG<br>CCTCCTAGTGTCGCCAACACCTGCTGCCGGCCGCTCGCCTGCTACTCAAA<br>GCTGCCCTCAAGTGACAGCAGCTCATAACAGTCCACAAAGCCCCCAAAG<br>TCAGCAAGTGGCAGTTACAAGATCTGACTGTGTTCCCTTGGCACAGCCA<br>AGAATCCAGTGGCCCCAATCCTCAAAGAAAGCTGAGTGGCTCCAGTTCG<br>ACAAGGACGTGAATCAGATCCTGGAAGTGACAGGCAAGGGGGGTGTG<br>GACCAGCGACTGTCAACAATGACCACGCTCATAGTGAACATTGCAGCTG<br>AGCGATTCGGAACTGTGACACCCAAACCCACTCCATCGACATATACTCCA | AAAGCAGT<br>AGAG (SEQ<br>ID NO:<br>1165) | TAGCAT<br>GCCACTT<br>GGACAC<br>AGGCCG<br>GGGTCT<br>GATCAG<br>CCTCGG<br>TCGGGT<br>CGCCTG | MTTHRAEVTTSGKT<br>QEEPGPEATHSAQSL<br>LVSPTPAAGRSPATQ<br>SCPQVTAAHNSPQSP<br>QSQQVAVTRSDCVP<br>LAQPRIQWPQSSKKA<br>EWLQFDKDVNQILEV<br>TGKGGVDQRLSTMT<br>TLIVNIAAERFGTVTP |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGCCACAGAGTAAAGGAAATCAAACGTCTCAGGAAAGAACTTAAGCTA | | GAGGAG | KPTPSTYTPSHRVKEI |
| | | | | CTAAAGAGGCAGTACAAGGCAGCAGGGGAAGTAGAAAGAGCGGGCCT | | GGTGTC | KRLRKELKLLKRQYKA |
| | | | | AGAAGATCTGAGAGGAATCCTGAGGAAACAGCTCGTGAACCTATGTAG | | TGTTGC | AGEVERAGLEDLRGI |
| | | | | GGCAGAGTATCACAGGAAGAGGCGGAGAGAGAGAGCAAGGAAAAGG | | AAGACC | LRKQLVNLCRAEYHR |
| | | | | GCAGCATTTTTGGCCAACCCTTTCAAGTTGACCAAGCAGCTCCTTGGCCA | | CGAAAC | KRRRERARKRAAFLA |
| | | | | AAAGAGGACTGGCAAACTCACCTGCTCCAAGGAGGCTATCAACAATCAC | | ACCCTGT | NPFKLTKQLLGQKRT |
| | | | | CTCAAGGCCACTTATTCTGACCCGAATAGAGAACAACCCCTGGGGCCTT | | GAGCCC | GKLTCSKEAINNHLK |
| | | | | GCGGTGCACTGCTGACACCACCTGAGCCCACATCAGAGTTCAACATGAA | | AGGAAA | ATYSDPNREQPLGPC |
| | | | | GGAACCCTGCCGGAGTGAAGTAGAGGAAGTGGTGAGGAGAGCAAGGT | | CAACAC | GALLTPPEPTSEFNM |
| | | | | CAAGCTCAGCACCAGGCCCAAGCGGAGTGCCTTACAAGGTATATAAGA | | TGATGA | KEPCRSEVEEVVRRA |
| | | | | ACTGCCCAAAGCTTCTACACAGGCTCTGGAAGGCCCTGAAAGTCATATG | | TGTGTC | RSSSAPGPSGVPYKV |
| | | | | GAGAAGAGGGAAGATTGCCCAGCCATGGAGGTATGCGGAGGGAGTGT | | CAAGGT | YKNCPKLLHRLWKAL |
| | | | | ACATCCCAAAAGAGGAGAAGTCGGAGAACATCGACCAGTTTCGAGTCA | | TGTGCA | KVIWRRGKIAQPWR |
| | | | | TCTCCTTGCTCAGTGTGGAGAGCAAAATATTCTTCAGCATTGTGGCCAAA | | TCAGGA | YAEGVYIPKEEKSENI |
| | | | | AGACTCTCCAACTTCCTATTGAGCAATAAATACATCGACACGTCTATGCA | | GATGTTT | DQFRVISLLSVESKIFF |
| | | | | GAAGGGAGGCATACCAGGAGTCCCAGGCTGCCTGGAACACACAGGCGT | | CTGTAA | SIVAKRLSNFLLSNKYI |
| | | | | GGTAACTCAGCTCATTAGGGAGGCAAGAGAAGGCAGGGGGGACCTGG | | C (SEQ | DTSMQKGGIPGVPG |
| | | | | CTGTGTTGTGGTTGGATCTCACCAATGCCTATGGCTCAATACCCCACAAG | | ID NO: | CLEHTGVVTQLIREA |
| | | | | CTGGTGGAGGTCGCACTGGAGAAACATCATGTACCCCAGAAGGTGAAA | | 1288) | REGRGDLAVLWLDLT |
| | | | | GACCTCATCATCGACTATTACAGCAAGTTCAGCTTGAGAGTCTCCTCTGG | | | NAYGSIPHKLVEVALE |
| | | | | CCAGTTAACATCAGATTGGCACCAGCTTGAGGTAGGAATAATCACTGGT | | | KHHVPQKVKDLIIDYY |
| | | | | TGCACCATCTCAGTGACCCTCTTTGCACTGGCAATGAACATGATGGTCAA | | | SKFSLRVSSGQLTSD |
| | | | | AGCAGCTGAGACAGAGTGCAGAGGCCCCCTCAGCAAGTCCGGAGTAAG | | | WHQLEVGIITGCTISV |
| | | | | GCAACCTCCCATCAGAGCCTTCATGGACGACCTCACAGTGACAACAACG | | | TLFALAMNMMVKA |
| | | | | TCGGTACCAGGAGCAAGATGGATCCTCCAAGGGTTGGAGAGGCTCGTG | | | AETECRGPLSKSGVR |
| | | | | GCATGGGCACGCATGAGCTTCAAACCTGCAAAATCCAGATCCTTGGTGC | | | QPPIRAFMDDLTVTT |
| | | | | TTAGGAAAGGCAAAGTCAGAGATGAGTTCCGCTTCAGGCTGGGACAAC | | | TSVPGARWILQGLER |
| | | | | ACCAAATCCCATCAGTCACTGAGAGACCAGTAAAGAGTCTCGGGAAGG | | | LVAWARMSFKPAKS |
| | | | | CCTTTAACTGTAGCCTCAATGACAGAGACTCCATCAGGGAAACCAGCAC | | | RSLVLRKGKVRDEFR |
| | | | | TGCCATGGAGGCTTGGTTGAAAGCAGTGGATAAATCAGGGCTCCCTGG | | | FRLGQHQIPSVTERP |
| | | | | AAGATTTAAGGCTTGGGTTTACCAACATGGAATCCTTCCAAGACTCCTCT | | | VKSLGKAFNCSLNDR |
| | | | | GGCCCTTGCTAATCTATGAGGTCCCCATGACTGTGGTTGAAGGTTTTGA | | | DSIRETSTAMEAWLK |
| | | | | ACAAAAGGTGAGCAGCTATCTACGCAGATGGCTGGGATTGCCACGCAG | | | AVDKSGLPGRFKAW |
| | | | | CCTAAGTAACATCGCTCTGTATGGGAACACCAACAAGCTCAAACTTCCTT | | | VYQHGILPRLLWPLLI |
| | | | | TTGGCTCAGTCAGGGAGGAGTTCATTGTGGCACGGACACGAGAACATC | | | YEVPMTVVEGFEQK |
| | | | | TGCAGTACTCTGGATCCAGAGATGCGAAAGTGTCCGGGGCAGGGATTG | | | VSSYLRRWLGLPRSLS |
| | | | | TCATCAGGACAGGGAGAAAGTGGAGGGCAGCAGAGGCAGTCGAACAA | | | NIALYGNTNKLKLPFG |
| | | | | GCGGAAACCCGGCTGAAGCACAAGGCCATCCTGGGGGCAGTAGCACAA | | | SVREEFIVARTREHLQ |
| | | | | GGCAGAGCTGGACTTGGGAGCCTAGCAGCAACCCGATACGACTCGGCC | | | YSGSRDAKVSGAGIVI |
| | | | | AGTGGGAGGGAGAGGCAGAGGCTGGTGCAGGAGGAGGTGCGTGCTTC | | | RTGRKWRAAEAVEQ |
| | | | | AGTTGAGGAGGAGAGAACCAGCAGAGCAGTGGCCATGCGGCAACAAG | | | AETRLKHKAILGAVA |
| | | | | GTGCCTGGATGAAGTGGGAGCAGGCGATGGAGCGGAATGTCACCTGG | | | QGRAGLGSLAATRYD |
| | | | | AAGGACATCTGGACATGGAACCCCCTGAGAATCAGGTTCTTGATCCAAG | | | SASGRERQRLVQEEV |
| | | | | GGGTCTACGACGTTCTTCCCAGCCCATCGAACCTGTACATATGGGGCAG | | | RASVEEERTSRAVAM |
| | | | | AGTAGAGACACCTGCATGCCCGCTGTGTTCCAAGCCAGGGACACTAGA | | | RQQGAWMKWEQA |
| | | | | ACATATTTTGAGCAGCTGTTCCAAGGCACTAGGTGAAGGTCGGTATCGA | | | MERNVTWKDIWTW |
| | | | | TGGAGACACGATCAGGTCCTTAAATCCATTGCTGAGGCAATCAGCAAGG | | | NPLRIRFLIQGVYDVL |
| | | | | GGATCAAGGACAGTCGATACCGCCAAGCCACGGCCAAGGTCATTCAGT | | | PSPSNLYIWGRVETP |
| | | | | TCATCAAGGAAGGACAAAGGCCAGAGAGAACAGCAAAGAACTGCTCTG | | | ACPLCSKPGTLEHILS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTGGGTTGCTCTCCACGGCCCGAGACTGGGTGATGACAGTTGATCTTGA<br>GAGGCAGCTAAAGATTCCACCACACATCACCCAGTCTACGTTGAGACCT<br>GACATAATCTTGGTCTCTGAGGCCACAAAGCAATTAATCCTGCTGGAGC<br>TGACGGTGCCCTGGGAGGAGAGGATGGAGGAGGCTCAGGAGAGAAA<br>GAGGGGAAAATATCAGGAGCTAGTGGAGCAATGTAGGGCGAATGGAT<br>GGAGGACCAGGTGCATGCCAGTGGAAGTGGGCAGTAGGGGATTTGCC<br>AGCTACACCCTGAGCAAGGCCTATGGTACACTGGGAATAACAGGCACA<br>AACCGAAGAAGAGCCCTAAGCAACAACGTGGAAGCAGCGGAAAAAGC<br>ATCCAGATGGCTCTGGTTGAAGAGGGGGGAACAGTGGGGGCAGTAGC<br>ATGCCACTTGGACACAGGCCGGGGTCTGATCAGCCTCGGTCGGGTCGC<br>CTGGAGGAGGGTGTCTGTTGCAAGACCCGAAACACCCTGTGAGCCCAG<br>GAAACAACACTGATGATGTGTCCAAGGTTGTGCATCAGGAGATGTTTCT<br>GTAAC (SEQ ID NO: 1042) | | | SCSKALGEGRYRWR<br>HDQVLKSIAEAISKGI<br>KDSRYRQATAKVIQFI<br>KEGQRPERTAKNCSA<br>GLLSTARDWVMTVD<br>LERQLKIPPHITQSTLR<br>PDIILVSEATKQLILLEL<br>TVPWEERMEEAQER<br>KRGKYQELVEQCRA<br>NGWRTRCMPVEVG<br>SRGFASYTLSKAYGTL<br>GITGTNRRRALSNNV<br>EAAEKASRWLWLKR<br>GEQWGQ (SEQ ID<br>NO: 1410) |
| HERO | HEROFr | — | *Takifugu rubripes* | AGACTAGGTGACAACCAAGAACAGTTWGGTCGACTACTGGAAAGACA<br>GTTGGCAGCTCGGAAAGACGGCACCCGGGACAGTATGGGTTAGCACCC<br>CAGCCTGTATCTTTCGCGAGAAGGAACCCAAACAAGCTACGGAAAGCCC<br>TACAGAGAAACACCCCCAGGAGATCCCGAGAGGGGGGGAGGATGAGA<br>TCTCCAATCGGACGGACCTAACGTTAATGACCCCTGCAATGGAAATGAC<br>TACGACAGTAACATGTATCTGCAGCAAGCTGTGCAAGAACCAGCGTGGC<br>TTAAAGATCCATCAGGCCAGAATGAAATGTCTGGAGCGGGAGGTTGAG<br>GTGCAACGCACAGGTCCTGGACCTGGTGAGACGCAGGAGGAGCCCGG<br>ACAGGAGGCAACCCACAGATCCCAGTCCCTCCACGTACCGGAGCCTCCC<br>AACCCTAACAGAGTAGTTCAACAGCAGCGGATTAAGTGGCCCCCAGCAA<br>ATAGACGGAGTGAGTGGCTGCAGTTTGATGAGGATGTGTCCAACATCA<br>TCCAAGCCACAGCCAAAGGAGATGTCGACAGCAGACTCCAGGCGATAA<br>GTACCATCATCGTCAGCTATGGCTCAGAAAGATTTGGACGGATCGAGAA<br>GGGCAACACTGAGACCACCTCTTACACCATGAACCGCAGGTCCTTTAAG<br>ATACACCAACTGCGCAAGGAGCTGCGAACCCTCAAGAAACAGTTCAAG<br>AGAGCTKCTGATGGGGACAAGCAAGCTTTAAAAGAGCTGTATAACATCC<br>TGCGGAAGAAGTTGAAAACTCTCCGCAGAGCAGAGTGGCACAGGAGGC<br>GCGGGAGAGAGAGAGCAAGGAAGCGAGCAGCCTTCATTGCCAATCCCT<br>TCCGGTTTTCTAAACAGCTGCTCGGGGACAAGCGGAGTGGCCGACTTGA<br>GTGCTCAAGGGAGGAAGTGAATCGCTTCCTCCAAAACACCATGAGCGA<br>CCCACTGAGGGGTCAAGACCTAGGACCCAACAGAGCGCTCATCAGCCCT<br>GCCCCACCATCGGCAGAGTTCAAGCTGGCAGAGCCTAGTTTGAAGGAG<br>GTTGAAGAAGTCATCAAGGCAGCCCGTTCTGCATCTTCCCCGGGCCCCA<br>GTGGTGTACCTTACCTCGTCTACAAGCGCTGTCCAGAAATTCTCCGGCAT<br>CTGTGGAAGGCCTTGAAAGTGATCTGGCGAAGGGGGAGAGTAGCCGA<br>CCAGTGGAGGTGTGCTGAGGGACTTTGGATACCCAAGGAGGAGGACTC<br>GAAAAACATCAACCAGTTTCGGACTATCTCACTACTGAGTGTGGAAGGG<br>AAGGTGTTTTTTAGCATCGTCTCCCGAAGACTGACCGAGTTTCTCCTCAA<br>GAACAACTACATCGACACTTCAGTGCAGAAGGGTGGGATCCCTGGAGT<br>CCCCGGCTGTCTAGAGCACAATGGTGTAGTCACACAGCTCATCAGAGAG<br>GCCCATGAGAGCAAAGGAGAACTAGCGGTTTTGTGGTTGGACCTGACT<br>AACGCCTACGGGTCCATCCCACACAAGCTAGTTGAGCTTGCGCTACACC<br>TACACCATGTTCCCAGTAAGATCAAGGACCTGATTCTGGATTACTATAAT | AGACTAGG<br>TGACAACC<br>AAGAACA<br>GTTWGGT<br>CGACTACT<br>GGAAAGA<br>CAGTTGGC<br>AGCTCGGA<br>AAGACGG<br>CACCCGGG<br>ACAGTATG<br>GGTTAGCA<br>CCCCAGCC<br>TGTATCTT<br>TCGCGAGA<br>AGGAACCC<br>AAACAAGC<br>TACGGAAA<br>GCCCTACA<br>GAGAAAC<br>ACCCCCAG<br>GAGATCCC<br>GAGAGGG<br>GGGGAGG<br>ATGAGATC<br>TCCAATCG<br>GACGGACC<br>TAACGTTA<br>(SEQ ID<br>NO: 1166) | TGATCA<br>CCCCGG<br>CTGGGT<br>CGCCTG<br>GGCGAG<br>GGTGTA<br>TGATGT<br>CGTGAG<br>ACCCGA<br>AACACC<br>CTATGA<br>ACCCAG<br>GATACA<br>TCCTGAC<br>GATGTG<br>TCCCAGT<br>GCATCC<br>AGGAGA<br>TGTAKCT<br>TTAAGT<br>(SEQ ID<br>NO:<br>1289) | MTPAMEMTTTVTCI<br>CSKLCKNQRGLKIHQ<br>ARMKCLEREVEVQR<br>TGPGPGETQEEPGQ<br>EATHRSQSLHVPEPP<br>NPNRVVQQQRIKWP<br>PANRRSEWLQFDED<br>VSNIIQATAKGDVDS<br>RLQAISTIIVSYGSERF<br>GRIEKGNTETTSYTM<br>NRRSFKIHQLRKELRT<br>LKKQFKRAXDGDKQ<br>ALKELYNILRKKLKTLR<br>RAEWHRRRGRERAR<br>KRAAFIANPFRFSKQL<br>LGDKRSGRLECSREE<br>VNRFLQNTMSDPLR<br>GQDLGPNRALISPAP<br>PSAEFKLAEPSLKEVE<br>EVIKAARSASSPGPSG<br>VPYLVYKRCPEILRHL<br>WKALKVIWRRGRVA<br>DQWRCAEGLWIPKE<br>EDSKNINQFRTISLLS<br>VEGKVFFSIVSRRLTE<br>FLLKNNYIDTSVQKG<br>GIPGVPGCLEHNGVV<br>TQLIREAHESKGELAV<br>LWLDLTNAYGSIPHK<br>LVELALHLHHVPSKIK<br>DLILDYYNNFRLRVTS<br>GSVTSDWHRLEKGII<br>TGCTISVVLFVLAMN |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AACTTCAGGCTCAGGGTCACTTCAGGGTCAGTAACCTCAGACTGGCATC | | | MVVKAAEVECRGPL |
| | | | | GCCTTGAGAAAGGAATAATAACAGGCTGTACCATCTCCGTCGTTCTCTTC | | | SRSGVRQPPIRAYMD |
| | | | | GTACTGGCGATGAATATGGTGGTAAAGGCGGCTGAGGTGGAGTGCAG | | | DLTVTTTSVPGCRWI |
| | | | | AGGGCCTCTATCCAGATCAGGTGTTCGACAGCCCCCCATAAGAGCCTAC | | | LQGLERLILWARMSF |
| | | | | ATGGACGACCTTACCGTCACAACAACATCAGTCCCAGGGTGTAGGTGGA | | | KPTKSRSMVLKKGKV |
| | | | | TCTTGCAGGGTTTGGAGAGACTCATCCTATGGGCTAGGATGAGTTTTAA | | | VDKFRFSISGTVIPSIT |
| | | | | GCCCACCAAGTCAAGGTCCATGGTACTGAAGAAGGGGAAAGTGGTGGA | | | EQPVKSLGKLFDSSLK |
| | | | | CAAATTCCGATTCTCAATCTCAGGAACCGTAATTCCATCGATCACGGAGC | | | DTAAIQKSTEELGGW |
| | | | | AACCAGTCAAGAGCCTGGGAAAGCTCTTTGACTCCAGCCTGAAGGACAC | | | LTKVDKSGLPGRFKA |
| | | | | TGCTGCTATCCAGAAGTCTACGGAAGAGCTTGGAGGGTGGCTCACTAA | | | WIYQYSILPRVLWPLL |
| | | | | GGTGGACAAGTCTGGCCTGCCTGGTAGATTTAAAGCCTGGATCTACCAG | | | VYAVPVTTVESFERKI |
| | | | | TACTCCATCCTTCCCAGAGTCCTGTGGCCTCTCCTCGTGTATGCAGTCCC | | | SSFLRRWLGLPRSLNS |
| | | | | AGTAACAACAGTGGAATCCTTTGAAAGGAAGATCAGCAGCTTTCTGCGC | | | AALYGTSNTLQLPFS |
| | | | | AGATGGCTGGGTCTTCCTCGCAGCCTCAACAGCGCTGCACTGTACGGGA | | | GLTEEFKVARTREAL |
| | | | | CAAGTAACACCCTGCAGCTACCCTTCAGTGGGCTCACTGAAGAATTTAA | | | QYRDSRDCKVSSAGI |
| | | | | GGTGGCACGCACAAGAGAAGCCCTACAGTACAGAGACTCCAGGGACTG | | | EVKTGRKWKAEKAV |
| | | | | CAAGGTGTCATCAGCCGGGATTGAGGTGAAGACAGGAAGGAAGTGGA | | | XVAESRLRQKALVGA |
| | | | | AGGCAGAAAAGGCAGTGGAKGTGGCTGAGTCACGCCTAAGGCAAAAG | | | VATGRTGLGYFPKTQ |
| | | | | GCACTAGTTGGGGCCGTGGCAACAGGAAGAACAGGCTTGGGCTACTTC | | | VSHARGKERNHLLQE |
| | | | | CCAAAGACCCAAGTCAGCCATGCCCGGGGCAAAGAGAGAAACCACCTA | | | EVRAGVEEERVGRAV |
| | | | | CTTCAGGAGGAGGTCCGAGCAGGCGTGGAGGAAGAGCGAGTGGGTAG | | | GLRQQGAWTRWES |
| | | | | GGCAGTGGGACTCCGGCAGCAGGGGGCATGGACAAGGTGGGAGAGC | | | ALQRKVTWSNIMQA |
| | | | | GCGTTACAGCGCAAAGTTACCTGGTCAAACATCATGCAGGCAGACTTCC | | | DFHRVRFLVAAVYDA |
| | | | | ACCGCGTCCGGTTCCTTGTGGCGGCAGTCTACGATGCCCTCCCCAGCCC | | | LPSPANLHAWGKSET |
| | | | | AGCAAACCTCCATGCGTGGGGAAAGAGTGAGACACCCACCTGTTCCCTT | | | PTCSLCSGRGSLEHLL |
| | | | | TGCTCCGGAAGAGGCTCCCTGGAACATCTCCTTAGCAGCTGCCCAAAGT | | | SSCPKSLADGRYRWR |
| | | | | CCCTGGCTGATGGTCGCTATCGCTGGCGCCACGACCAGGTACTCAAAGC | | | HDQVLKAVAESIALAI |
| | | | | AGTGGCTGAGAGCATAGCCTTGGCCATTAGCACCASCAAACACCATCAT | | | STXKHHHAPKKAISFI |
| | | | | GCTCCGAAGAAGGCAATCTCCTTCATAAAAGCTGGAGAGAGACCTCGTG | | | KAGERPRAGPQITTG |
| | | | | CAGGCCCACAGATAACAACGGGACTCCTCCACACAGCTMCTGATTGGC | | | LLHTAXDWQLHVDL |
| | | | | AACTGCACGTTGACCTGGGAAAACAACTGATATTCCCCCAGCACATCGC | | | GKQLIFPQHIATTSLR |
| | | | | AACAACGTCTCTACGGCCAGACATGATCATCATCTCAGAGGCTTCGAAA | | | PDMIIISEASKHLIML |
| | | | | CACCTGATCATGCTGGAGCTTACAGTGCCCTGGGAAGAGCGGATTGAG | | | ELTVPWEERIEEANE |
| | | | | GAAGCCAACGAAAGGAAACGTGCCAAGTATCAGGAGCTGGTGGAGGA | | | RKRAKYQELVEECRG |
| | | | | GTGCAGGGGCAGGGGCTGGAGGACCTTCTACGAGCCCATAGAAGTTGG | | | RGWRTFYEPIEVGCR |
| | | | | CTGTAGAGGCTTTGCAGGACGCTCCCTCTGCAAAGCCTTTGGCCGACTG | | | GFAGRSLCKAFGRLG |
| | | | | GGAGTCACAGGGACAGCCAAAAAGAGGGCCATTAAAKCCGCGAGTGA | | | VTGTAKKRAIKXASE |
| | | | | AGCTGCAGAGAGAGCCACGAGGTGGSTGTGGCTKAAAAGGGCAGATCC | | | AAERATRWXWLKRA |
| | | | | GTGGGTTGCTACTGGGACACAAGCCGGGTCTTGATCACCCCGGCTGGG | | | DPWVATGTQAGS |
| | | | | TCGCCTGGGCGAGGGTGTATGATGTCGTGAGACCCGAAACACCCTATG | | | (SEQ ID NO: 1411) |
| | | | | AACCCAGGATACATCCTGACGATGTGTCCCAGTGCATCCAGGAGATGTA | | | |
| | | | | KCTTTAAGT (SEQ ID NO: 1043) | | | |
| HERO | HEROTn | — | *Tetraodon* | AGATTGGTCTGGCTAAGCCAGTGACGTCCAGGAACAGACTGGCTGACG | AGATTGGT | TGATCA | MATTQASVKPTAVA |
| | | | *nigroviridis* | ACCACGAATAGAGTGGTGACAGCTTGGATAGACAGCTGACAGCAGGGA | CTGGCTAA | CTCCCA | TCVCGKICKNPRGLKI |
| | | | | AAGACGGCAACCGGGGCAGGAAGGGCTAGCAACCCAGCCTGCATCTTC | GCCAGTGA | GTCGGG | HQTKMGCLASVQPE |
| | | | | CGTGAGGAAGAACCCAAAACTTGCTACGAAGAGCCCGAAGCAAAGATA | CGTCCAGG | TCGCCT | QRARFSLSESREVPA |
| | | | | CCCCCAGGGGAGCCCGAGAGGGGGGGAGAATGAGCTCCCCAAACGGA | AACAGACT | GGGTGA | RAEPYGPQQPHSPEA |
| | | | | CGGATAACATGGCAACGACCCAGGCTAGCGTTAAACCGACAGCGGTTG | GGCTGACG | GGGGGT | LGETQEERGQESPHS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCACATGTGTATGTGGCAAAATCTGCAAAAACCCACGAGGTCTGAAGAT | ACCACGAA | CTGATG | AQNLRAQVAQAPDN |
| | | | | CCACCAGACCAAGATGGGGTGCTTGGCAAGTGTGCAACCAGAGCAGCG | TAGAGTGG | TTGAAA | PQHHRRVKWPPASK |
| | | | | CGCAAGGTTCAGCCTCAGCGAGTCGCGGGAGGTGCCAGCCAGGGCCGA | TGACAGCT | GACCCG | VSEWQQLDEDLEGIL |
| | | | | GCCCTATGGCCCTCAGCAACCGCATTCTCCTGAGGCCCTTGGTGAGACG | TGGATAGA | AAACCC | ESTAKGGVDRKLQT |
| | | | | CAGGAGGAGCGGGGCCAGGAGTCACCCCACAGTGCCCAGAACCTCCGT | CAGCTGAC | CCGATG | MTTLVISFATERYGT |
| | | | | GCTCAGGTAGCACAAGCGCCAGACAACCCACAACACCACCGGCGGGTT | AGCAGGG | ACCCCA | MEKRAAPEKYTKNR |
| | | | | AAGTGGCCCCCAGCCAGCAAAGTGAGCGAGTGGCAGCAGCTTGATGAG | AAAGACG | GGTACT | RAEKISQLRQELRVLK |
| | | | | GATTTGGAAGGTATTCTGGAGTCCACCGCAAAAGGTGGAGTAGACAGA | GCAACCGG | ATCACT | KQFKGASEDQKPGLA |
| | | | | AAACTCCAAACAATGACCACGCTGGTCATCAGCTTTGCCACCGAGAGAT | GGCAGGA | GACGAT | ELRCTLRKKLLTLRRA |
| | | | | ATGGTACAATGGAGAAACGCGCTGCTCCAGAGAAGTACACCAAAAACC | AGGGCTA | GTGTCC | EWHRRRAKERAKKR |
| | | | | GCAGGGCAGAAAAGATCTCCCAACTGCGGCAGGAACTTCGGGTCCTGA | GCAACCCA | AAGACA | AAFLANPFGFTKQLL |
| | | | | AAAAGCAGTTCAAGGGCGCCAGCGAGGATCAGAAGCCAGGATTGGCA | GCCTGCAT | TGCATC | GQKRSAHLECAKEEV |
| | | | | GAGCTTCGTTGCACCCTTAGGAAAAAACTGCTTACCCTTCGCCGAGCAG | CTTCCGTG | AATAGG | DSYLHDTFSDAEREN |
| | | | | AGTGGCACCGGAGACGGGCCAAGGAAAGAGCCAAGAAACGCGCTGCA | AGGAAGA | TGTATTT | SLGECRVLISPPEPAC |
| | | | | TTTTTAGCCAACCCTTTTGGGTTCACTAAACAACTTTTAGGCCAGAAGCG | ACCCAAAA | AGAAAT | SFNTKAPTWKEIQTV |
| | | | | TAGCGCCCACTTGGAATGTGCAAAAGAGGAGGTTGATTCCTACCTCCAC | CTTGCTAC | C (SEQ ID | VRAARNNSAPGPNG |
| | | | | GACACATTCAGTGACGCAGAACGGGAGAACAGCCTAGGCGAATGTAGA | GAAGAGC | NO: | VPYLVYKRCPKLLARL |
| | | | | GTGCTGATCAGTCCACCTGAGCCAGCCTGCAGTTTCAACACCAAGGCTC | CCGAAGCA | 1290) | WKILRVIWRRGKVA |
| | | | | CAACTTGGAAAGAAATCCAAACTGTGGTCAGGGCTGCAAGAAACAACT | AAGATACC | | HQWRWAEGVWVP |
| | | | | CAGCTCCTGGACCCAATGGAGTCCCATATCTGGTGTACAAAAGATGCCC | CCCAGGG | | KEEKSTLIEQFRTISLL |
| | | | | CAAACTCCTAGCCCGGCTCTGGAAGATCCTAAGGGTGATCTGGAGAAG | GAGCCCGA | | NVEGKIFFSILSHRLSD |
| | | | | GGGGAAGGTCGCCCATCAATGGAGATGGGCGGAAGGGGTGTGGGTTC | GAGGGGG | | FLLKNQYIDSSVQKG |
| | | | | CGAAGGAGGAGAAGTCAACCTTGATAGAGCAGTTTAGGACCATCTCACT | GGAGAAT | | GIPGVPGCLEHCGVV |
| | | | | GCTCAATGTCGAGGGGAAGATATTCTTTAGTATCCTCTCCCATCGTCTAT | GAGCTCCC | | TQLIREAREGRGSLA |
| | | | | CAGACTTCCTCCTTAAGAACCAGTACATCGACTCCTCGGTGCAAAAGGG | CAAACGGA | | VLWLDLANAYGSIPH |
| | | | | GGGGATCCCTGGGGTACCAGGGTGTTTAGAACACTGTGGCGTGGTGAC | CGGATAAC | | KLVEMALARHHVPG |
| | | | | ACAACTAATTAGGGAGGCGCGCGAAGGGAGAGGTAGCCTGGCCGTACT | (SEQ ID | | PIKTLIMDYYDSFHLR |
| | | | | TTGGCTGGACTTAGCTAACGCTTATGGCTCCATACCCCACAAGCTGGTG | NO: 1167) | | VTSGSVTSEWHRLEK |
| | | | | GAAATGGCATTAGCGAGGCACCATGTCCCAGGCCCGATCAAGACTCTG | | | GIITGCTISVIIFALAM |
| | | | | ATCATGGACTACTATGATAGCTTCCACCTGAGAGTCACGTCAGGCAGTG | | | NMLAKSAEPECRGPI |
| | | | | TCACATCTGAATGGCACCGACTAGAGAAAGGGATCATCACTGGATGCAC | | | TKSGIRQPPIRAFMD |
| | | | | CATCTCAGTGATAATATTCGCCCTGGCCATGAATATGCTGGCCAAGTCG | | | DLTVTTTSVPGCRWI |
| | | | | GCTGAGCCAGAGTGCAGAGGACCCATAACCAAGTCAGGCATTCGCCAG | | | LQGLERLMTWARM |
| | | | | CCCCCCATCAGAGCATTCATGGATGATCTGACAGTAACAACAACGTCAG | | | RFKPGKSRSLVLKAG |
| | | | | TTCCAGGGTGCCGTTGGATCCTCCAGGGCCTGGAGAGGCTTATGACTTG | | | KVTDRFRFYLGGTQIP |
| | | | | GGCCCGTATGCGCTTTAAACCTGGAAAATCTAGGTCCTTAGTCCTGAAG | | | SVSEKPVKSLGKMFD |
| | | | | GCAGGGAAGGTGACCGACCGCTTCCGCTTCTACCTGGGAGGCACCCAG | | | GSLKDAASIRETNDQ |
| | | | | ATTCCATCAGTCTCTGAGAAACCGGTGAAAAGCCTAGGTAAAATGTTCG | | | LGHWLTLVDKSGLPG |
| | | | | ACGGCTCCTTAAAGGATGCCGCTTCCATCAGGGAAACCAATGATCAGCT | | | KFKAWVYQHGILPRI |
| | | | | GGGGCACTGGCTGACGTTGGTCGATAAGTCAGGTCTTCCGGGGAAATT | | | LWPLLVYEFPISTVEG |
| | | | | CAAGGCATGGGTATACCAGCATGGTATCCTACCTAGGATACTGTGGCCA | | | LERRVSSCLRRWLGL |
| | | | | CTGCTGGTGTATGAATTTCCAATTTCCACCGTGGAAGGGCTTGAGAGGA | | | PRSLSSNALYGNNNK |
| | | | | GGGTCAGCAGCTGCCTCAGGCGTTGGCTGGGACTACCTAGGAGTCTGA | | | LTLPFSSLAEEFMVTR |
| | | | | GCAGCAATGCCCTCTACGGTAACAACAACAAGCTGACACTCCCCTTCAG | | | AREVLQYRESKDPKV |
| | | | | CAGCCTGGCAGAGGAATTCATGGTTACCAGAGCTAGGGAAGTTCTCCA | | | ALAGIEVRTGRRWRA |
| | | | | GTACAGGGAGTCCAAGGATCCCAAGGTAGCTCTTGCCGGCATTGAGGT | | | QEAVDQAESRLHHK |
| | | | | GCGGACTGGCAGAAGGTGGAGGGCTCAGGAGGCAGTGGACCAGGCAG | | | ELVGAVATGRAGLGT |
| | | | | AATCTCGGCTGCACCACAAAGAGCTTGTGGGAGCCGTGGCGACTGGCC | | | TPTTHLSRLKGKERR |
| | | | | GTGCAGGCCTGGGAACAACACCGACCACCCACCTCAGCAGGCTCAAGG | | | DQVQLEVRASIEEQR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCAAGGAAAGGCGGGATCAGGTCCAACTAGAAGTGAGGGCCAGTATTGAGGAACAGCGAGCTAGTCAGTGGGTGGGGCTGAGGCAGCAAGGCGCTTGGACTAGGTGGGAAGAGGCCATGGCCAGAAAGATCTCATGGCCTGAGCTGTGGAGGGCTGAGCCCTTGCGCATCCGCTTCCTTATTCAGTCAGTTTATGACGTCTTGCCCAGCCCATCAAACCTCTTCCTGTGGGGCAAGGTGGAATCCCCATCATGTCCCTTGTGCCAGGGAAGGGGCACCTTGGAGCACATCCTCAGCAGCTGTCCCAAAGCACTTGGAGAGGGTCGCTATCGCTGGCGTCACGACCAGGTGCTGAAGGCAATCGCTGAGTCTATCAGCTCCGCCATGGAGTACAGCAAGCGCCTACCCTTACCGGGACGCGGAGTTAGGTTTGTCAGGGCCGGTGAACAACCTCCTCCCCAACCAAGGGCCCAACCAGGCCTCCTTGCAACAGCTAGGGACTGGCAACTAAGGGTTGACCTGGGGAAACAATTAAAGTTCCCGGAAAACATCGTAGAAACCAACCTGAGGCCAGACATTGTTCTGCACTCACAGTCGTCCAAGCAAGTTATTTTGCTGGAGCTGACTGTGCCCTGGGAGGAGAGAATGGAGGAAGCGTATGAAAGGAAGGCAGGGAAGTACGCTGAGCTGGTGGAGGATTGCCGCAGAGCAGGGTGGCGCAGTAGATGCCTGCCTATAGAGGTTGGGGGTAGGGGCTTTGCAGGGAAGTCACTCTGCAAGGCCTTTAGCCTCCTGGGCATCACAGGCATGCGCAGGAGGAAAGCCATCTGCGCGGCCTCAGAGGCTGCAGAGAGGGCGTCCAGATGGCTGTGGATCCAGCGGGACAAGCCGTGGACGAGCGCTTCTTGGACACAGGCCGGGAACTGATCACTCCCAGTCGGGTCGCCTGGGTGAGGGGGTCTGATGTTGAAAGACCCGAAACCCCCGATGACCCCAGGTACTATCACTGACGATGTGTCCAAGACATGCATCAATAGGTGTATTTAGAAATC (SEQ ID NO: 1044) | | | ASQWVGLRQQGAWTRWEEAMARKISWPELWRAEPLRIRFLIQSVYDVLPSPSNLFLWGKVESPSCPLCQGRGTLEHILSSCPKALGEGRYRWRHDQVLKAIAESISSAMEYSKRLPLPGRGVRFVRAGEQPPPQPRAQPGLLATARDWQLRVDLGKQLKFPENIVETNLRPDIVLHSQSSKQVILLELTVPWEERMEEAYERKAGKYAELVEDCRRAGWRSRCLPIEVGGRGFAGKSLCKAFSLLGITGMRRRKAICAASEAAERASRWLWIQRDKPWTSASWTQAGN (SEQ ID NO: 1412) |
| NeSL | LIN9_SM | — | *Schmidtea mediterranea* | AAACGACATCATGAACGCTTGGCCGCAACAATCCAGTTATCCCTGCGGTAACATTGTGGAACTCATAAGACAAGTACTAAAAGAAGAATTAGAAAAATTAGAAGAAAAAATTGAAAATAATTTATTTATAAAATTTAAAAATTTAAATAAATTTAAAAATTTAAATTTAAATTTAAATGAAGATAAAAATTTATTTAATCCAATAAATAATCAAGAAAATCAAGAAAATGATGGATTCAAGACAATTAAATACTCCAAAAATAAGAAAATATCAGAACCCAAAAATGACAAACGACATCATGAAAAGCTACAACTACGCGGTTTTGAGCGATGTCACGCCTCAAGAAACCACTCAAACAACAACCCACTTAAATGTCGATATAGACAATGAAACCACCCAACCAAAACAGCCACTTACGAAGTCTGGCAAACCAAAATCTAAACCAATTGCGGTATCATACAAATTTAAAGATGCCACCTTCATCTGGGACACTACCCCACAAACAAATCCACCAAGAGATTGCACCAAACTTATTGATAAAACAAGACCAAGAAAGACCATCTTCAAAAAATCAGCATTTCAAAGCTACCTCAAAAAAGAACTGTCCAATGAGACATTTGTGGAAGTAAAAACCTTCCTCATGGCAACTCACAAATATCGTTTTAAAGACGAAAACTCAAGACTCTTGGCATACCGAATAATTAATCGCTATGTCATGGAGACAGCAAATGAATTCAAAGAAACCGAATTTGACATGGCTCGCTTTGCCAAATTCTTCACAATCCCAGAGAATTGGTTAAAACATCTAAAACCATACTCTACAGCTACCGAAACATCACCGGCTGATAGAATAAAAGTACAAAAATTAGTGGATCTCACATGCAGATACCCATTCAAAACTCAAGAAGAGCAAACAAGTGTAGCAAACTTCCTACACTTCTTCACCCAAAGATCAATAATTGGAATCTCAAGAGATTATAAATTCCAAAAATTTATACCATTTATGGCAAGAAAAAACACCAGGCCGGAGACAACCTCCACTATGGTTACGACTTCTCCAACAGAACAAAACAGACTACCAATGGTAATAATCACACCACTTGAAGAACCAAAAAGTGAACATCGTAGACCAGAGAAAAGAGGCGCAAGCAATGACACAATTGTGCTTAGCGACGAAGAGTTCCCACTACTTAAAAGGAGAACTCTTCCAACCAGAAAATCCAAAAATCC | AAACGACATCATGAACGCTTGGCCGCAACAATCCAGTTATCCCTGCGGTAACATTGTGGAACTCATAAGACAAGTACTAAAAGAAGAATTAGAAAAATTAGAAGAAAAAATTGAAAATAATTTATTTATAAAATTTAAAAATTTAAAT | TAAAATGGCAAAAAGATATTTCAAGATGAATTGTGGACTCATCTAAAAAATGACCACCTTGAGTCCAAATATGCCTAGCTATCATGGTTGCTGATGGAAACAGTAAGGCACCTGATAGCTAACTTTTCACTGTGAATATCTTCAGATATTCACA | MMDSRQLNTPKIRKYQNPKMTNDIMKSYNYAVLSDVTPQETTQTTTHLNVDIDNETTQPKQPLTKSGKPKSKPIAVSYKFKDATFIWDTTPQTNPPRDCTKLIDKTRPRKTIFKKSAFQSYLKKELSNETFVEVKTFLMATHKYRFKDENSRLLAYRIINRYVMETANEFKETEFDMARFAKFFTIPENWLKHLKPYSTATETSPADRIKVQKLVDLTCRYPFKTQEEQTSVANFLHFFTQRSIIGISRDYKFQKFIPFMARKNTRPETTSTMVTTSPTEQNRLPMVIITPLEEPKSEHRRPEKRGASNDTIVLSDEEFPLLKRRTLPTRKSKNPTGAGNVPTETECTDEVKFILNNEYQIECKECGKVWENVRNGLNHLRQK |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TACTGGTGCAGGAAATGTACCWACAGAAACCGAATGCACTGATGAAGT | CAATAAAT | GTGACA | HDFPNRTDVMVSCV |
| | | | | TAAATTCATCCTCAACAATGAATACCAAATAGAATGTAAAGAGTGTGGA | AATCAAGA | CGAAAG | RCEVPIKGAECVNHIK |
| | | | | AAAGTGTGGGAAAACGTACGAAATGGATTAAACCACCTTCGTCAAAAAC | AAATCAAG | GACACC | NHKKDDKEESEAGSL |
| | | | | ACGATTTCCCAAACCGAACAGATGTTATGGTATCTTGCGTAAGATGTGA | AAA (SEQ | ACTAGT | VANTQDIPNESSLSQ |
| | | | | AGTACCGATCAAAGGAGCAGAATGTGTAAATCACATTAAAAATCACAAA | ID NO: | AAAAAC | AAIEVYLRNILKMKEN |
| | | | | AAAGATGACAAAGAAGAAAGTGAAGCSGGGAGTCTTGTGGCTAACACT | 1168) | CACTAG | QERNIQYLEPSTANFL |
| | | | | CAAGACATCCCAAATGAAAGTAGCTGACTGTCACAAGCCGCAATCGAAG | | TTTTTTC | INRNLRAFYQNVKIEK |
| | | | | TATATCTGAGGAATATTCTGAAAATGAAAGAAAACCAGGAAAGGAATA | | TGACAC | LIGWEQVIWLIHWN |
| | | | | TTCAATATCTTGAACCTAGTACTGCGAATTTCCTCATAAATAGGAACCTC | | CTCTTGC | KCHWIVYLANCDSKT |
| | | | | AGAGCATTTTATCAAAACGTCAAAATCGAAAAGCTTATCGGATGGGAAC | | TACAAA | SVILDSDNQMTLQQ |
| | | | | AAGTCATCTGGCTTATACATTGGAACAAATGTCATTGGATTGTATACCTA | | CTCTGTA | RCNIKAKFDKFLEGTF |
| | | | | GCTAATTGCGACTCAAAAACCTCTGTTATCTTGGACTCTGACAACCAAAT | | AAAATC | EEKTVLGTLERKVPQ |
| | | | | GACATTACAGCAAAGATGTAACATAAAAGCCAAATTTGACAAATTCCTA | | AAAAGG | QPNNFDCGIYVIQYIS |
| | | | | GAAGGTACCTTTGAAGAAAAAACAGTGCTTGGAACCCTAGAAAGAAAA | | ATCGAT | DFLKDPQRIDYHTPD |
| | | | | GTTCCTCAGCAACCAAACAACTTCGATTGCGGTATATATGTGATACAATA | | AGGCCG | SKRIRKEIGELILEEMK |
| | | | | CATCAGCGACTTTCTTAAAGACCCACAAAGAATAGATTATCATACACCCG | | CGCTTTC | NPASKIKNPNKEIQSL |
| | | | | ACTCCAAAAGAATTAGAAAAGAAATAGGAGAATTAATATTAGAAGAAA | | ACGGTC | LQKFRLLQINVNDVF |
| | | | | TGAAAAACCCTGCCTCAAAAATCAAAAATCCAAACAAAGAAATACAATC | | TGTATTC | HWFAAEYQKSLPKIR |
| | | | | TTTACTCCAAAAATTCAGACTACTGCAAATCAATGTGAATGATGTATTCC | | GTACTG | TKRDGKLNKLSCSYQI |
| | | | | ATTGGTTTGCGGCTGAATACCAAAAATCTCTACCGAAGATACGTACCAA | | AAAATC | QRLFGLAPKRAVKEIY |
| | | | | AAGAGATGGAAAACTGAATAAACTAAGCTGCTCCTATCAAATCCAAAGA | | AAGATC | FQETSTADLETRVLN |
| | | | | TTATTTGGTCTAGCTCCTAAAAGAGCAGTCAAAGAAATATATTTCCAAGA | | AAGGAA | EHFKKDESTMKECKI |
| | | | | AACCTCTACAGCAGACTTGGAAACAAGAGTTCTAAATGAACATTTCAAA | | GCTTTTC | KNGNHYQDWITKAQ |
| | | | | AAGGATGAATCAACGATGAAAGAATGTAAAATAAAAAATGGAAACCAT | | CCCTTTT | IDNKEILEALKNSTDS |
| | | | | TACCAAGACTGGATAACAAAGGCCCAAATTGATAATAAAGAAATATTGG | | AGTCAA | APGEDNIPLRQWIIW |
| | | | | AAGCCCTAAAAAACAGTACAGATTCTGCCCCCGGAGAAGATAACATTCC | | CACCAG | NNDGVLFDMFNYIK |
| | | | | TCTGAGGCAATGGATAATCTGGAACAACGACGGTGTCCTCTTTGATATG | | GTTTCTG | RTHDIPDMWKNYTT |
| | | | | TTTAACTACATCAAAAGGACACACGATATCCCAGATATGTGGAAAAACT | | TCCTAGT | TLLIKPGKSQESNIPA |
| | | | | ACACCACAACACTACTTATAAAACCCGGAAAAAGCCAAGAAAGCAACAT | | TGAGCT | NWRPISILPTSYRIFM |
| | | | | CCCCGCTAATTGGAGGCCAATATCGATATTGCCAACAAGCTATCGTATAT | | TCCCTTG | KVLNKRVLEWANRG |
| | | | | TTATGAAAGTCCTAAATAAAAGAGTACTAGAATGGGCTAATAGAGGAG | | GGACAT | ELISKWQKAVDKAN |
| | | | | AACTGATATCAAAATGGCAGAAAGCCGTAGACAAAGCTAATGGATGTG | | CTGCGT | GCDEHSYVIQALIEKA |
| | | | | ATGAGCACAGCTATGTCATACAAGCGCTTATCGAAAAAGCAAACAGAA | | TACCATT | NRSYYKNEQCHLAFL |
| | | | | GCTACTACAAAAACGAGCAATGTCACCTCGCCTTCTTGGATTTGGCAGA | | TGACAG | DLADAFGSIPFQVIW |
| | | | | TGCTTTTGGAAGCATCCCATTCCAAGTAATATGGCATACCCTAAAAAATA | | ATGTAC | HTLKNMGMDEETIN |
| | | | | TGGGTATGGATGAGGAAACCATCAACTTGCTCAAAGAAATCTACAAAGA | | CGCCCC | LLKEIYKDCSTKYKCG |
| | | | | TTGCTCCACAAAATATAAATGTGGAAAGAATGAGTCAGAAAAGATCAAA | | AGTCAA | KNESEKIKITKGVRQG |
| | | | | ATTACGAAAGGAGTCCGACAGGGATGCCCATTGTCGATGACCCTCTTCA | | ACTCCCC | CPLSMTLFSLCIQYLI |
| | | | | GCCTCTGTATACAATATCTTATACAAGGCATAGCAGAAAAGAAAAAAGG | | ACCTGA | QGIAEKKKGATIAGQ |
| | | | | AGCAACAATTGCAGGTCAAGAAGTTTGCATATTGGCTTATGCGGACGAC | | CACTGTC | EVCILAYADDLVIVAN |
| | | | | CTAGTAATTGTTGCAAACACAGCAAAAGACATGCAAATGCTGTTAACAA | | CTCAAA | TAKDMQMLLTTIENL |
| | | | | CAATCGAAAATCTGGCAAAACAAGCCGATCTCATATTCAAACCGGCAAA | | ACAGTT | AKQADLIFKPAKCGY |
| | | | | ATGTGGATATTACAGAGACCCAAGAGATAAAAAGTCCATGATGAAGAT | | CAATTG | YRDPRDKKSMMKIY |
| | | | | ATATGGCAAAGAAATCAGCATAGTAGACGAAAAGAATGTTTACACCTAC | | CATCCG | GKEISIVDEKNVYTYL |
| | | | | CTAGGTGTAAGAATCGGTGACACAAAGAAAAAAGACCTAAATGTCAGA | | AAGATC | GVRIGDTKKKDLNVR |
| | | | | TTCGAAGAGGTCAAAAAGAAAACGACAGCAATCTTCAAATCGAAATTGC | | GCAATTT | FEEVKKKTTAIFKSKLR |
| | | | | GAAGTGACCAAAAACTAGAGGCATACAACATCTTTTGCCAATCAAAATT | | TTTCACT | SDQKLEAYNIFCQSKF |
| | | | | TGTGTACATCCTACAAGGCGAAGATATCGCAAAAACCAAAATTGAAACT | | AAAATA | VYILQGEDIAKTKIETY |
| | | | | TACGACGAAGAAATCAAGAAAATGATAAAAGAAGATATATTAAAATTAC | | AATTAA | DEEIKKMIKEDILKLQ |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AAGACAAAAGTCCGTTCACAGACTTCGTTATCTACTCCCCAAGAGAAAA<br>AGGGGGGTTAGGAATAACAAAGATAATAGATGAACAAACAATTCAAAC<br>TATTAATAGAACGGCAAAACTCCTAAATAGTAGCCATAGAGCAATCCGG<br>GCTATTATTTATGAAGAGCTAATACAAGTAGCTAACCTAAGAGGAGAAA<br>AAGAAATCAACACCATTGAAGAAGCACTAAAATGGTTGGAAGGTACCA<br>ACAAATACAAAAAGAACTCCAACGCCAAGACCACCTGGATAACAAGGG<br>TTCGGGAGGCCTTTCAAACTCTAGAAAAGAAACACAAAATCAAGGTTAG<br>ATTTGTGCCCAAAGAAAACTGCATTGGATATAAAATCAAATGCGACACC<br>CAAGAAAAGATAGTGGAGCTTGATAACTCAAAAGAGTTATCAAAAAGC<br>TTACACTGGATGATAAAAGAGGCATATTATAAAGAATGGAAAGCCCTAA<br>AATGCCAAGGATATATTATAAGCCTAAAAACCTCCGAATTTATGGAGTG<br>GAAAATGCCCAGAGGCCTTCCGGACCCTGATTGGAGATTCCTAACAAAA<br>GTAAAGGCAAATATGTTGGACGTAAACATGAAACAAGCCAACCAGGGA<br>GGAAGGTTGGGAAGCACAAAATGCCGAAAATGTGAAGATAAAGAATC<br>GGCAAGCCATGTTATAAACCACTGTGCCTCAGGTAACTGGAGTAGAGTG<br>GAAAAGCACAACCAGGTGCAAAATGAGCTAGCAAAAGAACTGACAAAG<br>CGGAATATCAGCTTCGAAAAGGACAGCATCCCAAAAGAAACAAAAGAG<br>AGCCTAAGACCAGATTTGGTTATAAGACTCAAAGACAAGATAATGATAG<br>TGGACATCAAATGCCCATTTGATGAGGAATCTGCTATCGAGAGTGCCAG<br>AAACAAGAACATAGACAAATATCGAGAACTGGCCAAAGAGATCCAAGC<br>AAAAACTGGGTTACAAACAACAGTCTCAACTTTCGTTGTCTGTTCTTTGG<br>GAACCTGGGATAAGAGGAACAACGAGCTCCTACGGCAGATGGGAATAA<br>GATATGAAGAATCCAAAGAGATGAGGATCAATATGATCCAAAAAGCCA<br>TCCACGGGTCTAGAAAAACCTACGACCACCACAGAAATTTTAACAATGG<br>TTAAAATGGCAAAAAGATATTTCAAGATGAATTGTGGACTCATCTAAAA<br>AATGACCACCTTGAGTCCAAATATGCCTAGCTATCATGGTTGCTGATGG<br>AAACAGTAAGGCACCTGATAGCTAACTTTTCACTGTGAATATCTTCAGAT<br>ATTCACAGTGACACGAAAGGACACCACTAGTAAAAACCACTAGTTTTTTC<br>TGACACCTCTTGCTACAAACTCTGTAAAAATCAAAAGGATCGATAGGCC<br>GCGCTTTCACGGTCTGTATTCGTACTGAAAATCAAGATCAAGGAAGCTT<br>TTCCCCTTTTAGTCAACACCAGGTTTCTGTCCTAGTTGAGCTTCCCTTGGG<br>ACATCTGCGTTACCATTTGACAGATGTACCGCCCCAGTCAAACTCCCCAC<br>CTGACACTGTCCTCAAAACAGTTCAATTGCATCCGAAGATCGCAATTTTT<br>TCACTAAAATAAATTAACAAAAGTTAATTATACTGCTTCATTGAGTAAGT<br>AGAAAAACAATC (SEQ ID NO: 1045) | | CAAAAG<br>TTAATTA<br>TACTGCT<br>TCATTGA<br>GTAAGT<br>AGAAAA<br>ACAATC<br>(SEQ ID<br>NO:<br>1291) | DKSPFTDFVIYSPREK<br>GGLGITKIIDEQTIQTI<br>NRTAKLLNSSHRAIR<br>AIIYEELIQVANLRGEK<br>EINTIEEALKWLEGTN<br>KYKKNSNAKTTWITR<br>VREAFQTLEKKHKIKV<br>RFVPKENCIGYKIKCD<br>TQEKIVELDNSKELSK<br>SLHWMIKEAYYKEW<br>KALKCQGYIISLKTSEF<br>MEWKMPRGLPDPD<br>WRFLTKVKANMLDV<br>NMKQANQGGRLGS<br>TKCRKCEDKESASHVI<br>NHCASGNWSRVEKH<br>NQVQNELAKELTKR<br>NISFEKDSIPKETKESL<br>RPDLVIRLKDKIMIVD<br>IKCPFDEESAIESARN<br>KNIDKYRELAKEIQAK<br>TGLQTTVSTFVVCSL<br>GTWDKRNNELLRQ<br>MGIRYEESKEMRIN<br>MIQKAIHGSRKTYDH<br>HRNFNNG (SEQ ID<br>NO: 1413) |
| NeSL | NeSL-1_CBre | — | *Caenorhabditis brenneri* | AAGGACGCTGGTTTAAGGCCGAATTCGTTCGTTCTTTTTCTGGCGGTCTT<br>GCTTTGAGCTTGGTTTCCGATCCTATGCCCTTGWGCATCAGCGATTGCG<br>TTCATCTGGTCTCGGCCGAAGGAGATACGATGAACGGGAGGTCCACTT<br>GTGGGCCATTGTCTCGTTCATCCTCTGTCGTAAGTAGGTCGAGGTCTTCC<br>CCTTCCCCCAGTGTTCCCCCCCACCCTTCCCCCAGTATCGGTCCAGATACA<br>GGATTGTCGGCTGGAATCATCGGCACATCGAGAGGATGTAGCCTTTGGT<br>TGCCAGAGGTGGACAATGCCTTATCACAGTGGCTGAGAAAAGGGTTGG<br>AACGAGACCATGAAGTTCTGGTTTGTGGATTTGAGGCAGCAAAGCCACT<br>GTCACTTTCCAAAGCTAGACTTCTAAGAAAGACCCCAAGGAACACTGGT<br>GTGGTTAGGCACATATTAGAATTTGACGGAAGGTTAGTTCATACTAACT<br>GTAACGAGACCGAGTGTGTTCTTTCTACTTTGTKCAGTGAMGWGGCTG<br>TCGAAGTAGTCAGGATATCTCTCAAATGTGAACCCCGTGAACCCTGTGA<br>ACCCAAATGTGTTCTTTCTATTTTATGCAGTGATAAGATAGTCWGGATAT | AAGGACG<br>CTGGTTTA<br>AGGCCGA<br>ATTCGTTC<br>GTTCTTTTT<br>CTGGCGGT<br>CTTGCTTT<br>GAGCTTGG<br>TTTCCGAT<br>CCT (SEQ<br>ID NO:<br>1169) | TAAACC<br>CACACG<br>AGAMCT<br>ACGACG<br>CCATAA<br>GATCAG<br>GCATGT<br>ACGGAT<br>GTGAAT<br>GAGACT<br>GATGAA<br>CGGAAT<br>GAGCAC | MPLXISDCVHLVSAE<br>GDTMNGRSTCGPLS<br>RSSSVVSRSRSSPSPS<br>VPPHPSPSIGPDTGLS<br>AGIIGTSRGCSLWLPE<br>VDNALSQWLRKGLE<br>RDHEVLVCGFEAAKP<br>LSLSKARLLRKTPRNT<br>GVVRHILEFDGRLVH<br>TNCNETECVLSTLXSX<br>XAVEVVRISLKCEPRE<br>PCEPKCVLSILCSDKIV<br>XISFECETREPFPFFXD |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CATTTGAATGTGAAACWCGTGAACCTTTTCCTTTCTTCMCGGATCGGAA | | GTGCCC | RKFREPIPFVFERMY |
| | | | | ATTCAGAGAACCTATTCCTTTCGTTTTCGAGAGGATGTATGACCCAAGA | | ATAAGA | DPRDPIPSFICWMYD |
| | | | | GACCCTATTCCTTCATTTATTTGTTGGATGTATGACCTGAGACAAAGGAT | | TCGGGT | LRQRMTPGTLPXNPL |
| | | | | GACCCCTGGCACSTTGCCAAGWAATCCCCTTTCTCMAGAGAACAAAGA | | ATKAAA | SXENKDSWGRPAVIK |
| | | | | CAGCTGGGGACGCCCAGCTGTCATAAAGAATGAGATAAGATCTATGAG | | GAWCA | NEIRSMRSYLEENVK |
| | | | | ATCTTATCTCGAAGAGAATGTGAAGGAAAACCGCCTGAACCTTTTGAGA | | GAGACG | ENRLNLLRRLRGGGE |
| | | | | AGGTTAAGAGGTGGTGGTGAAGGAAAGAAGATGATCAGAAAGTTGGT | | ATCCCTA | GKKMIRKLVAEKKSD |
| | | | | TGCAGAAAAGAAAAGCGACACAGAGGCTGTCTGCAGGATACTGTACCC | | MCATCG | TEAVCRILYPLDDRYE |
| | | | | ACTTGATGATCGTTATGAGTGTTTTGTTGATGGTTGTGAGACAACATCAA | | GGAAAA | CFVDGCETTSTMGY |
| | | | | CGATGGGATACGGGTCTAGTGACCTGAAATACATGACCACACACATAAA | | CACGAG | GSSDLKYMTTHIKKE |
| | | | | GAAAGAGCATGGTGTGAAAGTCCAATGGACATATGAGTGCTCCCTGTG | | TTATACT | HGVKVQWTYECSLC |
| | | | | TAATAAGCAAGCTCCTTTCATGGGGGGAGCTGCGTCCAAGTGGGTTACA | | GCTTCAC | NKQAPFMGGAASK |
| | | | | GCGCACATGGCAACAAAGCATACCGAAACGGTGAAGTTGAAGCTCAAA | | TGAMCT | WVTAHMATKHTETV |
| | | | | CCAAGCATCTCGACTACTGCCAAGGTTGCTGCGAAGCTAGATGAGATCG | | CGCTAA | KLKLKPSISTTAKVAA |
| | | | | CCGTGTCGCTACCCAAACCGAGACAAGTACGTGTATTGAGAGACCCAGA | | GCTCTCA | KLDEIAVSLPKPRQVR |
| | | | | TGAAGTGAAAGAGAAGGTTGCAAAACCAACACTTGCTTCCACGAGAGA | | TAATGA | VLRDPDEVKEKVAKP |
| | | | | AGAAGTGAAGAGAAATGCNTTGCGAAACATGGCCCCACTAGTCGAACT | | CCGAAC | TLASTREEVKRNALR |
| | | | | GAGTTCTCAGAATCAGTTGACWGGAGCCGAAAGACCTGAGGAAACTA | | TTGTTCG | NMAPLVELSSQNQL |
| | | | | GTGAAGCTATGCGACTCGAGGAGTGTAGGACTCCAGAGAAGATTGCTG | | CAACTG | TGAERPEETSEAMRL |
| | | | | AACTAGAAGGAAAGATACAGACCCGAACAGTGACTAAAAAGCTTAGTG | | CCTCCTA | EECRTPEKIAELEGKI |
| | | | | CACTGAAAGAGTCAATGGAAAAGAGAACGAGAGAGGAGAAGGTTGGG | | ACCGGG | QTRTVTKKLSALKES |
| | | | | AAACCATCACTTGCTCCAATTCATGAAGAAGTGAAAAAGACTGCAAGAC | | CGGGTG | MEKRTREEKVGKPSL |
| | | | | GGAGCTTGGCACCTCTAGTTGAACCGAGTACGTTCACTCATTTGACTGG | | TGAGAA | APIHEEVKKTARRSLA |
| | | | | GGCGTCAAGACTTCAGGCTGTTCGTGACGCGTTCTCGAAAGCCAACAAA | | GGGAGG | PLVEPSTFTHLTGASR |
| | | | | GACGCTGCGGCGAAAAGAAGGTCTAGCCTGGCGAAACCAGCTAGATTA | | TCGCCTT | LQAVRDAFSKANKD |
| | | | | TCAGAGATTATGAATACCACCTTCACGAAGGAGACGGTAAATGAGACG | | GAGGCG | AAAKRRSSLAKPARL |
| | | | | AAAGAACCTGTGAATGATACTGACGAGAGTATCGCAACAATCCAGCCAC | | GACGCA | SEIMNTTFTKETVNE |
| | | | | AAGTACGTGTCTACCGGTTTAATACATGGTGTCTCGATCATGAAACCAC | | ATGAGG | TKEPVNDTDESIATIQ |
| | | | | GAGAGAAGCCTGGTTAACCGGAGAAGTTGTGGATTGGTTCATGGGAAA | | GATGTG | PQVRVYRFNTWCLD |
| | | | | AGTGACTGAGAAGAAAGACCAGTACAGAGTGTTTGACTCACTTGTATG | | TGCAGG | HETTREAWLTGEVV |
| | | | | GTCAATGTACAAGTTCCATGGTGTAGGGTATGTATTGGATCTGATGAGG | | TTCCCCC | DWFMGKVTEKKDQ |
| | | | | GATCCTCTAACATACTTCTTACCAATATGTGAACACGATCACTGGGTTTT | | TCTTGA | YRVFDSLVWSMYKF |
| | | | | GCTAGTGATTGATGAGAAAGGAATTTGGTACGGTGACTCGAAAGGTGC | | GATCCG | HGVGYVLDLMRDPL |
| | | | | AGAACCGTGTAGAGAAATCGCCAAATTCATAGAAGAGACGAAAAGAGA | | AAAGTC | TYFLPICEHDHWVLL |
| | | | | AAGACGAATGTTCCCAGTCCCCGTACCTCTTCAAAGAGACGGAGTGAAC | | TAAAAG | VIDEKGIWYGDSKGA |
| | | | | TGTGGTGTACATATATGTCTAATGGTTAAATCCATCGTGAATGGCGAAC | | TACTAG | EPCREIAKFIEETKRER |
| | | | | CATGGTACACCGAAGAAGAAGTGAAAGTGTTCAGAAGAAATGTGAAAA | | ACCGAA | RMFPVPVPLQRDGV |
| | | | | GAGGTCTGAAAGAATTTGGTTTTGAACTTTATTCTGAAAGGATCGTCTAT | | AGATCG | NCGVHICLMVKSIVN |
| | | | | GTCGGAGATGACAGCATAAAAGTGAATGATGAGCATGATGATGACGTG | | AGGACG | GEPWYTEEEVKVFRR |
| | | | | GTATTCCTCTCGGAGGAGACGAATAACACTACGTTCACGATCGAGCAAG | | GACGGG | NVKRGLKEFGFELYSE |
| | | | | CAGAAGATCCGGCTGAAGAGGATGCCCAGCATCTGGAGAGTCCGGTGA | | ATGGCC | RIVYVGDDSIKVNDE |
| | | | | AACCTGTAAAGCTCATGGAGTTGAAAATTCCAAAGATTGAGATAAAGAA | | GCGAGG | HDDDVVFLSEETNNT |
| | | | | GAAAGAGATTCGGAGAAAACCGAAACAACAAATCGAAAAGAAAAGAA | | CACACG | TFTIEQAEDPAEEDA |
| | | | | AGGTGCCAACAGGGAAACCAGATGAACTGTTGGTCAGAGTGCGATTAT | | GCGGGT | QHLESPVKPVKLMEL |
| | | | | GGTTGGAAAGAGAAGTCCAATCATACTTCGACTCTGGAAAGAGATTCCA | | AACACA | KIPKIEIKKKEIRRKPK |
| | | | | AAGACTGGAGTGGATATTAGATGTCCTCACGGCTGCGATTCACAAGGCT | | GCCAGA | QQIEKKRKVPTGKPD |
| | | | | ACCGCCGGTGATGAGCAAGCAATTGAAAGAATTGAGAAGAGATCACCC | | TAACCTA | ELLVRVRLWLEREVQ |
| | | | | CCTTTGGAAGTGGAAGAGGGTGAAATGTCTACACAGACAGAACCAAAG | | GTAGAT | SYFDSGKRFQRLEWI |
| | | | | AAAAGAGAAAGAAAAGAAAAGGAGTCAGGTTGTGAAATGAAAGCTTCT | | CTTCGG | LDVLTAAIHKATAGD |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CACAAGGAGATGTACTTCAAAAACCGCTCCAAAGCGTTCAATGTGATAA | | ATCTCGT | EQAIERIEKRSPPLEVE |
| | | | | TTGGAAAAGACTCAAAGCAATGCGAGATTCCAATTGAGACCCTGCAAAA | | CGGCCT | EGEMSTQTEPKKRER |
| | | | | GTTCTTTGAGGGAACAACTGCAGAAACGAATGTGCCAGCAGAAGTGCT | | GGAGAT | KEKESGCEMKASHKE |
| | | | | GAAAGAGATGGGTTCACGTCTGCCAAAGTTGGAGGCGTTGGACTGGAT | | ATGTGG | MYFKNRSKAFNVIIG |
| | | | | GGAAGCTAATTTCATTGAAAGTGAAGTGTCAGATGCGATGAAAAAGAC | | AACCCT | KDSKQCEIPIETLQKF |
| | | | | CAAAGACACCGCTCCGGGTGTAGACGGACTACGGTATCACCATTTGAAA | | GGGAAA | FEGTTAETNVPAEVL |
| | | | | TGGTTTGATCCAGAGTATAAGATGTTGACACTTCTCTACAATGAATGTAA | | GGAGAA | KEMGSRLPKLEALD |
| | | | | GAACCATCGAAAGATTCCAAGTCATTGGAAAGAGGCAGAGACGATTCT | | AGTTGTT | WMEANFIESEVSDA |
| | | | | CCTTTATAAAGGAGGTGATGAAACGAGGCCCGACAACTGGAGACCTAT | | TGTTGG | MKKTKDTAPGVDGL |
| | | | | AAGTTTGATGCCCACGATCTACAAACTGTATTCTAGTCTTTGGAACCGAA | | GCTGGC | RYHHLKWFDPEYKM |
| | | | | GAATTAGATCAGTTGGTGGTGTGATGAGCAAATGTCAACGAGGTTTCCA | | AAGAGT | LTLLYNECKNHRKIPS |
| | | | | AGAGAGAGAAGGGTGTAATGAAAGCATAGGAATCCTTAGAACGGCTAT | | GAAGTT | HWKEAETILLYKGGD |
| | | | | CGATGTCGCTAAGGGAAAGAGAAGGAACCTGTCAGTTGCATGGTTAGA | | TGAATG | ETRPDNWRPISLMPT |
| | | | | CCTTACGAATGCGTTTGGTTCAGTACCCCATGAACTGATAAAAAGTACTC | | TGAACC | IYKLYSSLWNRRIRSV |
| | | | | TGGAATCGTATGGATTCCCAGAAATGGTGACAGAGATTGTCATGGATAT | | ACCGTC | GGVMSKCQRGFQER |
| | | | | GTACAGAGGTGCATCAATCCGAATCAAGAGCAAGAATGAGAAAAGTGA | | ATGCAA | EGCNESIGILRTAIDV |
| | | | | ACAGATTGTTATCAAATCTGGAGTGAAGCAGGGAGACCCCATCTCCCCC | | CCACTA | AKGKRRNLSVAWLD |
| | | | | ACGCTGTTCAACATGTGTTTAGAGAATGTGATAAGAAGACATCTGGATA | | AACCAG | LTNAFGSVPHELIKST |
| | | | | GTGCTTCGGGACACAGATGCATAAAGACAAAAGTCAAGGTCCTGGCTTT | | TGGCGA | LESYGFPEMVTEIVM |
| | | | | TGCAGATGACATGGCCATACTGGCCGAGAACAGAGATCAGTTACAAACT | | TGCGGG | DMYRGASIRIKSKNE |
| | | | | GAACTAAACAAGTTGGACAAAGAATGTGAATCACTAAACCTCATTTTCA | | TGGAGT | KSEQIVIKSGVKQGD |
| | | | | AACCGGTAAAGTGTGCCAGTTTGATAATTGAGAGAGGAATGGTGAATA | | CATCAC | PISPTLFNMCLENVIR |
| | | | | AGAATGCGGAAGTGGTTCTGAGAGGGAAGCCAATCAGAAACCTAGATG | | AGGAAA | RHLDSASGHRCIKTK |
| | | | | AGAATGGTTCCTATAAGTACCTGGGAGTACATACAGGAATCGCAACAAG | | ATGTTTC | VKVLAFADDMAILAE |
| | | | | AGTTTCAACAATGCAATTGTTGGAAAGTGTCACGAAAGAAATGGATCTA | | TGTTGCT | NRDQLQTELNKLDKE |
| | | | | GTGAATCAGAGCGGCATGGCTCCGTTTCAAAAACTAGACTGCCTAAAGA | | TGACTTA | CESLNLIFKPVKCASLI |
| | | | | CGTTTGTTTTGCCGAAACTAACGTACATGTATGCGAACGCAATACCTAA | | TCAGTG | IERGMVNKNAEVVL |
| | | | | GTTAACGGAGCTTAAGGTCTTTGCAAACTTGACGATGAGAATGGTGAAA | | TTTGATA | RGKPIRNLDENGSYK |
| | | | | GAGATTCATGAAATCCCCATCAAGGGATCTCCGTTAGAGTATGTACAGC | | TCGCCCT | YLGVHTGIATRVSTM |
| | | | | TACCTCCAAGTCAAGGCGGATTAGGAGTGGCTTGTCCAAAGATAACAGC | | CAGGCA | QLLESVTKEMDLVN |
| | | | | GTTGATTACCTTCTTGGTCAACGTCATGAAAAAGCTATGGTCTTCTGACA | | CAAGTA | QSGMAPFQKLDCLK |
| | | | | GTTACATCAGAAAACTATACAGGGACTACCTGGATGAAGTCGCAGAGA | | TGAAGG | TFVLPKLTYMYANAIP |
| | | | | CGGAGACAGGTATGGAAGAGATGACGAAAGAAGATATTGCAAAATATC | | CCCCCAC | KLTELKVFANLTMRM |
| | | | | TGAGTGGTGATGTGCCGATCGACAAGAAGGCGTTCGGTTACAACACMT | | CCACAT | VKEIHEIPIKGSPLEYV |
| | | | | TCACAAGAGTAAGAGATGTGTGCAACAGCCTCACTAASATAGKGGGAG | | AAACTC | QLPPSQGGLGVACPK |
| | | | | CTCCACTGCACAAGTTAAAGATTGTGGAGAGAGACGGTGACTTTGCCAT | | CCTAGC | ITALITFLVNVMKKL |
| | | | | TCTAGTGCAAGCCACCAAAGAAGGAATGGAGAAAATCTTCACCTGTGCT | | AACTGG | WSSDSYIRKLYRDYLD |
| | | | | CAGGAGAAGAAACTCCAACAGCTTCTGAAAGCAGAAGTMAACACGGCT | | TAGTCC | EVAETETGMEEMTK |
| | | | | CTAGCGCACCGTTTCTTCACCGAGAAACCMGTGAAAAGTGCAGTGATG | | AGCAAG | EDIAKYLSGDVPIDKK |
| | | | | AGTGTAATGAGACAGTATCCACAGAGCAATGCCTTTGTGAAGAATGGA | | CGCTGG | AFGYNTFTRVRDVCN |
| | | | | AAGAATGTGAGCATTGCTGTCCACTCGTGGATACACAAAGCAAGGTTGA | | TWCTTG | SLTXIXGAPLHKLKIVE |
| | | | | ATGCGCTGCATTGCAACTTCAACACGTACGGTGAAAACAAGTCAAAAGT | | CTACTAT | RDGDFAILVQATKEG |
| | | | | GTGCCGACGTTGCGGCAAAGACGTGGAAACCCAACTGCACATCCTGCA | | TGCGCC | MEKIFTCAQEKKLQQ |
| | | | | GWCATGCGAGTACGGGTTACCAAAGCTAATCAACGAAAGACATGATGC | | CCAGGC | LLKAEVNTALAHRFFT |
| | | | | GGTGTTACATGTGGTGAGAAACCTCATCCGCAAAGGCTCAAAGAAAGA | | TCGCCC | EKPVKSAVMSVMRQ |
| | | | | CTGGAAGCTAAAGATAGATGAAACTGTGTCAAGTTGTAATCAACTTCGT | | (SEQ ID | YPQSNAFVKNGKNV |
| | | | | CCAGACATCTATATGTGTAGCCCAGATGGGAAAGAGGTCATAATGGCA | | NO: | SIAVHSWIHKARLNA |
| | | | | GATGTAACCTGTCCTTATGAATCAGGAATGCAAGCTATGCAAGAGAGTT | | 1292) | LHCNFNTYGENKSKV |
| | | | | GGAACCGAAAGGTCACSAAATACGAAGGAGGCTTTAGCCACTTCCAWA | | | CRRCGKDVETQLHIL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGATGGGAAAGAAATTCACAGTGTTGCCAATAGTGGTTGGATCACTGG | | | QXCEYGLPKLINERH |
| | | | | GAACGTGGTGGAAACCCACAACGAACAGCTTAGTTCAACTAGGCATAG | | | DAVLHVVRNLIRKGS |
| | | | | AGAAAGASACGATAAGAAGAGTGATCCCCGAGCTGTGCTCAATGACCA | | | KKDWKLKIDETVSSC |
| | | | | TGGAATACAGTAAGGATGTCTACTGGAACCATATATTCGGGGACACCTT | | | NQLRPDIYMCSPDGK |
| | | | | CAGGAAGCCACCAATGAGATTTGGTGTAGAGAAGCCAAAGGGTAATAG | | | EVIMADVTCPYESG |
| | | | | TTGGAAGAAGGAAGGCAGCGAGCCGAAAGGTGCTGCTTCCTCCGACTA | | | MQAMQESWNRKVT |
| | | | | AACCCACACGAGAMCTACGACGCCATAAGATCAGGCATGTACGGATGT | | | KYEGGFSHFXKMGK |
| | | | | GAATGAGACTGATGAACGGAATGAGCACGTGCCCATAAGATCGGGTAT | | | KFTVLPIVVGSLGTW |
| | | | | KAAAGAWCAGAGACGATCCCTAMCATCGGGAAAACACGAGTTATACT | | | WKPTTNSLVQLGIEK |
| | | | | GCTTCACTGAMCTCGCTAAGCTCTCATAATGACCGAACTTGTTCGCAAC | | | XTIRRVIPELCSMTME |
| | | | | TGCCTCCTAACCGGGCGGGTGTGAGAAGGGAGGTCGCCTTGAGGCGGA | | | YSKDVYWNHIFGDTF |
| | | | | CGCAATGAGGGATGTGTGCAGGTTCCCCCTCTTGAGATCCGAAAGTCTA | | | RKPPMRFGVEKPKG |
| | | | | AAAGTACTAGACCGAAAGATCGAGGACGGACGGGATGGCCGCGAGGC | | | NSWKKEGSEPKGAA |
| | | | | ACACGGCGGGTAACACAGCCAGATAACCTAGTAGATCTTCGGATCTCGT | | | SSD (SEQ ID NO: |
| | | | | CGGCCTGGAGATATGTGGAACCCTGGGAAAGGAGAAAGTTGTTTGTTG | | | 1414) |
| | | | | GGCTGGCAAGAGTGAAGTTTGAATGTGAACCACCGTCATGCAACCACTA | | | |
| | | | | AACCAGTGGCGATGCGGGTGGAGTCATCACAGGAAAATGTTTCTGTTG | | | |
| | | | | CTTGACTTATCAGTGTTTGATATCGCCCTCAGGCACAAGTATGAAGGCCC | | | |
| | | | | CCACCCACATAAACTCCCTAGCAACTGGTAGTCCAGCAAGCGCTGGTWC | | | |
| | | | | TTGCTACTATTGCGCCCCAGGCTCGCCC (SEQ ID NO: 1046) | | | |
| NeSL | NeSL-1_CJap | — | *Caenor-habditis japonica* | GCGCCCCGGGTTACATTGTCGGGGCCACCTTTCTCTTGGAGTAGAGTAC | GCGCCCCG | TAAAAG | WRRPAPKQTKNSSL |
| | | | | AGTCTACTAATTTTTTGATAAGCTAGTCGGGTCCGAACCACTAGAGTTTG | GGTTACAT | CCAAAA | HHLGHEVKRIARLKP |
| | | | | CTTGAAAATGCGTCAAACCAGCATTTTAGAACTCGCCCAAAAGTTCGGC | TGTCGGG | GCCACG | GIFEFHAKPKNSSLHH |
| | | | | CCCGACCCCCAAACAAATGGGACCTTCTTGACGATTTTCCCTGAAAATCG | GCCACCTT | GAGCAT | LGHGVKRXARLKPGI |
| | | | | GAGGATGGAATGGTCCCCTATTCTTGTAAATAGKACTGTGCAATACCCC | TCTCTTGG | CGGGAA | FEFHAKXKNSSLHHL |
| | | | | TTCGTCATCTGTGGGGAACAGATGACACGTGACGTCATCCGTGTAGACG | AGTAGAGT | AGAAAA | GHEVKRIARLKPGIFE |
| | | | | TCACGTTTTCCCGTGCCTGCGGGAGCCCCCAATCGAGCAATTTTTGCTCT | ACAGTCTA | ATGGAA | FHAKPKNSSLHHLGH |
| | | | | TTTGAGTGTCTGGAACGCTTGAAACCCCAGACAAATCAGGCCCAGTCGT | CTAATTTTT | AAGGAC | EVRRNSRLKPGIFGFY |
| | | | | CGGAAAATTTCTTTTTGAAATTTTTTGGCGCCTGCGAAAAAAATTTTTTA | TGATAAGC | TGAAAA | QKSKNSSLHHLGHEV |
| | | | | ACCGCCACAAACCCCCGGGAGGCGCGGWTAGGGATATCGATGTCATCG | TAGTCGGG | CGAGAC | RRIARLKPGILEFHAK |
| | | | | ACTCGTCGGTGATCTTTGATTTTCTCTCTGCGTCTCCTATTTTGGAACAGT | TCCGAACC | TGAAAA | NRIKSGLKVTFLSDLX |
| | | | | CTCGACCAAAAAACCGGGCCTGGCAACCCACCGAATCCGGATGTCGGA | ACTAGAGT | ATCCCA | AHAGALACSRFLAST |
| | | | | GGGATTTGGCAAGAAATGTTGGAAATAACGAAATTTCGTTATTTTCAGC | TTGCTTGA | AACAAA | LKTEHCRQKSFKPVG |
| | | | | ACAATTGTCAAACCGGCAAGAAAACTGGATGGACAAGACACACAATTTA | AAATGCGT | ACAAAT | FLLHFLKNSSINEVAS |
| | | | | CCGGAAATTGTGCTTGTTACGTCGAATTTCCCAATTTTGAAAAAATTCCT | CAAACCAG | CCAAAA | LRNVKKXFLEFFSGKP |
| | | | | CGTTCCACTGGTCGGGACGCGAGGTCAGACGATCTGCACGTCTGAAACC | CATTTTAG | CAAACT | IGGMASFSRTKITFFK |
| | | | | CAAAATCTTCGGATTTTATGCAGTAGTGGCGCCGCCCGGCTCCCAAACA | AACTCGCC | GAAAAA | LCLKNFVLSAENPPIIR |
| | | | | AACAAAAAATTCCTCGTTGCACCATTTGGGGCACGAGGTCAAACGAATT | CAAAAGTT | AAAAAA | QKTNQNKASXVQIA |
| | | | | GCACGTTTGAAACCTGGAATTTTTGAATTCCATGCAAAACCAAAAAATTC | CGGCCCCG | AAAACA | RGGHLSDCLPSQKM |
| | | | | CTCGTTGCACCATTTGGGGCACGGGGTCAAACGAWTTGCACGTTTGAA | ACCCCCAA | AAACAA | AGVLGRLFLSVQSTLS |
| | | | | ACCCGGAATCTTCGAATTCCATGCAAAACMAAAAAATTCCTCGTTGCAC | ACAAATGG | AAACTG | HRPFDTLLRSDDDKR |
| | | | | CATTTGGGGCACGAGGTCAAACGAATTGCACGTTTGAAACCCGGAATTT | GACCTTCT | GACAGA | GRKTIKLQFFIKENLV |
| | | | | TCGAATTCCATGCAAAGCCAAAAAATTCCTCGTTGCACCATCTGGGGCA | TGACGATT | CACTGG | TPXVARDVKILXKQT |
| | | | | CGAGGTCAGACGAAATTCACGTCTGAAACCCGGAATCTTCGGATTCTAT | TTCCCTGA | AAACAG | KNNSGNSDSNSETK |
| | | | | CAAAAATCAAAAAATTCCTCGTTGCACCATTTGGGGCACGAGGTCAGAC | AAATCGGA | TGTCAG | NFSKNKVSRQNGPLI |
| | | | | GAATTGCACGTTTGAAACCCGGAATTCTCGAATTCCATGCAAAAAACCG | GGATGGA | GCAAAG | GGGNHKKIGENQITR |
| | | | | GATAAAATCCGGTCTAAAAGTGACGTTTTTGTCAGATCTTWCTGCTCAC | ATGGTCCC | TCGCCG | TLEIESKSDDNKVLVL |
| | | | | GCTGGTGCGTTGGCGTGTAGCAGATTTCTGGCATCGACACTTAAAACGG | CTATTCTT | ATTATAC | RILYPTNDWYKCYSQ |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGCACTGCCGACAAAAAAGCTTCAAGCCAGTCGGTTTTCTGCTTCATTTC | GTAAATAG | TGTTCCA | WCQHKSLVGYGAHD |
| | | | | CTAAAAAATTCCTCGATCAACGAGGTGGCGTCTCTCCGCAACGTCAAAA | KACTGTGC | CGCCTTA | LKYLTDHIKSTHSKKV |
| | | | | AAAWKTTTCTTGAATTTTTCTCAGGAAAACCTATCGGTGGGATGGCTTC | AATACCCC | AAAGTC | EWSYQCSICDAKAEG |
| | | | | TTTCAGTAGAACCAAAATAACTTTTTTCAAACTTTGTTTGAAGAATTTTGT | TTCGTCAT | CCGAAA | TGTKAARWITAHMP |
| | | | | TTTGTCTGCTGAAAATCCCCCGATAATCCGCCAAAAAACAAACCAAAAC | CTGTGGG | TGGCGC | KVHGIEATHRIKQNS |
| | | | | AAAGCGAGCCKTGTCCAAATCGCAAGAGGAGGTCATCTGTCAGACTGTC | GAACAGAT | AAAACA | EKTTNVKTANSLQE |
| | | | | TKCCGTCCCAAAAGATGGCAGGAGTTCTCGGACGACTATTTCTCTCGGTT | GACACGTG | ACCTGA | MALSLQKPKNGPKK |
| | | | | CAGAGCACTCTCTCGCACCGCCCTTTCGACACGTTATTGCGGAGCGATG | ACGTCATC | ATCTATC | VVMATSTTPEKKISEL |
| | | | | ACGACAAAAGAGGGAGGAAAACGATCAAACTCCAGTTTTTTATTAAAGA | CGTGTAGA | TGAAAG | ESKIQTREVAKQLSAL |
| | | | | AAATCTGGTCACACCTKTGGTTGCTAGGGACGTGAAAATTTTAAAMAAA | CGTCACGT | TGCTCCA | KESAQKNQQGNKTK |
| | | | | CAAACAAAAAACAATTCTGGGAACTCTGATAGCAACAGTGAAACAAAA | TTTCCCGT | AACCAC | NVKSSLKTIAENTNET |
| | | | | AACTTCTCTAAAAATAAAGTTTCCAGACAAAATGGCCCATTGATTGGGG | GCCTGCGG | GCACAA | KKISARKSLINYLKPED |
| | | | | GCGGTAACCACAAAAAAATCGGAGAAAACCAAATCACACGCACTTTGG | GAGCCCCC | CTCGGA | VLNHIPKEPKPASAKX |
| | | | | AAATTGAATCCAAAAGCGATGACAACAAAGTTTTGGTCCTCCGAATACT | AATCGAGC | GAAAAT | GLQELTGAQRLQETR |
| | | | | GTACCCAACTAATGATTGGTACAAGTGTTACTCCCAATGGTGCCAACAC | AATTTTTG | CAGGGA | RRFMAGNRRDSIAR |
| | | | | AAATCCCTTGTTGGATATGGCGCTCACGATTTAAAATACTTGACAGACCA | CTCTTTTG | CAAGTT | RESLSLGKISNSFKIEL |
| | | | | CATAAAGTCCACTCATTCTAAAAAGGTTGAGTGGTCTTATCAGTGTAGTA | AGTGTCTG | GCTTCAC | KNAPEKTTLKKPAVT |
| | | | | TTTGTGACGCAAAAGCCGAAGGTACCGGTACAAAAGCWGCTAGATGG | GAACGCTT | GCAACG | QKQNTSQNVSSSTV |
| | | | | ATTACAGCCCACATGCCAAAAGTACACGGTATTGAAGCAACACACAGAA | GAAACCCC | GGCTGG | VKENKTGNDVITIDD |
| | | | | TTAAACAAAATTCTGAAAAAACAACAAATGTTAAAACTGCGAACAGTCT | AGACAAAT | GACAGG | TETVKRKINTWCLDH |
| | | | | CCAGGAAATGGCGCTGTCGCTCCAAAAACCAAAAAATGGTCCGAAAAA | CAGGCCCA | TACCCCC | ESTENAWMADDIIF |
| | | | | AGTTGTAATGGCAACTAGTACGACCCCAGAAAAGAAAATCTCTGAACTG | GTCGTCGG | TCCTGA | WYIQKQIEISLDNKKF |
| | | | | GAATCAAAAATCCAAACCAGAGAAGTGGCCAAACAATTGAGCGCTCTG | AAAATTTC | AACCGC | KVIDPLIWTTYRIYGV |
| | | | | AAGGAGTCAGCTCAAAAAAATCAGCAAGGAAACAAAACAAAAAAATGTT | TTTTTGAA | GAGGTT | ECVQDELVGFEKYFF |
| | | | | AAATCAAGCTTAAAAACAATTGCTGAAAACACAAATGAAACMAAAAAG | ATTTTTTG | GAGGAT | PICENGHWVLLIIDDK |
| | | | | ATWAGCGCTCGAAAGAGCCTTATAAACTATCTGAAACCTGAGGATGTG | GCGCCTGC | GGACGG | RVWYSDSLADKPIEVI |
| | | | | CTCAATCACATTCCAAAGGAGCCAAAACCAGCTTCTGCGAAAAKTGGCC | GAAAAAA | GAAGGC | EDLINKLNRTQGKFN |
| | | | | TKCAAGAACTGACTGGTGCTCAAAGACTGCAGGAAACMAGAAGAAGG | ATTTTTTAA | CGCGAG | QTVPKQKDGFNCGV |
| | | | | TTTATGGCWGGAAACAGAAGAGATTCAATTGCAAGAAGAGAAAGTCTG | CCGCCACA | GCTTAT | HVCLVAKSVITENFW |
| | | | | TCTCTCGGCAAAATCTCAAACTCATTTAAAATTGAGCTGAAAAATGCTCC | AACCCCCG | GGCGGG | YTEKDVNDFRKTVKL |
| | | | | GGAAAAAACAACTCTTAAAAAACCGGCTGTCACTCAGAAACAAAACACG | GGAGGCG | TAACTC | WLFSEGFELYSEPYK |
| | | | | AGTCAGAATGTATCTAGTTCTACGGTTGTAAAAGAGAACAAAACAGGAA | CGGWTAG | GGTTGG | QIQNKNISVNSEKNQ |
| | | | | ATGACGTGATCACAATTGATGACACAGAAACTGTTAAAAGAAAAATAAA | GGATATCG | TGTGCT | ISDNEKNWGDKTQT |
| | | | | CACTTGGTGTCTCGACCACGAATCCACAGAAAATGCGTGGATGGCTGAC | ATGTCATC | AGTAGA | VNESTLKERDEDIFLL |
| | | | | GACATCATATTCTGGTACATCCAGAAACAGATTGAAATCAGTTTGGACA | GACTCGTC | TGATTTA | RPHISVGVALKTEDEK |
| | | | | ATAAAAAGTTCAAAGTGATTGATCCACTCATCTGGACCACATATCGAATT | GGTGATCT | TATCCG | NQKAENLKAPQKLK |
| | | | | TATGGTGTCGAATGTGTCCAAGATGAACTAGTTGGATTTGAAAAATACT | TTGATTTT | ACAGCC | AIRRLKILKTCLKKLTA |
| | | | | TTTTTCCAATCTGTGAAAATGGTCATTGGGTTTTGCTGATTATCGATGAC | CTCTCTGC | CCAACT | VKGKPEETERAAIPNL |
| | | | | AAAAGAGTCTGGTACAGTGATTCCCTGGCCGATAAACCAATTGAGGTTA | GTCTCCTA | AAGAGG | MAIKLKTPPKVEPVR |
| | | | | TTGAGGACCTCATAAACAAACTAAATCGAACCCAAGGTAAATTTAACCA | TTTTGGAA | AATCCT | RNPEKGENYXKSQP |
| | | | | AACGGTTCCAAAACAAAAAGACGGCTTTAATTGTGGAGTTCATGTATGT | CAGTCTCG | GGGAAA | NKKRQIPTGKPDELV |
| | | | | CTGGTGGCCAAATCCGTTATCACTGAGAACTTTTGGTACACAGAAAAAG | ACCAAAAA | GGAAAA | KKVREWFEIQFQAYF |
| | | | | ACGTTAATGACTTCAGAAAAACTGTCAAGCTTTGGCTTTTCAGTGAAGG | ACCGGGCC | CTTGAA | EDGKSFQRLEWXTGL |
| | | | | GTTTGAACTCTATTCAGAGCCGTACAAACAAATCCAAAACAAAAACATTT | TGGCAACC | AAAGTT | LTAAIHKASAGDEQA |
| | | | | CCGTTAATTCGGAAAAAAATCAAATCAGTGATAATGAAAAAAATTGGGG | CACCGAAT | TTTACAG | VGKIIKRCPPLEIEEGE |
| | | | | TGATAAAACTCAAACTGTGAATGAGAGTACTCTGAAAGAAAGAGATGA | CCGGATGT | GGCTGG | MATQTETKQKPKNQ |
| | | | | AGACATCTTTTTGCTCAGACCACACATCAGTGTTGGAGTTGCTCTCAAGA | CGGAGGG | TAATAG | KSTKGANSSSSIREAY |
| | | | | CAGAAGACGAGAAAAATCAAAAAGCTGAAAACTTGAAAGCCCCACAAA | ATTTGGCA | TTCAGC | AENRARTFNKIIGKD |
| | | | | AACTCTGAAACACGGAAGAATTCCAAGTGGACAAAAACGAGAAACCAG | AGAAATGT | ACAATT | DKCEIPIEKIEKFFENT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AATCTCCAAATGCCCAGGAAACTCCAAAAAACGAGCCAAAAATGGTTCC | TGGAAATA | GTAGTC | TSNTNVPTETLARITS |
| | | | | AAGTCCGAAGAATTCGGAAAAAGAAATTTCTACTGAGCTTCTGGATGCT | ACGAAATT | TACTGTC | DLPKLEIGSWIEEEFR |
| | | | | CAAGAAGCCGGAGAAGAGCTGAAAAGCGATCCGAAGGCTGAAAATCCT | TCGTTATT | TTGCAA | EKEVAEALKKTKDTA |
| | | | | GAAAACCTGTCTCAAAAAGCTGACGGCAGTGAAGGGAAAACCGGAAGA | TTCAGCAC | CCACAA | PGVDGLRYHHLSWF |
| | | | | GACGGAAAGAGCCGCCATTCCAAACCTCATGGCAATCAAGCTCAAGAC | AATTGTCA | CAAACC | DPKXKLLTKLYNECRE |
| | | | | GCCTCCAAAAGTTGAACCTGTAAGAAGAAACCCTGAAAAGGGTGAAAA | AACCGGCA | AGTGGT | HKKIPGHWKEAETVL |
| | | | | TTACMAAAAAAGTCAGCCAAACAAAAAGAGACAAATACCAACCGGAAA | AGAAAACT | TCTGCG | LYKGGDETQAENWR |
| | | | | ACCGGATGAATTGGTTAAAAAAGTCCGAGAATGGTTTGAAATTCAATTT | GGATGGA | GGTAGA | PISLMPTICKLYSSLW |
| | | | | CAAGCATATTTTGAGGACGGAAAATCCTTCCAGAGGTTAGAGTGGWTG | CAAGACAC | TCAAACT | NKRIKSVTGVLSKCQ |
| | | | | ACAGGTTTGCTCACGGCTGCAATTCACAAAGCTTCGGCTGGAGATGAGC | ACAATTTA | ATAATTT | RGFQEREGCNESIAIL |
| | | | | AAGCTGTGGGMAAAATCATCAAACGTTGTCCACCTCTGGAAATTGAAG | CCGGAAAT | GTGTGT | RTAIEAAKGTKKSLSI |
| | | | | AAGGGGAAATGGCTACCCAAACTGAAACAAAACAAAAACCAAAAAACC | TGTGCTTG | TTTCTTT | AWLDLTNAFGSVPH |
| | | | | AAAAGAGCACAAAAGGAGCAAATAGTTCCAGCTCAATTCGGGAAGCCT | TTACGTCG | TACTTGA | ESIEATLIAYGFPGMV |
| | | | | ATGCTGAAAACCGAGCGAGAACCTTCAACAAAATTATTGGAAAAGACG | AATTTCCC | CCCGGG | TEVIKDMYNGASIRV |
| | | | | ACAAATAGTGTGAAATTCCAATTGAAAAAATTGAAAAGTTCTTCGAGAA | AATTTTGA | CAACAC | KTKNEKSKQILIKSGV |
| | | | | CACAACTTCAAATACCAATGTTCCAACAGAAACACTAGCGAGGATCACT | AAAAATTC | ATTATAC | KQGDPISPTLFNICLE |
| | | | | TCTGATCTTCCAAAACTCGAGATTGGTAGTTGGATTGAAGAAGAGTTCA | CTCGTTCC | CACGTC | SVIXRHLKSADGHKCI |
| | | | | GGGAGAAAGAAGTAGCCGAAGCTCTTAAAAAAACAAAGGATACTGCCC | ACTGGTCG | CACAAG | XSNIKLLAFADDMAIL |
| | | | | CAGGTGTAGATGGATTACGGTACCATCATCTGAGCTGGTTTGATCCAAA | GGACGCG | GACGAA | SDSKTKLQQELQKM |
| | | | | AAKGAAACTGCTCACAAAACTGTACAACGAATGCAGGGAGCACAAGAA | AGGTCAGA | TTCATAA | DDDCTPLNLIFKPAKC |
| | | | | AATCCCAGGTCACTGGAAAGAGGCAGAAACTGTACTCCTCTACAAAGG | CGATCTGC | TGGCCC | ASLIIEWGKVQKDQK |
| | | | | GGGGGACGAGACGCAGGCCGAGAATTGGCGACCAATCAGTCTCATGCC | ACGTCTGA | CTCCCTA | IKLKGQFIRSLAEQDT |
| | | | | AACCATCTGCAAGCTATACTCTAGCCTGTGGAACAAAAGAATAAAATCC | AACCCAAA | AATAAA | YKYLGVQTGIETRVSA |
| | | | | GTGACAGGTGTTCTGAGCAAATGCCAAAGGGGTTTTCAAGAAAGAGAG | ATCTTCGG | CTCCCTA | MQLMKKTVSELDKI |
| | | | | GGTTGTAATGAAAGCATTGCAATTCTCAGAACCGCTATTGAAGCGGCAA | ATTTTATG | GCAACT | NCSALAXWQKLDAV |
| | | | | AAGGAACAAAAAAGAGCCTGTCAATTGCTTGGTTGGACCTTACCAATGC | CAGTAG | GGTGGT | KTFVLPKMTYMYAN |
| | | | | ATTTGGCTCAGTTCCACACGAATCGATCGAGGCCACACTAATTGCTTACG | (SEQ ID | CCGGCG | TVPKLSELKEFANITM |
| | | | | GTTTTCCGGGAATGGTAACCGAGGTAATAAAAGACATGTATAATGGCG | NO: 1170) | AAGCCG | RAIKVMQNIPVKGSP |
| | | | | CATCGATTCGTGTAAAAACAAAAAACGAAAAGAGTAAACAAATCCTGAT | | GTTCTTG | LEYVQLPIGKGGLGV |
| | | | | TAAATCGGGTGTAAAACAGGGTGATCCAATCTCACCTACTCTTTTCAACA | | CCACTAT | ACPKTTALITYLVSTM |
| | | | | TTTGCCTTGAAAGTGTCATTMGTCGCCACCTAAAAAGCGCGGATGGTCA | | TGCGCC | KKLWSTDDYIRKLHT |
| | | | | CAAATGCATCGAMTCAAACATCAAATTATTGGCGTTTGCCGATGACATG | | CCAGGC | DYLKMVAIKETKTKE |
| | | | | GCAATCCTGTCAGATTCCAAAACAAAACTCCAACAAGAGTTACAAAAAA | | TCGCCC | VTLEDLASYLSDDKTV |
| | | | | TGGATGATGACTGTACACCGCTCAACCTTATCTTCAAACCCGCCAAATGT | | (SEQ ID | CKKAVGYNSFTRVREI |
| | | | | GCAAGTCTGATAATTGAGTGGGGAAAAGTACAAAAAGATCAAAAAATA | | NO: | CKTLSKNKGALLSQLK |
| | | | | AAACTAAAAGGTCAATTCATCAGAAGTTTGGCCGAACAAGACACCTACA | | 1293) | IIAKDGKLAILVQAXK |
| | | | | AATATCTTGGGGTGCAAACTGGCATCGAAACGCGCGTTTCTGCAATGCA | | | DGKTKIFTHDHVKTL |
| | | | | ACTGATGAAAAAAACKGTCAGCGAGCTTGACAAAATAAATTGCTCTGCA | | | QKXLKKEINEALLHRF |
| | | | | CTGGCTCMWTGGCAAAAACTGGACGCAGTAAAAACTTTTGTGCTCCCA | | | TTEKRVKSEVVRVVQ |
| | | | | AAAATGACGTACATGTATGCAAATACTGTACCGAAACTCTCCGAGCTCA | | | EYPQCNSFVRDGGK |
| | | | | AAGAGTTCGCAAATATTACAATGAGAGCAATAAAAGTAATGCAAAACAT | | | VSIGAHRFVHKARLN |
| | | | | TCCAGTAAAAGGTTCACCATTGGAGTATGTACAGTTACCCATTGGAAAA | | | LLACNYNTWQDAAT |
| | | | | GGTGGACTAGGAGTGGCATGTCCAAAAACAACTGCGTTGATAACCTATC | | | KQCRRCGYEKETQW |
| | | | | TGGTTTCAACAATGAAAAAATTGTGGTCCACTGATGACTATATCAGGAA | | | HILSSCPKSMGGKITE |
| | | | | ACTACACACAGACTACCTGAAAATGGTGGCCATAAAAGAAACGAAAAC | | | RHDSVLKTVKEMIQT |
| | | | | AAAAGAGGTCACACTAGAGGACCTTGCCTCCTACCTAAGTGATGATAAA | | | GSLKNWKLKLDHELP |
| | | | | ACCGTCTGCAAAAAAGCGGTTGGTTATAATTCATTCACAAGGGTACGAG | | | GSTRLRPDIYLRSPNG |
| | | | | AAATCTGCAAAACGCTATCAAAAAACAAAGGAGCACTGTTAAGCCAACT | | | SEIILGDVTIPYEHGIE |
| | | | | AAAAATCATTGCAAAAGATGGAAAGTTGGCTATTCTGGTACAGGCTSTG | | | AMQTAWQKKIEKYE |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AAAGATGGCAAAACAAAGATTTTCACGCATGACCACGTGAAAACCTTGC<br>AAAAASTTCTTAAAAAAGAAATAAATGAAGCCCTTCTGCACAGATTCACA<br>ACTGAAAAAAGAGTGAAAAGCGAAGTGGTGCGAGTGGTCCAAGAGTA<br>CCCCCAGTGCAACTCCTTTGTCAGAGATGGAGGAAAAGTTAGCATTGGA<br>GCGCATCGCTTTGTGCACAAAGCCAGGTTGAACCTGCTCGCGTGTAATT<br>ACAACACGTGGCAGGATGCAGCCACAAAACAATGCAGAAGGTGTGGAT<br>ATGAAAAAGAAACCCAATGGCACATCCTCTCATCTTGCCCAAAAAGTAT<br>GGGAGGAAAAATAACTGAAAGACACGATTCTGTGTTAAAAACAGTAAA<br>AGAGATGATTCAAACTGGATCTCTCAAAAACTGGAAACTAAAACTTGAT<br>CATGAATTGCCAGGATCAACCAGACTTCGCCCGGATATCTATTTGAGAA<br>GCCCAAATGGATCCGAAATAATTCTTGGCGATGTCACAATCCCGTATGA<br>ACACGGAATTGAAGCTATGCAAACAGCATGGCAGAAAAAAAATTGAAAA<br>ATATGAAGAGGGCTTCAAATACCTTCGTTCTACCGGCAAAAAACTCACA<br>ATTGTGCCAATTGTGGTCGGAGCACTAGGAAGTTGGTGGAAGCCCACA<br>ACAGACAGTCTTGTCAGTCTGGGAATCGACAAAAATACTGTAAAAAGAG<br>CTATTCCAGAAATTTGCTCTACAGTACTCGAATACAGTAAAAACATTTAC<br>TGGAACCATATATTCGGGGATTCCTACCAAAAAGTACCCATGTTTTTCGG<br>CGGTGAAAAACCAAAGGGGCAAAGTTGGAAGAAAGTGAAGCCTCCTGA<br>AGGCAAAACTGCTTCTAACCATGAGCCTCCAGGTTAAAAGCCAAAAGCC<br>ACGGAGCATCGGGAAAGAAAAATGGAAAAGGACTGAAAACGAGACTG<br>AAAAATCCCAAACAAAACAAATCCAAAACAAACTGAAAAAAAAAAAAA<br>AACAAAACAAAAACTGGACAGACACTGGAAACAGTGTCAGGCAAAGTC<br>GCCGATTATACTGTTCCACGCCTTAAAAGTCCCGAAATGGCGCAAAACA<br>ACCTGAATCTATCTGAAAGTGCTCCAAACCACGCACAACTCGGAGAAAA<br>TCAGGGACAAGTTGCTTCACGCAACGGGCTGGGACAGGTACCCCCTCCT<br>GAAACCGCGAGGTTGAGGATGGACGGGAAGGCCGCGAGGCTTATGGC<br>GGGTAACTCGGTTGGTGTGCTAGTAGATGATTTATATCCGACAGCCCCA<br>ACTAAGAGGAATCCTGGGAAAGGAAAACTTGAAAAAGTTTTTACAGGG<br>CTGGTAATAGTTCAGCACAATTGTAGTCTACTGTCTTGCAACCACAACAA<br>ACCAGTGGTTCTGCGGGTAGATCAAACTATAATTTGTGTGTTTTCTTTTA<br>CTTGACCCGGGCAACACATTATACCACGTCCACAAGGACGAATTCATAA<br>TGGCCCCTCCCTAAATAAACTCCCTAGCAACTGGTGGTCCGGCGAAGCC<br>GGTTCTTGCCACTATTGCGCCCCAGGCTCGCCC (SEQ ID NO: 1047) | | | EGFKYLRSTGKKLTIV<br>PIVVGALGSWWKPT<br>TDSLVSLGIDKNTVKR<br>AIPEICSTVLEYSKNIY<br>WNHIFGDSYQKVPM<br>FFGGEKPKGQSWKK<br>VKPPEGKTASNHEPP<br>G (SEQ ID NO: 1415) |
| NeSL | NeSL-<br>1_CRem | — | *Caenor-<br>habditis<br>remanei* | CGCGAACCAGTCATATGACAGTCTTTATTGATCGCGGTATAGGCGAGCG<br>AGGCCAGATGGCCGTATGTAGCCTCCACCGTTATTTTTCGTTTTCACCTTT<br>TTCCCCCATCCCCCCGTATGTAAATAATGGATCGTTCGGCGAAAATGGCT<br>GTGGCACAGACAAATCACTGTTGCCCGTCATAGAAGTTGTTGTTCGTGA<br>AGTTAAGATAAATTGGTCTGAGAATATTTTGGTAGTAGAGTGTCTGATA<br>ATGGTAAAGAGCGGAGAAAGAGTCGTTGTAAAGAGACAAAATCTGGAA<br>AAAGTTATTCAGAATTTGGCAAGAATCAACTCAACTCTATTTTCCAATCT<br>AGGAAATCAGATATTTTGCGTAGTACCCAGAATAAAAGACAGTACCAAT<br>AAAGAGCAGGGATACAGGAAAGAGAAGCAAWTGAAATTCCATGTATC<br>ATTCCGAAGTATAAAATCCCAAGTTCCACCATATTTGAGAGGTGGGGGA<br>GATGTAATGGAAGATACAGAGATAAGAGGTATCAGAAAGTTGGAGCCA<br>GAGGCTCAGTTAGACAGCTCAAAACCGCTGATCTGCAGAGTTCTCTACC<br>CAACGCAAGGTTATATGTATAAATGTTTTTATCCAAAGTGTAAAGGACA<br>TAGTAATGGATCAACAGATCTGAGAAGTCTGAAGAAACACATGGTGGA<br>TAAGCATTTCACGAATATTGAATTTGCATATAAATGTGCTACGTGTATGT | CGCGAACC<br>AGTCAT<br>(SEQ ID<br>NO: 1171) | TAGCCG<br>ATCGTA<br>AAAGAA<br>ACCGAG<br>CCGTAA<br>CAACAA<br>GCAAAG<br>TAAACA<br>AAAGAA<br>AAATCA<br>ATAAAA<br>AGGAAG<br>GTTGAC<br>CTCAGA<br>CCCCGA | MTVFIDRGIGERGQ<br>MAVCSLHRYFSFSPF<br>SPIPPYVNNGSFGEN<br>GCGTDKSLLPVIEVVV<br>REVKINWSENILVVE<br>CLIMVKSGERVVVKR<br>QNLEKVIQNLARINST<br>LFSNLGNQIFCVVPRI<br>KDSTNKEQGYRKEKQ<br>XKFHVSFRSIKSQVPP<br>YLRGGGDVMEDTEIR<br>GIRKLEPEAQLDSSKP<br>LICRVLYPTQGYMYK<br>CFYPKCKGHSNGSTD<br>LRSLKKHMVDKHFTN |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTTTAACGACTGGGAAATCGGCCACAGCGTTAAAATCAATAAAGGCACA | | GGAGGG | IEFAYKCATCMFLTTG |
| | | | | TATGGCAAGTCACCACAAGGTAACGATGGAACCCGGTAAAAAGAGTCT | | AAGAGA | KSATALKSIKAHMAS |
| | | | | CGTGCAAAAGTTGAATGCCAGACTCGAAGAAGCTGCTCCATCACTTCCA | | GACACC | HHKVTMEPGKKSLV |
| | | | | ATGCCGAGAAATCGATCAAAGGTCATACAGTTGACCCCCGAGAAATCGA | | SAGAAA | QKLNARLEEAAPSLP |
| | | | | TATCGGAATTGGAGAAAAAGAAGCAAACTCGTTCTGTGGCAAAACAGC | | AAGAGA | MPRNRSKVIQLTPEK |
| | | | | TTAGCACACTGAAAGAGTCGGCACAGAAAAAGGAAGAGGAGGTGAAG | | GACGCA | SISELEKKKQTRSVAK |
| | | | | ATAGCGGAGGTCAAAAAGAGAGAACCCCGTCTATCAATAATCCCAGAG | | GAGAAA | QLSTLKESAQKKEEEV |
| | | | | TCGAATGTCAGGCGAAGTCTGGCGGCAGGACTCGAACAATGTATAAAC | | AGGAGA | KIAEVKKREPRLSIIPE |
| | | | | CCTGAGCAATCGGTAGCTCAGAGGATAAGAGAAAAAAGAGAAGAATAC | | GACACC | SNVRRSLAAGLEQCI |
| | | | | GCCAAAGCTTCTAGGGAGGCAGCGGCAAAAAGAAGATCGAGTTTGGCA | | TCTCATA | NPEQSVAQRIREKRE |
| | | | | ATGAAGCCAGCTAGATTACCAGACAAAGAAAACGAGATTACACTCCAG | | AGGAGA | EYAKASREAAAKRRS |
| | | | | GAAACGAAAAAGATCGATGATCCAATCGTTATAGACCTGGAAAAAGAA | | GGTAGG | SLAMKPARLPDKENE |
| | | | | TGTATTCTCACTACAGTACTTCAAGTCCCAAGAAACCAGTTCAACTCGTG | | TCAATCC | ITLQETKKIDDPIVIDL |
| | | | | GTGTCTAGAGCATGAGACAACGATTGACGCTTGGTTAACGGATGAGGT | | AAATGT | EKECILTTVLQVPRNQ |
| | | | | AATACATATGTACATGTGCACAATAACCGAGAATCGAAAATATTTTATG | | AAACAG | FNSWCLEHETTIDA |
| | | | | GCAATCGATCCGGTTCTGTGGCCAGTCTATGTGAGAAATGGAGCAGAG | | AAAAAA | WLTDEVIHMYMCTI |
| | | | | GATCTACTGAGGCGTACTAGTTGCCCAGGAACATTCTTCTTTCCAATTTG | | CCAGTG | TENRKYFMAIDPVL |
| | | | | TGAAAGTAATCATTGGGTTCTATTAGTGATAGAACACGATGTGTATTGG | | GGGAGG | WPVYVRNGAEDLLR |
| | | | | TATCTGGATCCGAAAGGCGAGGAACCAAAAGGAAATGTAGAGATTCTT | | AAAGAA | RTSCPGTFFFPICESN |
| | | | | TTAGAGTCCATGAAAAGGAAAAGGCAGTACTATGAATTCCCACCACCCT | | AGACTG | HWVLLVIEHDVYWY |
| | | | | CACAGAGAGATAATGTGAATTGTGGAGTGCATGTCTGTCTTATGGCAAA | | ATTTCAC | LDPKGEEPKGNVEILL |
| | | | | ATCAATAGTAGATGAATGTGGTTATAATTGGTATTCTGAAGAGGACGTA | | CCACTA | ESMKRKRQYYEFPPP |
| | | | | AGGTCATTCAGAACCAATATGAAGGACATTCTGAAAAGTAAGGGATAT | | AAATGA | SQRDNVNCGVHVCL |
| | | | | GAGTTATGTCCTGAGCCTTATAATAGGCAAAATTTATTAAAAACAGAAA | | ATTTGG | MAKSIVDECGYNWY |
| | | | | AACAAAAGGAAGTTATTCTGGAAGAAATGATCGATTCATTCGTTGTAGA | | AAACAG | SEEDVRSFRTNMKDI |
| | | | | AGACGATATGACGTTCACAGTGCATCGGGATTCTGATCATGGTGATGAT | | AATTTG | LKSKGYELCPEPYNR |
| | | | | GAAGTTGAACATCTGAAGACCATTGAGCAGGAACCTGAAAATGAAATA | | GAAGAG | QNLLKTEKQKEVILEE |
| | | | | AGTGAAATTGAGAATGTAGAGGGATCTGTAGACTCAGTCATTCCAAAGT | | AAAAGA | MIDSFVVEDDMTFT |
| | | | | TGATGGAAATGAGAGTGCAGACACCTCCAGTGATCAATGAAAAAAGAG | | GAAAGG | VHRDSDHGDDEVEH |
| | | | | GTAAAAAGCGAGTATCGGCCAAAGAGAAACCGAGAAAGCAAAAGGAA | | GAAACC | LKTIEQEPENEISEIEN |
| | | | | AAAGAGCAAAAAGTGCCAACAGGAAAACCAGATGAGCTGGTTAAAAGA | | TAAAGA | VEGSVDSVIPKLMEM |
| | | | | GTAAGAGTATGGTTTGAGAAAGAATTCAAATCGTATGTGGAAGATGGA | | AAATAG | RVQTPPVINEKRGKK |
| | | | | AAAAGTTTCCAAAGGTTGGAATGGMTAACAGATGTTCTCACTGCAGCA | | TTCTCTT | RVSAKEKPRKQKEKE |
| | | | | ATTCAGAAGGCGTCAGCCGGAGATGAGAAAGCAGTAGAACTGATTGAG | | GCCAAA | QKVPTGKPDELVKRV |
| | | | | AAAAGATGTCCACCTTTGGAAWKCGAGGAGGGTGAAATGTGTACCCAG | | ATTCTGT | RVWFEKEFKSYVEDG |
| | | | | ACTGAAAAGAAAAAGAAACCAAAAAGTGGTAAAGGGAATGGCGGTCA | | AGAGGA | KSFQRLEWXTDVLTA |
| | | | | AGAAAGTATGAAGTCCTTGATGGCCTCATACAGTGAGAACCGAGCCAA | | ATACTTT | AIQKASAGDEKAVELI |
| | | | | AACCTACAATAGAATAATTGGTAAGCATTCAAAGCAGTGTGAGATCCCA | | GTCAAA | EKRCPPLEXEEGEMC |
| | | | | ATAGCCAAAGTACAAAAGTTCTTTGAAGGGACCACTGCCGAGACAAATG | | ACATGA | TQTEKKKKPKSGKGN |
| | | | | TGCCAAAGGAAACACTTAAGGAAATGTGTTCACGCCTCCCGAAAGTTGA | | TAGAAA | GGQESMKSLMASYS |
| | | | | AGTGGGAACGTGGATTGAAGGTGAATTCAGTGAAAGTGAAGTGACTGA | | CCAGTA | ENRAKTYNRIIGKHSK |
| | | | | AGCATTGAAGAAGACAAAGGACACAGCACCAGGGGTAGATGGATTAA | | ATCTGG | QCEIPIAKVQKFFEGT |
| | | | | GGTACCATCACCTGAAATGGTTTGATCCCGAGTTGAAAATGCTGTCACA | | TACGAA | TAETNVPKETLKEMC |
| | | | | GATCTATAATGAGTGTAGAGAACACAGAAAAATTCCAAAGCATTGGAA | | AGACAA | SRLPKVEVGTWIEGE |
| | | | | AGAGGCAGAGACAATTCTTCTCTATAAGGGAGGAGATGAGTCMAAAM | | GTAAGA | FSESEVTEALKKTKDT |
| | | | | CGGATAATTGGAGGCCTATCAGTCTGATGCCAACCATCTATAAACTGTA | | CCTGAA | APGVDGLRYHHLKW |
| | | | | TTCTAGTCTCTGGAACAGAAGGATTAGAGCAGTGAAAGGGGTGATGAG | | CTGACA | FDPELKMLSQIYNEC |
| | | | | CAAGTGTCAGAGAGGTTTCCAAGAAAGAGAAGGATGTAATGAAAGTAT | | AGAAGG | REHRKIPKHWKEAET |
| | | | | CGGAATATTGAGAACAGCCATAGATGTGGCCAAGGGCAAAAAGAGAAA | | AAGTCA | ILLYKGGDESKXDNW |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CATAGCCGTAGCATGGTTAGATCTCACGAATGCCTTTGGATCAGTACCA | | GAAAGA | RPISLMPTIYKLYSSL |
| | | | | CATGAGCTGATAAAAGAAACTCTGGAATCTTACGGATTTCCAGAAATAG | | AATACC | WNRRIRAVKGVMSK |
| | | | | TAGTAGACGTCGTAGAAGACATGTATCGAGATGCATCGATCCGTGTGAC | | GCTCAC | CQRGFQEREGCNESI |
| | | | | GACGCGAACGGAGAAAAGTGATCAGATTATGATCAAGTCAGGAGTGAA | | AAAGCC | GILRTAIDVAKGKKR |
| | | | | GCAGGGAGATCCAATCTCGCCTACTCTCTTCAACATGTGTCTCGAGAGT | | TGTGAT | NIAVAWLDLTNAFGS |
| | | | | GTCATCAGAAGGCATCTCGACAGATCAGTCGGCCATCGGTGCCTGAAAA | | CGATTCT | VPHELIKETLESYGFP |
| | | | | CAAAAATAAAAGTATTAGCCTTTGCAGACGATATGGCAGTATTAGCAGA | | CTTACCT | EIVVDVVEDMYRDAS |
| | | | | AAGTAGTGAACAGTTGCAAAAGGAGTTGACAGCTATGGATGCTGACTG | | ACTGAA | IRVTTRTEKSDQIMIK |
| | | | | CTCAGCACTGAATTTGCTATTCAAACCGGCTAAATGTGCAAGTCTGATAT | | CTTGTTC | SGVKQGDPISPTLFN |
| | | | | TGGAAAAAGGAATAGTAAACAGGTTAAATGAGGTAGTTTTGAGAGGGA | | TCTTGG | MCLESVIRRHLDRSV |
| | | | | AACCGATCAGAAACCTCATGGAAAATGAGACCTACAAGTACTTAGGTGT | | CCTCGTA | GHRCLKTKIKVLAFAD |
| | | | | TCAGACAGGTACGGAAACAAGGGTTTCCATAATGGATCATATAACGGA | | ACCGGC | DMAVLAESSEQLQKE |
| | | | | AGTGTCAAGGGAGATAGATCTAGTGAATATGAGTCAACTGGCAATGCA | | TAAAGG | LTAMDADCSALNLLF |
| | | | | CCAGAAACTAGATATACTCAAAGCCTTCATACTTCCAAAGATGACCTATA | | GAGAAG | KPAKCASLILEKGIVN |
| | | | | TGTATCAGAACACGACACCTAAACTGTCAGAACTGAAAGTGTTTGCCAA | | GAATGT | RLNEVVLRGKPIRNL |
| | | | | TTTGGTAATGAGGTCAGTGAAGGAATTCCACAACATTCCCCTAAAAGGG | | TAATTG | MENETYKYLGVQTG |
| | | | | TCACCGTTGGAGTATGTCCAACTTCCCGTAGGAAAAGGAGGATTAGGA | | GAGATA | TETRVSIMDHITEVSR |
| | | | | GTGGCATGTCCAAAGAACACAGCCTTATTAACATTCTTGGTAACCATTAT | | GACATA | EIDLVNMSQLAMHQ |
| | | | | GAAAAAGTTATGGTCATCTGATAGCTATATCAGAAAGTIGTATACAGAC | | AAGATA | KLDILKAFILPKMTYM |
| | | | | TACCTAGAGGAGGTGGCAAAAGTGGAAATTGGAAAGTTCGAGGTCAAC | | GGTGGA | YQNTTPKLSELKVFA |
| | | | | TTGAACGATCTAGCAGAATTCCTAAGTGACGAAAGAGCAGTCGACAGC | | GTGAAG | NLVMRSVKEFHNIPL |
| | | | | AAGTTGTTCGGCTTCAATGCGTTCACGAGGGTGAGAGAAGTGGTGAGG | | GTCCTG | KGSPLEYVQLPVGKG |
| | | | | AGTCTCTGTAAGAATAAAGATTCTCCACTACATAGTCTGAAAATAATTGA | | TTCTTGA | GLGVACPKNTALLTF |
| | | | | AAGAGAAGGGAAACTTGCCATAAGTGTGCAAGCAACCGAAGAAAGTAT | | AACTAG | LVTIMKKLWSSDSYIR |
| | | | | TGAGAAAATCTTCACTGAAGACCAGGAAAAGAAGTTAATGTACCTACTG | | GAGGAA | KLYTDYLEEVAKVEIG |
| | | | | AAAGGGGAGCTAAATACAGCTCTCCAGCACAGGTTCTTTACTCAAAAGG | | TGTGGA | KFEVNLNDLAEFLSDE |
| | | | | TATTCAAAAGTGAAGTAATGAGAGTGGTTCAACAGCATCCACAAAGTAA | | AAGAGC | RAVDSKLFGFNAFTR |
| | | | | CAGTTTTGTCAGAAATGGTGGAAAAATGAGTTTTTCGGCTCAAAGATTT | | AGAAGG | VREVVRSLCKNKDSP |
| | | | | GTCCACCCAGGAAGACTGAACCAGTTGCCATGTAACTACAACACTTGGG | | CCGCGA | LHSLKIIEREGKLAISV |
| | | | | CAAAAGGCCGTACGAAGTTGTGTAGAAGGTGTGCAAAGAATGAAAATG | | GGCTTT | QATEESIEKIFTEDQE |
| | | | | AGACACAGTCGCATATACTGCAAGTGTGTGACTACTCAATAGGAAATAT | | AGACGG | KKLMYLLKGELNTAL |
| | | | | CATAAAGGAAAGACACGATGCAGTTCTTTATAAGTTTAGAGAACTCATT | | GTAACT | QHRFFTQKVFKSEV |
| | | | | AAAAGAGGGTCAAAAGGTCATTGGTTAGAGAGAACTGACCGGACAGTA | | CAGTCA | MRVVQQHPQSNSFV |
| | | | | CCAAATACTGGATCACAGCTGAAGCCAGATCTCTATCTGGAAAGCCCAG | | GTTGCT | RNGGKMSFSAQRFV |
| | | | | ACGGGAAGCATGTGATACTAGCCGATGTGACAGTTCCATATGAAAGAG | | AGTGGT | HPGRLNQLPCNYNT |
| | | | | GCATCGAAGGAATGCAAAAGGCATGGAATGAGAAAATCAACAAGTATA | | CTTCGG | WAKGRTKLCRRCAK |
| | | | | CTGATGGATATAAAGAAATATTCAGAAGACAAGGAAAATCCCTAGTAGT | | ATCCAA | NENETQSHILQVCDY |
| | | | | GTTACCATTAGTAGTTGGTTCACTGGGAACGTGGTGGAAGCCCACGGA | | CGGCTT | SIGNIIKERHDAVLYK |
| | | | | GGAAAGTCTGATCAAACTAGGTGTTGAGAAGACTACAGTAAGAAGGAT | | CGGACA | FRELIKRGSKGHWLE |
| | | | | AATACCTGAGACGTGTGGAATGGTGGCTGAATACAGTAAGAACTGCTA | | TAGTGA | RTDRTVPNTGSQLKP |
| | | | | TTGGAGACACATCTACGGTGAAAAGTATGTTCAAACTCCAATGATAAAT | | GGAACC | DLYLESPDGKHVILAD |
| | | | | GGAGGAAAAAAGCCTGAAGGAAATGATTGGAAAAAGTGTGAAAAAGG | | CTGGGT | VTVPYERGIEGMQKA |
| | | | | AATAGAAGTTCCTAAAGTTACTAATTAGCCGATCGTAAAAGAAACCGAG | | ACGGAG | WNEKINKYTDGYKEI |
| | | | | CCGTAACAACAAGCAAAGTAAACAAAAGAAAAATCAATAAAAAGGAAG | | AAGAAA | FRRQGKSLVVLPLVV |
| | | | | GTTGACCTCAGACCCCGAGGAGGGAAGAGAGACACCSAGAAAAAGAG | | TGGAAA | GSLGTWWKPTEESLI |
| | | | | AGACGCAGAGAAAAGGAGAGACACCTCTCATAAGGAGAGGTAGGTCA | | AGAGAT | KLGVEKTTVRRIIPET |
| | | | | ATCCAAATGTAAACAGAAAAAACCAGTGGGGAGGAAAGAAAGACTGAT | | AGGGCG | CGMVAEYSKNCYWR |
| | | | | TTCACCCACTAAAATGAATTTGGAAACAGAATTTGGAAGAGAAAAGAG | | GGCAAA | HIYGEKYVQTPMING |
| | | | | AAAGGGAAACCTAAAGAAAATAGTTCTCTTGCCAAAATTCTGTAGAGGA | | GGCTAA | GKKPEGNDWKKCEK |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATACTTTGTCAAAACATGATAGAAACCAGTAATCTGGTACGAAAGACAAGTAAGACCTGAACTGACAAGAAGGAAGTCAGAAAGAAATACCGCTCACAAAGCCTGTGATCGATTCTCTTACCTACTGAACTTGTTCTCTTGGCCTCGTAACCGGCTAAAGGGAGAAGGAATGTTAATTGGAGATAGACATAAAGATAGGTGGAGTGAAGGTCCTGTTCTTGAAACTAGGAGGAATGTGGAAAGAGCAGAAGGCCGCGAGGCTTTAGACGGGTAACTCAGTCAGTTGCTAGTGGTCTTCGGATCCAACGGCTTCGGACATAGTGAGGAACCCTGGGTACGGAGAAGAAATGGAAAAGAGATAGGGCGGGCAAAGGCTAAGTTCATACACTGTCATGCAACCACTAAACCAGTGGGATCTGCGGGTGAATCACTTTCGAAAAGAAGTGAATGGACGTGCTGATGTCTGACTTTAAAGAAGTCTGAAATTAAAAAAACAGATATAAAGGCCCCTCACTATAAACTCCACAGCAACAGGTGGTCCGGCGAGGCCGGTTCTTGCCACCATTGCACCCCAGGCTCGTC (SEQ ID NO: 1048) | | GTTCATACACTGTCATGCAACCACTAAACCAGTGGGATCTGCGGGTGAATCACTTTCGAAAAGAAGTGAATGGACGTGCTGATGTCTGACTTTAAAGAAGTCTGAAATTAAAAAAACAGATATAAAGGCCCCTCACTATAAACTCCACAGCAACAGGTGGTCCGGCGAGGCCGGTTCTTGCCACCATTGCACCCCAGGCTCGTC (SEQ ID NO: 1294) | GIEVPKVTN (SEQ ID NO: 1416) |
| NeSL | NeSL-1_TV | — | *Trichomonas vaginalis* | GGGTGAGTAGTCTAGTGGTATGATTCCTGTTTTGGGTACAGGAGGTCCCGAGAAGCTTCCACTGCAATCGTACGTGTACTGTGGCAACACAGCTATAACAGACAGTTTCACGCCAACCGCGAAAACGATTTTGAAGCCTGAGGAACAAAATTTAGATATCGTTTTGAAAAATATTGCAGCGTTGAATCCAGAAAATTACTCCGACTTAATCAGGAGCCTATCGAAGATGGAGTTCAGATTAGATTACCCGAAAGAAATAGAGAATTACTGGATTTCGGAAAAATTATTTAGCCAATCCATCGCATCATTGCCCATCAGTTTGTTAGTCGCATCCATGTTCTCACCTGAAGACCGTGACTTGAGTACAGAACCGTTCCACTGTAACGCTGATGGCTGTAATTTCCATTGTGACAATTGTGAAAGAATGGTTGAACACATCAGAGAGCACCATAACACTGACCCCATGATCAATACATTTGAAACAACAGAAGACACATTTAGAAGAATAACGGCCATCAAAATAGACAAGACAGGCATCGAAGAACTTAACCCTCTAAAATACAGATGCTCGTATTGCGACGAGTTATTCAC | GGGTGAGTAGTCTAGTGGT (SEQ ID NO: 1172) | TAAGAAGAGATAAGACGAGTGAGAAGAACAGAAGCATAGTAGGATTGGCAGAGCTTAAGCGATGTCACTCGG | MIPVLGTGGPEKLPLQSYVYCGNTAITDSFTPTAKTILKPEEQNLDIVLKNIAALNPENYSDLIRSLSKMEFRLDYPKEIENYWISEKLFSQSIASLPISLLVASMFSPEDRDLSTEPFHCNADGCNFHCDNCERMVEHIREHHNTDPMINTFETTEDTFRRITAIKIDKTGIEELNPLKYRCSYCDE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGAAGCAGAAGATCATGCCATCCATATGATTTCACATCTCACAGAAAAA | | TACGAA | LFTEAEDHAIHMISHL |
| | | | | TTATCACCAGATATATCTTTCTTTTTCAACGACATTTTACGCCTTTACAAA | | ACGTGT | TEKLSPDISFFFNDILR |
| | | | | ACTATCGACAAACCAACAGTACAAAATTTATTTCCAGAAACACAAGTCG | | ACCAAA | LYKTIDKPTVQNLFPE |
| | | | | CAATTTTTGACACACTTGAAGAAACAAACAGATTCAGACTTATCGTAGG | | CACCGG | TQVAIFDTLEETNRFR |
| | | | | AAGAGAAGCCATAGAAACAATTGAAGAAGCATTCCCTCCAAGTCCACCA | | ATTCCGT | LIVGREAIETIEEAFPP |
| | | | | GGAACAGATCGGAAACCATCCATAATCATCACAGACACCTGTCAACTCA | | GCTAGG | SPPGTDRKPSIIITDTC |
| | | | | GGTTTGTACCATGCATGGATGAACCACCAAAAGGAGATCTCGGAATTCT | | AATCAC | QLRFVPCMDEPPKG |
| | | | | GACTCTACTTTTAAGAGATTTCAGCGCACACAATATCCCGATTAAATCAC | | AAGCCA | DLGILTLLLRDFSAHNI |
| | | | | TGAACAATAAGGAACTAATTGCTGATAAAGACATCGATTACAGCCCAGA | | AAATAA | PIKSLNNKELIADKDI |
| | | | | TTTTGTCGAAGGAGCTCTAGCCAACGCAGAAGAACATGATACAACGAAC | | AAGAGA | DYSPDFVEGALANAE |
| | | | | AGCCAGAACAACAATGGAAGATACATTAACTCAGCCGAAAAACTTACAG | | CACCAC | EHDTTNSQNNNGRY |
| | | | | AATTTTTAATACAATGTGAAGACTACTTAACGAACATCAAAACACTTGAA | | GAAAAT | INSAEKLTEFLIQCEDY |
| | | | | GACTTAGAACGTTTCTACACAACGATTAAAGACTACAGAGTCAACAAAG | | TACTCAC | LTNIKTLEDLERFYTTI |
| | | | | AGGTTATCGCCGAAGATACACCAATCTTTGTATATTTCCTAGTAGAAGAA | | CCTCCCT | KDYRVNKEVIAEDTPI |
| | | | | GGGAAATTACCAAAACCAGGTCTTAGATGCCCACTTGAATCATACGAAG | | CAAACA | FVYFLVEEGKLPKPGL |
| | | | | GACACGAAGACAAGGCATTCGAATCACTGAGAAAACTTTGCGACCACTT | | GATAAT | RCPLESYEGHEDKAF |
| | | | | CAAAGGAGAAATCGCGAAAACGAGCTTTGACCCAAAGGTTCACACCAT | | AATATTA | ESLRKLCDHFKGEIAK |
| | | | | AGACATCTGGGTTGAATTTTTGGCCCAAGCCTATGGCACAGGCACGTTT | | ACCTCCC | TSFDPKVHTIDIWVEF |
| | | | | GTCTACAAAGATGAAAACGGAAACATCGACCTTGATACGCACGTATTCA | | ATCCATC | LAQAYGTGTFVYKDE |
| | | | | AATGCCCTTATGCAGACTGCTCATACACGAACAACGACAGATCAAAACT | | AGTCCG | NGNIDLDTHVFKCPY |
| | | | | CATGGACCACATGAAAACGAAGAAACACGCCAAGAACGTATACATCGA | | TATGGT | ADCSYTNNDRSKLM |
| | | | | GAGATACGGCTTCTTTTGGGGTATTGTCATAGAAGGAGTCAACCGACCA | | CTGATA | DHMKTKKHAKNVYI |
| | | | | AAAGGAATCGTCTACCCGACACTCAAAGACATCAAAGAACACGCTTGTC | | ACAGAC | ERYGFFWGIVIEGVN |
| | | | | GCAAATGTCCAGAAGCAGGATGCAACACATATGTAACAGAATTGAGCG | | TAGCAC | RPKGIVYPTLKDIKEH |
| | | | | ACATCAAAGAACATCTAAAGAAGAAACATAAGTCTACAACAGCAGGAG | | CACATCC | ACRKCPEAGCNTYVT |
| | | | | TAGACGGAGAAATCGCGCACACTGATGCTACATACTGCTGGATTACCAA | | ATGATA | ELSDIKEHLKKKHKST |
| | | | | AGAAGAACTCGACGCATTACATGCCGAGAGAGCAAGAGAAAGAGCAG | | CACTCAT | TAGVDGEIAHTDATY |
| | | | | AGCAAGTAGACAACACTCCAGTACAACAGATAATTAATGCTGACAACAA | | TGGAGT | CWITKEELDALHAER |
| | | | | TGAAGAGAACAACGAGAACCAAGAAGACAACGGAAACAACGAAGAAG | | GAAAAC | ARERAEQVDNTPVQ |
| | | | | CAGATGCCCTCGACCCGCCAAATAACACAACAGAGACAGAAGATGAAG | | CACCAA | QIINADNNEENNEN |
| | | | | CGGTTCATGCCGTCATCATCAATCCACCAGCAACAGAAGAGGAAGAGGT | | CAACAA | QEDNGNNEEADALD |
| | | | | AGCCATCATCGCCGAGGCAAGAAGAAACATTCCAGAACTCCAACAAGC | | ATCCACC | PPNNTTETEDEAVHA |
| | | | | AGAAGAGAGAGGCTGCGTTACACCGAAAATGACATCACTCGTCCGATTA | | TAGACC | VIINPPATEEEEVAIIA |
| | | | | AAACTATTGAAAGGAGGAGGAGAACTTTTCAACAAGAAACTCACTCCAT | | AAATCCT | EARRNIPELQQAEER |
| | | | | TAGCCACAAGATACGCAGCTACAGGAAATACAGAAGCAGACAAAATCA | | GCCCCA | GCVTPKMTSLVRLKL |
| | | | | AGGTAGATTACTTGACACTAAAATGCAATGCCGCCTTGAGAGAAATGAT | | CCTCCAC | LKGGGELFNKKLTPL |
| | | | | CTACACCAATAACCACAGCGAATCAAAGTTTATGACAGCAGAAAATGGA | | CCAAGT | ATRYAATGNTEADKI |
| | | | | GAAGACACAGCACCACCGCCAAGGATATCGGAAGACACAAGAGATCGC | | AGCTCG | KVDYLTLKCNAALRE |
| | | | | ATTCAAAAAGCAGCCAATGAAATAAAAGGAACTCTCATCAAAGTAGTCA | | CTTCGCT | MIYTNNHSESKFMT |
| | | | | AACACATAAGTCACGCGAGATGCCTCAAAGACAGCACGAGAGACGATG | | CGCTCA | AENGEDTAPPPRISE |
| | | | | AACACAATAAATTCGTCGAAATGATTGCAAAAATCAAAAACGATCTCAG | | CCTAAA | DTRDRIQKAANEIKG |
| | | | | AGATAACAAATTCGAACAATATAACATTGAAGAAATATTTCAAGGACCG | | ACTTTGC | TLIKVVKHISHARCLK |
| | | | | ATCTCCGACCAGAGTATTCTCAACATCGTCAACACGGAGGACAACAACG | | TCGCTC | DSTRDDEHNKFVEMI |
| | | | | AATTCATCAAGAAAATGGATTACATTAACCGAATTCTCGGAACACCACA | | GCTTCG | AKIKNDLRDNKFEQY |
| | | | | GGATGCATCACCATATGCAAGGAAGAAGTTACAAGCATGTTTCGCCGAT | | CTCGCTC | NIEEIFQGPISDQSILN |
| | | | | AACCCAACAAAGACTCTCAGAAACATAATCTTAGCCGACAAAGTTCCAC | | GTCTTAA | IVNTEDNNEFIKKMD |
| | | | | AACAATCATTGAAGCCAAGCGAATACCTTGATTACTACGGACCTCAATG | | CCCTTTC | YINRILGTPQDASPYA |
| | | | | GGCAAACGAAGCTGAAGGCTACGAAAACTTCCTGCATCATGACTACGCG | | CGAATA | RKKLQACFADNPTKT |
| | | | | TTACCGGAGAGATATGGCCAAGTTTTCGCAAACGACTTCCTCGACTTCAT | | AACACTT | LRNIILADKVPQQSLK |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GACAAACGAATCGAAGATCATCGAAGTAATCCGCAACAAGAATCATTTA | | ACAATTC | PSEYLDYYGPQWAN |
| | | | | TCGGCACACGGCCTCGATGGAATTCCGAACTCAGTTTACATGCTATTCCC | | CCGGCT | EAEGYENFLHHDYAL |
| | | | | AGTCAGCGCCGCAAAATTCCTCAGTATATTATTCAGATCAATCATCATAT | | CGCCCC | PERYGQVFANDFLDF |
| | | | | CAGGTCACATCCCAGACTGCTGGAAGCTCTCCAAGACAGTGATGCTTTT | | ATTTTTT | MTNESKIIEVIRNKNH |
| | | | | TAAGAAGGACGACCCATCGTTAGCAAAGAACTGGAGACCAATCGGCAT | | (SEQ ID | LSAHGLDGIPNSVYM |
| | | | | CACGTCATGCACTTACAGAATCTTCATGACTTTAGTCAACAAAGCGTTAC | | NO: | LFPVSAAKFLSILFRSII |
| | | | | AGATGATCCCAATGTTCCACGCAATGCAAAAAGGTTTCGTTCGCGGAGC | | 1295) | ISGHIPDCWKLSKTV |
| | | | | AACACTGAGTGAGCACATTGCAGTCGCGAACGAAGTCCTTTGCCAATCA | | | MLFKKDDPSLAKNW |
| | | | | ACCAGAACACAGTCTGAAATGTTCCAAACAGCAATCGATTTCACGAACG | | | RPIGITSCTYRIFMTLV |
| | | | | CTTTCGGCACAGTTCCTCATCAATTGATCTTTGATTCTCTCGAAGCGAAG | | | NKALQMIPMFHAM |
| | | | | AAAGTTCCCGATTCGATCATCAATCTGCTCAAGGACCTCTACAAAGGAG | | | QKGFVRGATLSEHIA |
| | | | | CAAGAACGGCTATCTATACAAGACATGCACACTCCGAGATAGTTCCGGT | | | VANEVLCQSTRTQSE |
| | | | | TCGCAGAGGTGTCATCCAAGGCTGTCCACTCAGTCCAATCCTCTTCAACT | | | MFQTAIDFTNAFGTV |
| | | | | GCTGCTTAGATCCTTTATTATATGCAGTCCAGAGGAGACACTTTGAGGA | | | PHQLIFDSLEAKKVPD |
| | | | | CGGTTACAGATTCCAAGACAAAGCAGGACAGTATTCAATTGCCATTCAA | | | SIINLLKDLYKGARTAI |
| | | | | GCTTACGCTGACGACGTTCTAGTCATCTCTCCAACACATGAAGGAATGC | | | YTRHAHSEIVPVRRG |
| | | | | AAAGAATCTTAAACACAGTAGATGAATTCCAGAAAATTGCGAAACTCAA | | | VIQGCPLSPILFNCCL |
| | | | | AGTTGCACCACAGAAATGCGTCACACTTGCCAAAACATCCACTGCAATC | | | DPLLYAVQRRHFEDG |
| | | | | CAACCTTTCCGCATTGGTCCAGACGAAATCCCAATCAAGACGAGCATGG | | | YRFQDKAGQYSIAIQ |
| | | | | ACAACATCACATATCTTGGAATACCAATCTCTGGAACAAAGACATCAAG | | | AYADDVLVISPTHEG |
| | | | | ATTTGCAGCTGCAACTGGCATTCTGGAAAAGGTCAAAGCACAGATCAGA | | | MQRILNTVDEFQKIA |
| | | | | GTCGTCTTCGCGTCACATCTCGCTCTCTCTCAGAAGATTATCGCTCTCAG | | | KLKVAPQKCVTLAKT |
| | | | | AGTCTTCATCTTGCCACAACTTGACTTTTACATGTTCCACAACGTATTCAG | | | STAIQPFRIGPDEIPIK |
| | | | | AGTCAATGACTTGAAAGCGACAGATCAGATGATCCGAGGCCTGATCGA | | | TSMDNITYLGIPISGT |
| | | | | CAAAGAAGCGCCGACGTCAAACATTCCGGTTTCATTTTTCTACATGCCGA | | | KTSRFAAATGILEKVK |
| | | | | AGAACAAAGGCGGCTTTGGACTCGTTAAATTGGAACTTCGCCAGCCTCA | | | AQIRVVFASHLALSQ |
| | | | | GCTCGTTCTCACTAAATTTGCGAGGTTATGGTTAAGTCAACAAGCAGAA | | | KIIALRVFILPQLDFYM |
| | | | | ACCAAAGCCTTCTTTCACACAATGGCTCAAGAAGAGAAGTCATTCCGCA | | | FHNVFRVNDLKATD |
| | | | | AGGTCGTCGAAGACCAAGAAAATGGTTTCTTAGGCATCAAGATGGAAA | | | QMIRGLIDKEAPTSNI |
| | | | | ACGGCAAAATTGTCCAGAAGAACGAAAGATCCAAACGCACAAATTGTTT | | | PVSFFYMPKNKGGF |
| | | | | CATCACACAGGCGGCTAAAGCAGCAGACAAACTGGAAGTCAGATTCAA | | | GLVKLELRQPQLVLTK |
| | | | | AGAATGGGACAAAGGAGGCATACAAGTCAGAGGTGTAGGAGAAAATG | | | FARLWLSQQAETKAF |
| | | | | CAACAGACTGGTACCGCTCGAAACACATCGGCCAAATCTCACCCTTAATC | | | FHTMAQEEKSFRKVV |
| | | | | GGTCGCGTCATCCAACAGAGGCAGTACGAGGAGTTCAAGAAAGACGAA | | | EDQENGFLGIKMEN |
| | | | | ACACACTCACACACTTTCTGCGAACCAGCAGCGCTAGCGGAGTCACACG | | | GKIVQKNERSKRTNC |
| | | | | ACATCATGAAGAGACCACAAGCTGTTCCAAACAACCTCTACTCAGCGGC | | | FITQAAKAADKLEVR |
| | | | | TATTGCTCTCCGTACAAACACAGCTCCAACCCCAGCAAACATGCACTTCC | | | FKEWDKGGIQVRGV |
| | | | | ACAACCCAGAAGTTTTGGCTAATTGTCCATTGTGCGGATGCCAATCCTGC | | | GENATDWYRSKHIG |
| | | | | ACTCTCTTCCACACATTGAACATGTGCAGAAACCGTTTCAGTCTATACAA | | | QISPLIGRVIQQRQYE |
| | | | | ATGGCGCCACAATATCATATGCGATGACATTTACCAATTCATTCACGATC | | | EFKKDETHSHTFCEP |
| | | | | ACTATCCAGGAGTAACCATCAAATGCTCGGCGAGAATTACAAGTGACGG | | | AALAESHDIMKRPQA |
| | | | | CTACCAAACAACAGGCCCAGAGCTCGACGACACAGTTAAAGATCTCCTC | | | VPNNLYSAAIALRTN |
| | | | | CCAGACCTTGTTGTCTACGATGAAGCGAACAAGATGATCAAGATCATTG | | | TAPTPANMHFHNPE |
| | | | | AAGTCACATGCCCTTACGGCACGGACAACAATGTTGGCAACTCTCTTGA | | | VLANCPLCGCQSCTL |
| | | | | CGCGGCATACGACAAAAAGGTTAACAAGTATAAGAGCCTTGCTGAACA | | | FHTLNMCRNRFSLYK |
| | | | | AACAGAGAGATTATTTAACTGGACCACGACGCTCTCAATTATCGTAGTCT | | | WRHNIICDDIYQFIH |
| | | | | CATCACTAGGAGTCATCCCTCTCCGTACAAAACTCGACGCATTGAGAATC | | | DHYPGVTIKCSARITS |
| | | | | TCACCTGCAGATCACATACAGCTACTCAAGAGACTTTCGATGCACGCGA | | | DGYQTTGPELDDTVK |
| | | | | TAGCTGCGAGTGCTTGCATTGTTTTTGAAAAAGTGCCAGAATTCTTCGGT | | | DLLPDLVVYDEANK |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATGCGCTGCCGTCCCCTCCCAGGACGAGTCACAGCTCCCAATGCAGCGA | | | MIKIIEVTCPYGTDNN |
| | | | | TCCCACCAAACAACAATGAAAACAATAACGACACAGATCATGGTCAGGA | | | VGNSLDAAYDKKVN |
| | | | | GAACCAACAGGCAACCTCTGAAGAGCAACCAACCAACAATGGAAATGC | | | KYKSLAEQTERLFNW |
| | | | | TCAAGAAGACAATGGCCAAGGCGAACAAATAAATAATTCAACCGAACA | | | TTTLSIIVVSSLGVIPLR |
| | | | | AACTATCTCTGTTGATCAAATCATCGAAGAAGATGCTGAGAACAACGCG | | | TKLDALRISPADHIQL |
| | | | | ATAGAACAAGCCTTAGACCAACCCGATGAGGACGAATTCCTTAACTAAG | | | LKRLSMHAIAASACIV |
| | | | | AAGAGATAAGACGAGTGAGAAGAACAGAAGCATAGTAGGATTGGCAG | | | FEKVPEFFGMRCRPL |
| | | | | AGCTTAAGCGATGTCACTCGGTACGAAACGTGTACCAAACACCGGATTC | | | PGRVTAPNAAIPPNN |
| | | | | CGTGCTAGGAATCACAAGCCAAAATAAAAGAGACACCACGAAAATTACT | | | NENNNDTDHGQEN |
| | | | | CACCCTCCCTCAAACAGATAATAATATTAACCTCCCATCCATCAGTCCGT | | | QQATSEEQPTNNGN |
| | | | | ATGGTCTGATAACAGACTAGCACCACATCCATGATACACTCATTGGAGT | | | AQEDNGQGEQINNS |
| | | | | GAAAACCACCAACAACAAATCCACCTAGACCAAATCCTGCCCCACCTCCA | | | TEQTISVDQIIEEDAE |
| | | | | CCCAAGTAGCTCGCTTCGCTCGCTCACCTAAAACTTTGCTCGCTCGCTTC | | | NNAIEQALDQPDEDE |
| | | | | GCTCGCTCGTCTTAACCCTTTCCGAATAAACACTTACAATTCCCGGCTCG | | | FLN (SEQ ID NO: |
| | | | | CCCCATTTTTT (SEQ ID NO: 1049) | | | 1417) |
| NeSL | NeSL- | — | *Caenor-* | GACTCGCCTTGGGGAAGGTWTTTCAGGGGKSAATTGCCGMAGGCAAG | GACTCGCC | TAAACC | MRYHXSNXPAXRTS |
| | 2_CBre | | *habditis* | GCAGCCCCCSMMTAGCTTACAAAGTAAGTACMCATTTTCATTTCTTGTG | TTGGGGAA | GGCTCC | DNXWRSIXKDVRRP |
| | | | *brenneri* | AATTCTTTAAACATATTTTTCTTGTTTTTTGATTTCTTTTTTCTCTACCTTCC | GGTWTTTC | TCTGGG | DPSTIEEKSRYNRSIGI |
| | | | | CCCAATTCTTCCCCTCATCTTGTGTATACATCCCCCTCCTCCAACCAATCA | AGGGGKSA | AGGAGG | PDSLKXRSSAVRSXSS |
| | | | | ATACATTGACCTCTCTCTTCTGTCAAAAAATCAATACTAGTATATTGTCCC | ATTGCCG | TATGTCA | XPPSGPQDVRLXNSP |
| | | | | TTGTATAGTATTATTTGACGTCGTCTTTGTATTAGGAGTAGGTAACAAW | MAGGCAA | GAGGAC | SLDDRRRLVDCETTL |
| | | | | CTGTGTATGGCTTCAAAAAGCATGCACAAACWCCTGTCAAAAAGTAWT | GGCAGCCC | ATTCTCC | GSYREWTDKPMMG |
| | | | | TCCCATCMTGTGAATAGCTCAACGACWKGAAGMCCAATGATATGAGA | CCSMMTA | GTGGGC | KMTYAAVTKRAPPRP |
| | | | | TATCATMGCTCCAACMACCCAGCASCCCGCACCTCAGACAATCAMTGG | GCTTACAA | GGATGG | QTGGARLSTNLLADE |
| | | | | AGATCAATCCMAAAGGACGTCCGTCGCCCAGATCCGTCAACTATCGAG | AGTAAGTA | GAGGAG | MEIKYRDTNDIRLVID |
| | | | | GAGAAAAGCAGGTATAACAGGTCCATAGGTATTCCAGATTCGCTCAAAG | CMCATTTT | TAGGGT | LPNPHLIKCPLCKSCIS |
| | | | | AWCGGAGCAGTGCAGTCCGCAGCAKGAGCAGCCMACCTCCGTCAGGT | CATTTCTT | AACGAC | ARGRGANALKYMKR |
| | | | | CCACAGGACGTCCGTCTCWCCAATTCGCCATCTCTCGATGATAGGAGAA | GTGAATTC | CCGTCAT | HIADAHHLNADFVYK |
| | | | | GGTTAGTWGATTGTGAAACAACACTAGGGTCATACCGCGAATGGACSG | TTTAAACA | TCTGGA | CSRCQEHEPENVCG |
| | | | | ATAAACCAATGATGGGAAAGATGACGTATGCGGCAGTGACAAAAAGAG | TATTTTTCT | TGCCTA | AKWIVNHLKRVHGY |
| | | | | CGCCCCCAAGACCGCAAACGGGAGGAGCCCGGTTGAGCACCAATCTCC | TGTTTTTT | AACCAC | TLEDAVSTAKPSTRQ |
| | | | | TAGCAGATGAAATGGAGATAAAGTATCGAGACACCAATGACATCCGCCT | GATTTCTT | CACAAT | QIANAFNDSAPFIDA |
| | | | | TGTCATAGACCTTCCCAATCCCCACCTCATCAAGTGTCCGCTCTGTAAAA | TTTTCTCTA | CTGTCA | RKTSDVPEKKSREAG |
| | | | | GCTGCATAAGTGCGCGGGGAAGAGGTGCTAATGCGCTGAAGTACATGA | CCTTCCCC | AGGCAA | LEKFLAPTKSEDTREK |
| | | | | AAAGGCACATAGCCGACGCCCACCACCTCAACGCCGACTTCGTCTACAA | CAATTCTT | AGTGCC | TPPSTRKSSESSEASI |
| | | | | ATGTAGCAGGTGTCAAGAGCATGAACCAGAAAATGTATGCGGCGCGAA | CCCCTCAT | CCAAAA | QSTIQETLSESSDTLT |
| | | | | GTGGATTGTGAATCATCTCAAAAGAGTACATGGCTATACTCTAGAAGAT | CTTGTGTA | GCACAC | VQEIINISSEDEMDEE |
| | | | | GCCGTATCCACAGCAAAACCCTCTACAAGGCAGCAGATTGCAAACGCCT | TACATCCC | GCGTGG | PPKRRVNVWALIHE |
| | | | | TCAACGACTCTGCTCCATTCATAGACGCCCGGAAAACATCCGATGTGCC | CCTCCTCC | ATCGGT | NGKDAWIDSDLMVI |
| | | | | AGAGAAGAAGAGCAGAGAGGCAGGACTTGAGAAGTTCCTGGCCCCTAC | AACCAATC | TTGGAT | FLESRARGYESCSIIDP |
| | | | | AAAGTCCGAGGACACAAGGGAAAAAACCCCGCCCTCCACCAGAAAGTC | AATACATT | GCCGAC | LNFICTDMSYLTTIVR |
| | | | | CTCTGAAAGTTCAGAGGCATCAATCCAATCGACCATCCAAGAGACTCTTT | GACCTCTC | TGAGCC | RRMEEGYKKIIFPLCA |
| | | | | CGGAGTCGTCAGACACATTGACCGTCCAAGAAATAATCAATATCAGCAG | TCTTCTGT | AGAGGG | NDHWTLVTITGSTAT |
| | | | | TGAAGATGAAATGGACGAGGAGCCACCGAAACGGCGTGTCAATGTCTG | CAAAAAAT | CAAAGT | FYDPMGNEPTETVKK |
| | | | | GGCCTTGATCCATGAGAATGGCAAGGACGCCTGGATAGACTCAGACTT | CAATACTA | CGAAGG | MIDELDLEMQLAPS |
| | | | | GATGGTCATATTCCTGGAATCAAGAGCAAGAGGATATGAATCATGCAGC | GTATATTG | CCGGTA | NSPRQRDSWNCGVF |
| | | | | ATCATAGACCCTCTGAACTTCATTTGCACTGACATGTCCTATCTGACCAC | TCCCTTGT | GGCTCC | VMKMAEAYIKDTQ |
| | | | | AATAGTCAGAAGGCGCATGGAAGAAGGCTACAAGAAAATCATATTTCC | ATAGTATT | CGGCGG | WDLTDVDTDVKTFR |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATTATGTGCAAATGACCACTGGACACTGGTCACGATAACAGGTAGCACG | ATTTGACG | GTTGTC | RSLLTELKAKFNIFAE |
| | | | | GCCACCTTTTACGATCCAATGGGAAATGAGCCAACTGAGACTGTCAAGA | TCGTCTTT | CGTCAT | DIQTYRPPSRKALTRN |
| | | | | AGATGATCGATGAGCTCGACCTTGAAATGCAATTAGCCCCGTCAAACTC | GTATTAGG | AGTCAG | SQSPVVVCHKCSRPA |
| | | | | TCCTAGACAGAGAGACTCGTGGAACTGCGGCGTTTTCGTCATGAAAATG | AGTAGGTA | TGGTGC | TPIQDVSRMEVEEAP |
| | | | | GCGGAAGCGTACATCAAGGATACGCAATGGGATCTCACGGACGTAGAC | ACAAWCT | GCCTAC | VLVPTPEEPPQEWTF |
| | | | | ACGGACGTCAAAACGTTCAGAAGGAGCCTCCTAACAGAGCTCAAAGCA | GTGTATGG | ACCCAA | VGKNRKRGVTSRTP |
| | | | | AAGTTCAACATCTTTGCCGAGGATATCCAGACCTACCGGCCACCCTCAA | CTTCAAAA | CTGCTAT | NTSPEAKRPAFPPVP |
| | | | | GGAAAGCCTTAACGAGGAACAGCCAATCGCCTGTCGTTGTTTGTCACAA | AGCATGCA | GACACA | LKPSANRWHFPEEET |
| | | | | GTGCTCTCGGCCAGCCACACCGATCCAGGATGTGAGCAGAATGGAAGT | CAAACWC | CAAGGA | EKMEVSSADEVKNST |
| | | | | GGAAGAAGCGCCAGTGCTGGTACCGACTCCTGAAGAGCCTCCACAGGA | CTGTCAAA | CAACCC | PPKPPKIPNLLAMKIA |
| | | | | ATGGACCTTCGTCGGAAAAAACAGAAAGCGTGGTGTGACAAGCCGAAC | AAGTAWT | AAAATA | SPVPLKRGNPSKKHG |
| | | | | CCCGAACACGTCGCCGGAAGCCAAGCGACCGGCTTTCCCACCAGTACCC | TCCCATCM | AATAAG | KGHMMNTARKGPT |
| | | | | CTCAAACCATCAGCCAACAGATGGCACTTTCCAGAAGAGGAAACTGAAA | TGTGAATA | CCAAGG | KKEMPKGEPANLIVKI |
| | | | | AGATGGAGGTCTCAAGTGCCGACGAGGTGAAGAACTCTACCCCTCCAA | GCTCAACG | CGGCGT | RSWFDEQLKMYKDE |
| | | | | AACCACCCAAGATACCTAATCTTCTCGCGATGAAAATCGCCAGTCCCGTA | ACWKGAA | TAGCTTC | GSNLQRLTWLSDSLT |
| | | | | CCTCTGAAGAGAGGAAACCCGTCAAAGAAGCACGGTAAAGGACACATG | GMCCAAT | GAGCTA | AAIGKAFNGNKYIVD |
| | | | | ATGAATACAGCGAGAAAGGGTCCGACAAAGAAAGAGATGCCCAAAGG | GAT (SEQ | ACAAGC | QIIKRNPPPLVEKGA |
| | | | | GGAACCAGCGAACCTTATAGTTAAAATCAGAAGCTGGTTTGATGAGCAA | ID NO: | TCCCCG | MSTQTSRKRDEFKPR |
| | | | | CTGAAGATGTACAAGGATGAAGGGTCCAATCTACAAAGACTCACATGGT | 1173) | AGAGGA | ERMAQEPNEPLRIQY |
| | | | | TATCGGACTCTCTGACCGCCGCCATCGGAAAAGCATTCAATGGCAACAA | | TGGTTG | AKNRQKTFFKIIGKQS |
| | | | | ATACATAGTGGACCAAATCATCAAGAGAAACCCACCACCACTTGTTGAA | | CCACAG | EQCTINIETVEQHFRK |
| | | | | AAGGGCGCAATGTCAACACAGACAAGCCGAAAGAGAGACGAGTTCAA | | GGCACC | TLKAPVVSENAIKTVC |
| | | | | GCCAAGGGAGAGAATGGCCCAAGAGCCCAATGAGCCGCTTCGTATTCA | | ATCCTG | GSIKKVLMPKTIEDPI |
| | | | | ATATGCCAAGAATAGGCAAAAAACGTTCTTCAAGATCATTGGGAAACAG | | GGGAAC | SSVEVKSILTKVKDTS |
| | | | | TCTGAACAGTGCACCATCAACATTGAGACTGTCGAACAGCACTTCCGAA | | GACCCG | PGTDGVKYSNLRWF |
| | | | | AAACACTCAAGGCTCCTGTAGTCTCAGAGAATGCAATTAAAACGGTCTG | | ATCTTTC | DPEGERLAKLFEECRK |
| | | | | CGGAAGCATCAAGAAAGTATTGATGCCAAAGACCATAGAAGACCCAAT | | GGATGC | HREIPSHWKEAETILL |
| | | | | CTCCTCCGTAGAAGTCAAATCCATCTTGACGAAAGTGAAAGACACGTCA | | CCAACC | PKDCSDEEKKKPEN |
| | | | | CCAGGAACAGATGGTGTCAAGTATAGCAATCTACGCTGGTTCGACCCAG | | ACCGCC | WRPIALMATIYKLYS |
| | | | | AAGGGGAACGCCTCGCCAAACTGTTCGAAGAATGTCGCAAGCATAGAG | | AATCTGT | AVWSRRISGVQGVIS |
| | | | | AAATACCCAGCCATTGGAAGGAGGCGGAGACGATCTTATTGCCAAAGG | | CAGGCA | PCQRGFQSLDGCNES |
| | | | | ACTGTTCAGATGAAGAGAAGAAAAAGCCGGAAAATTGGCGTCCCATCG | | ACGTGC | IGILRMCIDTASVLNR |
| | | | | CCCTCATGGCAACAATCTATAAGTTGTATTCAGCAGTGTGGAGCAGAAG | | CCCAAA | NLSCSWLDLTNAFGS |
| | | | | AATCTCCGGTGTTCAAGGGGTAATTAGCCCGTGCCAAAGAGGCTTTCAG | | AGCACA | VPHELIRRSLESFGYP |
| | | | | TCCCTCGACGGATGCAATGAGTCGATCGGAATATTGCGCATGTGTATTG | | CGTGCG | QSVIQIVTDMYKGAT |
| | | | | ACACCGCTTCCGTACTCAATAGGAATCTCTCTTGCTCATGGCTTGATCTC | | GAGCGG | MKVKTADQKTQSIKI |
| | | | | ACCAACGCCTTCGGGAGCGTTCCTCACGAGCTGATAAGGAGATCCCTAG | | TTGGAT | EAGVKQGDPISPTLF |
| | | | | AATCATTCGGATATCCACAATCAGTTATCCAAATCGTGACTGACATGTAC | | GCCGAC | NICLEGIIRMHQMRE |
| | | | | AAGGGAGCAACGATGAAAGTCAAAACGGCAGATCAAAAGACGCAAAG | | TGAGCC | KGYDCVGHKVRCLAF |
| | | | | CATCAAAATAGAAGCGGGGGTGAAACAAGGAGACCCCATTTCTCCAAC | | AGAGGG | ADDLAILTNNKDEM |
| | | | | CCTATTCAATATTTGCCTTGAAGGCATCATCAGGATGCATCAGATGAGA | | CAAAGT | QEVIDKLDADCRSVS |
| | | | | GAGAAAGGGTACGATTGTGTCGGGCATAAAGTTCGCTGCCTAGCGTTC | | CGTAGG | LIFKPRKCASLTIVRGA |
| | | | | GCCGACGACCTTGCGATTCTAACGAACAACAAAGATGAAATGCAGGAA | | CCGGTA | VDKYAKIRINGDAIRT |
| | | | | GTTATCGACAAGTTGGATGCAGACTGTAGAAGCGTGTCGTTGATCTTTA | | GGCTCC | MADRDTYRYLGVKT |
| | | | | AACCTAGGAAGTGTGCATCTTTGACTATCGTGAGAGGTGCAGTTGATAA | | CGGCGG | GVGGRASETEALIQV |
| | | | | GTATGCAAAGATCAGAATAAATGGAGACGCGATCAGAACAATGGCGGA | | GTTCTCC | VKELQKVHETDLAPH |
| | | | | TAGAGACACCTATAGATATCTGGGTGTAAAGACCGGAGTTGGTGGAAG | | GTCGTA | QKLDILKTFLLPRLQH |
| | | | | AGCATCGGAAACGGAAGCTTTAATTCAGGTGGTCAAGGAGCTCCAAAA | | GTCAGT | LYRNATPKLSELREFE |
| | | | | GGTCCACGAAACCGACCTGGCTCCACATCAAAAACTTGACATCCTGAAG | | GGTGTG | NVVMKSVKRYHNIPI |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACGTTCTTACTGCCAAGACTGCAGCATCTCTACAGAAATGCCACTCCTAA | | CCTACAC | KGSPVEYVQIPVKKG |
| | | | | ACTGTCAGAGTTGAGAGAGTTCGAGAACGTTGTTATGAAATCAGTGAA | | CTAACT | GLGVLSPRLTCLITFLT |
| | | | | ACGGTATCATAACATACCAATAAAGGGCTCGCCTGTGGAATATGTCCAA | | GCTATG | STLCKLWSDDPFISSI |
| | | | | ATCCCTGTCAAGAAGGGTGGACTAGGAGTTCTATCTCCTCGACTCACAT | | ACAAGC | HKDALSRITVKAMGL |
| | | | | GCCTGATCACTTTCCTTACCTCGACCCTCTGCAAGCTATGGTCCGATGAT | | GTATAG | TTQSATIKETCEYLNT |
| | | | | CCATTCATATCTTCTATCCACAAAGACGCACTAAGCAGAATCACAGTGAA | | GAGGCC | RKAVTKGGYSLFCRM |
| | | | | AGCGATGGGACTCACCACTCAAAGTGCCACAATAAAAGAGACATGTGA | | CGGAAA | NESLRTLSVIQGAPLK |
| | | | | GTACTTAAACACAAGGAAAGCTGTCACGAAAGGAGGATATAGTCTATTC | | AACAAG | SMEFIPVNNEIGIAV |
| | | | | TGCCGCATGAATGAATCTCTCCGCACGCTGTCTGTCATCCAAGGTGCTCC | | CCAAGG | QATKDSEIKVFTKADS |
| | | | | ACTGAAATCAATGGAATTCATCCCGGTGAACAATGAAATCGGTATAGCG | | CGGCGT | LKLMSKLKDLVRSAM |
| | | | | GTACAAGCCACGAAGGATTCCGAGATCAAAGTCTTCACAAAGGCTGACA | | TAGCTG | LKRFLEEKSVKSRVTQ |
| | | | | GCCTGAAGCTAATGAGTAAGCTAAAAGATCTGGTCAGATCTGCTATGCT | | AGAGCT | VLQHHPQSNRFVRD |
| | | | | CAAACGGTTCCTCGAAGAGAAGAGTGTTAAAAGCAGAGTCACCCAAGT | | AACAAG | GRNCSIAAQRFVHPA |
| | | | | ACTCCAACACCACCCACAATCCAATAGATTCGTCAGGGACGGCCGAAAC | | CTTCTCG | RLNLLSCNANTYDVN |
| | | | | TGCAGCATAGCAGCWCAGAGATTCGTGCACCCKGCCCGTCTGAACCTCC | | TGGATG | HPKGCRRCQADFES |
| | | | | TCTCCTGCAACGCCAACACATACGATGTTAACCATCCAAAAGGCTGCAG | | GGTGCC | QQHILQNCHYSLAG |
| | | | | AAGGTGCCAGGCTGACTTCGAGTCTCAGCAGCACATCCTGCAGAACTGT | | AGAGGG | GITQRHDRVMNRIL |
| | | | | CACTACAGTTTGGCAGGGGGAATAACCCAGAGACATGACAGAGTCATG | | CACCATC | QEIGNGRKAHYKIMV |
| | | | | AACAGGATTCTGCAGGAAATTGGAAACGGGAGAAAAGCTCACTACAAG | | CTGGTG | DMETGATRERPDIIM |
| | | | | ATAATGGTGGATATGGAAACCGGCGCCACAAGAGAAAGACCGGATATC | | GGTGGA | EERDGPEVLLADVTV |
| | | | | ATCATGGAGGAAAGGGACGGTCCAGAAGTGTTACTAGCCGACGTGACA | | TGGGGG | PYENGVQAVERAWD |
| | | | | GTGCCCTACGAGAATGGGGTTCAAGCGGTTGAGAGGGCGTGGGATAA | | GAGCTT | KKIEKYKHFLDYYRKI |
| | | | | GAAGATAGAAAAATACAAGCACTTCCTAGATTACTACCGCAAAATCGGA | | GGGAAC | GKKATILPLVVGSLGT |
| | | | | AAGAAGGCTACGATTCTTCCCCTAGTAGTCGGTAGCCTAGGAACCTACT | | GTCCCG | YWPDTSHSLKMLGLS |
| | | | | GGCCCGACACAAGCCACTCACTGAAGATGCTTGGCCTTTCCGACGGTCA | | ATCCTTC | DGQIRNVIPEICQIAL |
| | | | | AATAAGGAATGTTATACCTGAAATCTGCCAAATTGCACTGGAATCCTCCA | | GGATGC | ESSKNIYWKHILGDSY |
| | | | | AAAATATCTATTGGAAGCACATTCTCGGTGATAGCTACAAAACGGTGGA | | CCAGAC | KTVEGLFCQRNNKEV |
| | | | | GGGACTATTTTGTCAGAGGAATAACAAAGAAGTCCGATTCGAAGGAAA | | CACCGC | RFEGKGEKHHVSQRF |
| | | | | AGGTGAAAAACACCACGTGTCACAAAGATTCCAACCTCTGAAATGTGAA | | AATCTGT | QPLKCEKVRTMKSTK |
| | | | | AAGGTGCGTACAATGAAAAGCACAAAAGAAGAGGGTAGAAGTAGATC | | CAAGGC | EEGRSRSNAKKGPN |
| | | | | GAATGCCAAGAAAGGTCCGAACTGGCGAAGATCAAAAAGCGAATCGGA | | ACCGTG | WRRSKSESDGRSVSK |
| | | | | CGGAAGGAGTGTGAGTAAAGGCAGATACTGGCGAGATCCGTCGAACAA | | CTCCAA | GRYWRDPSNKPPHS |
| | | | | GCCGCCACACTCGAAGATGACCCAGTCGGCTTTAGCTAAGCGCTAAACC | | AAGCAC | KMTQSALAKR (SEQ |
| | | | | GGCTCCTCTGGGAGGAGGTATGTCAGAGGACATTCTCCGTGGGCGGAT | | ACGCGC | ID NO: 1418) |
| | | | | GGGAGGAGTAGGGTAACGACCCGTCATTCTGGATGCCTAAACCACCAC | | GGGTTG | |
| | | | | AATCTGTCAAGGCAAAGTGCCCCAAAAGCACACGCGTGGATCGGTTTG | | GTTTGG | |
| | | | | GATGCCGACTGAGCCAGAGGGCAAAGTCGAAGGCCGGTAGGCTCCCG | | ATGCCG | |
| | | | | GCGGGTTGTCCGTCATAGTCAGTGGTGCGCCTACACCCAACTGCTATGA | | ACTGAG | |
| | | | | CACACAAGGACAACCCAAAATAAATAAGCCAAGGCGGCGTTAGCTTCG | | CCAGAG | |
| | | | | AGCTAACAAGCTCCCCGAGAGGATGGTTGCCACAGGGCACCATCCTGG | | GGCAAA | |
| | | | | GGAACGACCCGATCTTTCGGATGCCCAACCACCGCCAATCTGTCAGGCA | | GTCGTA | |
| | | | | ACGTGCCCCAAAAGCACACGTGCGGAGCGGTTGGATGCCGACTGAGCC | | GGCCGG | |
| | | | | AGAGGGCAAAGTCGTAGGCCGGTAGGCTCCCGGCGGGTTCTCCGTCGT | | TAGGCT | |
| | | | | AGTCAGTGGTGTGCCTACACCTAACTGCTATGACAAGCGTATAGGAGGC | | CCCGGC | |
| | | | | CCGGAAAAACAAGCCAAGGCGGCGTTAGCTGAGAGCTAACAAGCTTCT | | GGGCTC | |
| | | | | CGTGGATGGGTGCCAGAGGGCACCATCCTGGTGGGTGGATGGGGGGA | | TCCGTCA | |
| | | | | GCTTGGGAACGTCCCGATCCTTCGGATGCCCAGACCACCGCAATCTGTC | | TAGTCA | |
| | | | | AAGGCACCGTGCTCCAAAAGCACACGCGCGGGTTGGTTTGGATGCCGA | | GTGGTG | |
| | | | | CTGAGCCAGAGGGCAAAGTCGTAGGCCGGTAGGCTCCCGGCGGGCTCT | | TGCCTTC | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCGTCATAGTCAGTGGTGTGCCTTCACCCAACTGCTATGACATGCGTACA | | ACCCAA | |
| | | | | GGAGGCCCGGAAAAATAAGCCAAGGCGGCGTTAGCATAGGGCTAACA | | CTGCTAT | |
| | | | | AGCTTCTCGTGGATGGGTGCCAGAGGGCACCATCCTGGTGGGTGGATG | | GACATG | |
| | | | | GGGGGAGCTTGGGAACGTCCCGATCGTTCGGATGCCCAACCACCGCAA | | CGTACA | |
| | | | | TCTGCCAGGCAACGTGCTTCGGAWGGTCATTGGTTCTAGACTTGTAATA | | GGAGGC | |
| | | | | GACCATTGGCCGGAAGAGCACACGCGCGGTTGGTTGGATGCCGACCGA | | CCGGAA | |
| | | | | GCCTAGAGGGTGCAAACCTGAAGGGCGAGGTCGAAGGCCGTGAGGCT | | AAATAA | |
| | | | | CCCGGCGGGAAACTCCGTCATAGTTAGTGGTGTGCCTACACCCGACGAC | | GCCAAG | |
| | | | | TATGACACATAGGAGGAATCCTGATCTGATATGATCATGTATATAGGGA | | GCGGCG | |
| | | | | GGGCGAAGGTAAATAGTCAGKGTCAAAGTCCACGTGGCAGCTACTCCC | | TTAGCAT | |
| | | | | CAGCATAGTAGTGATGCGAGTGGAWCCAACTTTGACACTGATGTTCCCT | | AGGGCT | |
| | | | | GAGCCTGACCCATCTGCACAAATCCAACAGTGTATGATGGCCCACACAC | | AACAAG | |
| | | | | TGAGGACGAGTATCACTTGTGATACTCAGAGGTGTCCCCCATGATCAAC | | CTTCTCG | |
| | | | | CAATATCACAGCTAGCGGACCTACCGTGAGGTAGACCCCCGCCGCTGTA | | TGGATG | |
| | | | | GCAGGCTCGCCTC (SEQ ID NO: 1050) | | GGTGCC | |
| | | | | | | AGAGGG | |
| | | | | | | CACCATC | |
| | | | | | | CTGGTG | |
| | | | | | | GGTGGA | |
| | | | | | | TGGGGG | |
| | | | | | | GAGCTT | |
| | | | | | | GGGAAC | |
| | | | | | | GTCCCG | |
| | | | | | | ATCGTTC | |
| | | | | | | GGATGC | |
| | | | | | | CCAACC | |
| | | | | | | ACCGCA | |
| | | | | | | ATCTGCC | |
| | | | | | | AGGCAA | |
| | | | | | | CGTGCT | |
| | | | | | | TCGGAW | |
| | | | | | | GGTCAT | |
| | | | | | | TGGTTCT | |
| | | | | | | AGACTT | |
| | | | | | | GTAATA | |
| | | | | | | GACCAT | |
| | | | | | | TGGCCG | |
| | | | | | | GAAGAG | |
| | | | | | | CACACG | |
| | | | | | | CGCGGT | |
| | | | | | | TGGTTG | |
| | | | | | | GATGCC | |
| | | | | | | GACCGA | |
| | | | | | | GCCTAG | |
| | | | | | | AGGGTG | |
| | | | | | | CAAACC | |
| | | | | | | TGAAGG | |
| | | | | | | GCGAGG | |
| | | | | | | TCGAAG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GCCGTG<br>AGGCTC<br>CCGGCG<br>GGAAAC<br>TCCGTCA<br>TAGTTA<br>GTGGTG<br>TGCCTAC<br>ACCCGA<br>CGACTA<br>TGACAC<br>ATAGGA<br>GGAATC<br>CTGATCT<br>GATATG<br>ATCATGT<br>ATATAG<br>GGAGGG<br>CGAAGG<br>TAAATA<br>GTCAGK<br>GTCAAA<br>GTCCAC<br>GTGGCA<br>GCTACTC<br>CCCAGC<br>ATAGTA<br>GTGATG<br>CGAGTG<br>GAWCCA<br>ACTTTGA<br>CACTGA<br>TGTTCCC<br>TGAGCC<br>TGACCC<br>ATCTGC<br>ACAAAT<br>CCAACA<br>GTGTAT<br>GATGGC<br>CCACAC<br>ACTGAG<br>GACGAG<br>TATCACT<br>TGTGAT<br>ACTCAG<br>AGGTGT<br>CCCCCAT<br>GATCAA | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | CCAATAT | |
| | | | | | | CACAGC | |
| | | | | | | TAGCGG | |
| | | | | | | ACCTACC | |
| | | | | | | GTGAGG | |
| | | | | | | TAGACC | |
| | | | | | | CCCGCC | |
| | | | | | | GCTGTA | |
| | | | | | | GCAGGC | |
| | | | | | | TCGCCTC | |
| | | | | | | (SEQ ID | |
| | | | | | | NO: | |
| | | | | | | 1296) | |
| NeSL | NeSL- | — | *Caenor-* | CCAACTCTCATCGTATTAACCTACGGTATTCACTCCTAGTGAGTGTAATA | CCAACTCT | TGAATA | MTNVYLKPVNDNQT |
| | 2_CRem | | *habditis* | AAGGTTAATTACGTTTTCTCTTGCMAGAGAAAAAGAAAATTCGAATCCT | CATCGTAT | CCGTCA | NKTGDNSRNTMSNS |
| | | | *remanei* | TTTTGTGTAACTCACAAACTGACAGAGACCTATCGAATTTCCTTTGTTTC | TAACCTAC | GATAAG | QCEMTWKPVARTYA |
| | | | | GTATATAGGAATAGTCACTCTGGACCACGAAGTGGACAGTTGTCGGCG | GGTATTCA | CCCCCA | QAASTNPADDKTVT |
| | | | | GACTTCCAGAGTGGAGAGAAAAGGTGTGAAGAGAGGAGGTCTAGAAA | CTCCTAGT | ACATAA | VLGCKYNLLKLGNTP |
| | | | | CACTTCGGCTGTCTAGGACCAGTTCCTGAGTGGAAAGAGGAAGGTCTA | GAGTGTAA | AAATAA | QTSKRSPPKPSRGGA |
| | | | | GAAACACTTCGGCTGTCTAGGACCAGTTCGTGAGATCTCTCGTGGAGAG | TAAAGGTT | AAGTCG | RISSVYTLTDELEITHR |
| | | | | TTGAAAACAGTCAGCTGAGGCTACTGTATTTCTTGATAGCCCCGCCCCCA | AATTACGT | GCGTTA | EEGKITFAIDLPNKNN |
| | | | | ATCCCCCTCCCCCCCCCTCGACAGATTTTTCTGTTTGACCTCCTGGAATT | TTTCTCTTG | GCTAAC | ILCPLCRECTQTRGRG |
| | | | | TGCGAGGAGTGCGCGAGAATTTTCGAATTCTTCGCGCGTTTTCTCGAAA | CMAGAGA | CACTAA | SSFTKHMKLHVKEKH |
| | | | | TTTTCCAGAAGATTCGAGCGGAGAATCTTCGAGAAAGTGAGCTGAATTT | AAAAGAA | ACCGGC | QLDATFIYKCSMCNE |
| | | | | CGCGCGAATTTTCCGCGATTTTCAAATTATCGATTTTTGTCGGAAAATTT | AATTCGAA | TCCTCAT | YEPEKKCGTKWIQTH |
| | | | | ATTTTCTGGCAAAATTTGATTGAGTTCACGCGGGAGAGAAGGAATTGTT | TCCTTTTTG | TGGGGG | LQKVHNYKYDESAIV |
| | | | | GGAAAAGGGTATTGATTTTTGTGGCGGAGGAAACTCCCACTGAATCAAT | TGTAACTC | AGAGTA | VPVPPNTRQQIANEL |
| | | | | AACTCTCAAAGGAGAACTCATCGAACAACCTCGGGTGACCTGAATCTTG | ACAAACTG | TCATTCC | NNAAPFVDIRKPKAA |
| | | | | GGCGAAATTTTCGCATTGACACAAGATAAMACAAATTACTGTKGAAAAT | ACAGAGAC | GGTGCT | AVEEKKTENGALLKFL |
| | | | | AAATCAGAACAAACTGTCAAAAAGAGAGACAAAAAGTATTGATTAACA | CTATCGAA | CTCCGTT | TKSNKDDQVKSPSXD |
| | | | | ACATCATGACAAATGTATATCTTAAGCCTGTGAATGATAACCAGACTAAC | TTTCCTTTG | TGGGCG | IPDAESPEKETQALTI |
| | | | | AAAACCGGTGATAATTCTAGAAATACTATGTCAAATAGTCAATGTGAAA | TTTCGTAT | GTAGGG | DPKGNNSPSKSSIRSS |
| | | | | TGACGTGGAAACCTGTAGCCAGAACATATGCTCAGGCAGCCAGTACTAA | ATAGGAAT | AGGAGT | QSSASSVCQEIQEIITL |
| | | | | CCCGGCCGACGACAAAACGGTGACTGTCCTTGGGTGCAAATACAATCTG | AGTCACTC | TGGGTA | SEDEDPKGARPKPGI |
| | | | | CTAAAACTGGGAAATACTCCTCAGACGTCGAAAAGGTCGCCTCCAAAAC | TGGACCAC | GCGACC | NVWSLINETGKDAYI |
| | | | | CATCGAGAGGAGGAGCTCGAATCAGCAGTGTGTATACTCTGACTGATG | GAAGTGG | CGGAAG | DTDIMMAFLKMRVE |
| | | | | AGCTGGAGATTACGCACAGAGAAGAAGGTAAGATCACATTCGCGATAG | ACAGTTGT | TATGGA | NCDSVNIIDPLNYQF |
| | | | | ACCTTCCAAACAAGAATAACATCTTGTGCCCGCTGTGTCGGGAGTGCAC | CGGCGGA | TGCCCA | PARVDLVPLIQRNLE |
| | | | | CCAAACCCGTGGGAGAGGGTCCAGTTTTACCAAGCATATGAAACTCCAC | CTTCCAGA | ACCACC | DGKKRVVFPICADEH |
| | | | | GTGAAAGAGAAGCACCAACTTGATGCCACGTTCATCTACAAGTGTAGTA | GTGGAGA | GCAATC | WTLLTISNGIAAFYDP |
| | | | | TGTGCAACGAGTACGAACCGGAAAAAAAATGCGGTACGAAGTGGATCC | GAAAAGG | TGATCT | TGSRMSSYIEELVNEL |
| | | | | AGACCCACCTTCAAAAAGTGCACAACTACAAGTATGACGAGTCTGCAAT | TGTGAAGA | GGCATT | GLIIPKEQDEQPRQR |
| | | | | AGTTGTCCCAGTACCACCCAACACAAGACAGCAAATAGCTAATGAGTTG | GAGGAGG | GTGTTTC | DSYNCGVFVMKMAE |
| | | | | AACAATGCTGCCCCATTCGTTGACATCAGAAAACCGAAAGCTGCTGCTG | TCTAGAAA | GGATGG | AFIQDTEWEMEEVE |
| | | | | TTGAGGAGAAGAAGACTGAAAATGGTGCTCTGTTAAAATTCCTGACCAA | CACTTCGG | TCTCTGT | EDVKNFRRNLLEELK |
| | | | | GTCCAATAAGGACGATCAGGTAAAATCCCCATCGGAWGATATTCCAGA | CTGTCTAG | CTCTAG | PNYEIFAEKIKYYNSP |
| | | | | TGCGGAAAGCCCTGAAAAAGAAACTCAGGCGCTCACTATCGATCCGAA | GACCAGTT | ATCTGA | GKSFAQSRPTSRSSQ |
| | | | | AGGGAACAACTCACCATCAAAAAGCTCAATAAGATCGAGCCAGTCCTCA | CCTGAGTG | AATAGA | CAVCPTCSRSATPM |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCTTCCTCCGTTTGTCAAGAAATCCAGGAAATCATCACGTTGAGTGAGG | GAAAGAG | GCTCTG | MDVGNMEVDPVPQ |
| | | | | ATGAAGACCCAAAAGGGGCTCGTCCAAAACCAGGAATCAACGTGTGGA | GAAGGTCT | GCCTGA | QQETPKSREPEQDEG |
| | | | | GCTTGATAAATGAAACGGGAAAGGATGCATACATTGATACAGATATCAT | AGAAACAC | AGAACA | WKVVGKARKRGVVT |
| | | | | GATGGCGTTCTTGAAGATGAGAGTGGAAAACTGTGACTCCGTGAACAT | TTCGGCTG | CACGCG | ERSPNISPEAKRQFTG |
| | | | | AATTGATCCACTCAATTACCAGTTTCCCGCGAGAGTGGACCTAGTCCCAC | TCTAGGAC | CGGACC | PEIKVVSPGKFHPLVG |
| | | | | TTATCCAGAGGAATCTGGAAGACGGAAAGAAAAGAGTCGTGTTTCCGA | CAGTTCGT | GGTTGG | ETEEMEVTCDSPPTK |
| | | | | TCTGTGCAGACGAACACTGGACGCTCTTGACCATCTCGAATGGAATTGC | GAGATCTC | ATGCCG | EPTTEPKVTPSLPAM |
| | | | | TGCATTCTATGATCCGACTGGATCGCGAATGAGTAGTTATATTGAAGAG | TCGTGGAG | ACTCGA | KIASPEVTKKQTSKKK |
| | | | | TTGGTGAACGAACTTGGACTGATTATCCCAAAGGAACAGGATGAACAG | AGTTGAAA | TCTGGA | GKYGKKKQXTKKAQ |
| | | | | CCAAGACAAAGAGACAGCTACAACTGTGGGGTATTTGTGATGAAAATG | ACAGTCAG | GGGTGC | PPKGEPTKKAQPKGE |
| | | | | GCGGAAGCCTTCATCCAAGATACCGAATGGGAAATGGAGGAAGTAGAG | CTGAGGCT | AAACCT | PAKLIEQVRTWFDKQ |
| | | | | GAAGACGTGAAAAACTTCCGAAGAAATCTCCTTGAAGAACTGAAACCCA | ACTGTATT | GAAAGG | MKSYQEQGSNIQTLT |
| | | | | ACTACGAGATATTTGCTGAAAAAATCAAATATTATAACTCTCCGGGAAA | TCTTGATA | GAAAGT | WIADSLTAAIFKANS |
| | | | | AAGTTTCGCCCAAAGTCGACCCACAAGTCGAAGCAGCCAGTGTGCCGTC | GCCCCGCC | TGAAGG | GNKYLVDKITARCPP |
| | | | | TGTCCGACGTGCTCTCGTTCAGCTACACCGATGATGGATGTAGGAAACA | CCCAATCC | CCGTGA | PLLNEGEMATQTSRR |
| | | | | TGGAAGTGGATCCCGTTCCACAGCAACAAGAGACACCGAAGAGTCGCG | CCCTCCCC | GGCTCC | TEAVKPKDRFVKESN |
| | | | | AGCCAGAACAAGATGAAGGCTGGAAAGTGGTGGGAAAGGCTAGAAAG | CCCCCCTC | TGGCGG | EPLRIQYAKNRAKTF |
| | | | | AGGGGAGTGGTAACTGAACGATCGCCAAACATCTCTCCAGAAGCCAAG | GACAGATT | GAAACT | NVIIGKHSARCEIDIN |
| | | | | AGACAATTCACTGGTCCAGAGATCAAAGTCGTCTCACCTGGGAAGTTTC | TTTCTGTTT | CCGTCAT | VVENHFRQTLKAQP |
| | | | | ACCCACTTGTGGGCGAAACTGAGGAGATGGAGGTGACGTGTGACAGCC | GACCTCCT | AGTCAG | VTEEALNTVCSGIKKA |
| | | | | CACCAACGAAAGAGCCCACTACGGAACCGAAAGTGACTCCAAGCCTGC | GGAATTTG | TGGTGT | KVDPSIEGPISSGEVK |
| | | | | CAGCAATGAAAATTGCTAGCCCAGAAGTGACGAAAAAGCAAACGTCAA | CGAGGAG | GCCAAC | AILAKIKDTSPGTDGV |
| | | | | AGAAGAAGGGAAAGTATGGCAAAAAGAAACAGSAGACAAAGAAAGCT | TGCGCGAG | ACCCGA | KYSDLKWFDPEGERL |
| | | | | CAGCCGCCGAAAGGGGAGCCAACAAAGAAAGCTCAGCCAAAAGGAGA | AATTTTCG | CGACTA | ALLFDECRQHGKIPS |
| | | | | ACCGGCAAAGCTCATTGAGCAAGTGAGAACTTGGTTTGATAAACAGATG | AATTCTTC | TGACAT | HWKEAETVLLPKDCT |
| | | | | AAATCGTACCAAGAGCAAGGTTCTAACATCCAGACACTGACCTGGATTG | GCGCGTTT | AGTTGG | EEERKKPENWRPISL |
| | | | | CCGACTCACTCACTGCCGCCATCTTCAAGGCAAACAGTGGAAACAAGTA | TCTCGAAA | AGGAAT | MATVYKLYSSVWNR |
| | | | | TCTGGTAGATAAGATAACTGCAAGATGCCCACCACCATTGCTGAATGAA | TTTTCCAG | CCTGATC | RISSVKGVISDCQRGF |
| | | | | GGTGAGATGGCGACGCAGACGAGCAGAAGGACAGAAGCGGTGAAACC | AAGATTCG | TGATAA | QAIDGCNESIGILRM |
| | | | | AAAAGATCGATTTGTAAAAGAATCTAACGAGCCGCTCAGAATCCAGTAT | AGCGGAG | TAATCAT | CIDTATVLNRNLSCS |
| | | | | GCAAAGAACCGAGCAAAGACCTTCAATGTGATAATTGGGAAACACTCC | AATCTTCG | TGTTCAT | WLDLTNAFGSVPHEL |
| | | | | GCACGATGTGAAATTGATATTAACGTCGTGGAAAACCACTTCAGGCAAA | AGAAAGT | ATAAGG | IRRSLAAFGYPESVINI |
| | | | | CCCTGAAAGCACAACCAGTAACAGAAGAAGCATTGAATACTGTGTGCA | GAGCTGAA | GAGGGG | ISDMYNGSSMRVKT |
| | | | | GTGGAATCAAAAAGGCGAAAGTTGATCCAAGCATTGAAGGTCCGATCT | TTTCGCGC | GATGGT | AEQKTQNIMIEAGVK |
| | | | | CGTCAGGAGAAGTGAAAGCGATTCTTGCAAAGATCAAAGATACCTCTCC | GAATTTTC | AAATAC | QGDPISPTLFNICLEGI |
| | | | | CGGAACTGATGGAGTGAAGTACAGTGATCTGAAATGGTTCGATCCGGA | CGCGATTT | CCAGGG | IRRHQTRKTGYNCVG |
| | | | | AGGTGAACGTTTGGCGTTGTTGTTCGATGAATGTCGACAGCACGGGAA | TCAAATTA | TCCGAA | NDVRCLAFADDLAIL |
| | | | | GATTCCGAGCCACTGGAAAGAAGCAGAAACTGTTCTGCTACCAAAAGAT | TCGATTTT | ACCATC | TNNQDEMQDVLNQ |
| | | | | TGCACTGAAGAGGAAAGAAAGAAGCCAGAGAATTGGAGACCCATCTCT | TGTCGGAA | AAAGCA | LDKDCRSVALIFKPKK |
| | | | | CTAATGGCTACTGTATACAAACTCTACTCCTCAGTCTGGAACAGGAGAA | AATTTATTT | GCTACT | CASLTIKKGSVDQYA |
| | | | | TCTCCTCAGTKAAAGGAGTCATCAGTGATTGCCAAAGAGGCTTCCAGGC | TCTGGCAA | GACCAG | RIKIHGMPIRTMSDG |
| | | | | GATCGATGGATGCAATGAGTCAATCGGAATTCTGCGGATGTGCATAGA | AATTTGAT | CATAGT | DTYKYLGVQTGNGG |
| | | | | CACAGCCACAGTTCTCAACCGAAACCTGTCGTGTTCATGGTTAGACTTGA | TGAGTTCA | AGTGAT | RASESESLTQIAAELQ |
| | | | | CGAACGCTTTTGGAAGCGTGCCCCACGAGTTGATCAGAAGATCACTAGC | CGCGGGA | GAACAC | MVHDTDLAPNQKLD |
| | | | | CGCATTCGGGTATCCTGAATCAGTCATCAATATAATCAGTGACATGTATA | GAGAAGG | ATAGAC | VLKAFILPRLQHMYR |
| | | | | ATGGATCGTCAATGAGAGTCAAGACAGCGGAGCAGAAAACTCAGAACA | AATTGTTG | CCTGGG | NATPKLTELKEFENTV |
| | | | | TCATGATTGAAGCTGGAGTTAAGCAAGGTGATCCCATCTCGCCAACTCT | GAAAAGG | GTTCCCT | MKSVKMYHNIPIKGS |
| | | | | ATTCAACATCTGTCTTGAAGGCATAATCCGAAGGCATCAGACGAGGAAG | GTATTGAT | GAACTC | PLEYVQIPVKNGGLG |
| | | | | ACAGGTTACAACTGCGTTGGAAACGACGTACGTTGCCTGGCATTTGCTG | TTTTGTGG | GACCCA | VMSPRFTCLITFLAST |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACGATCTTGCTATCCTTACCAACAACCAGGATGAGATGCAAGATGTGCT | CGGAGGA | TCTGCAC | LFKLWSDDEYISSIHK |
| | | | | CAATCAGCTGGACAAGGACTGTCGTAGTGTTGCCCTGATATTTAAGCCA | AACTCCCA | AAACCC | KALSRITAKVMGLKT |
| | | | | AAGAAGTGTGCTTCACTGACGATCAAAAAAGGAAGTGTTGATCAGTATG | CTGAATCA | ACTTTGT | QKATLQEQCEYLNTK |
| | | | | CAAGAATCAAGATTCATGGAATGCCCATTCGGACTATGTCGGATGGGG | ATAACTCT | ACAAAT | KAITKGGYSLFSRMN |
| | | | | ATACCTACAAGTATCTCGGAGTCCAAACCGGAAACGGTGGTAGAGCCTC | CAAAGGA | GAACCA | EAIRTLSVNLGAPLKS |
| | | | | GGAATCAGAATCCCTGACTCAGATTGCCGCGGAACTCCAAATGGTCCAT | GAACTCAT | AACTGA | MQFIPENGEIALEVQ |
| | | | | GACACAGACCTGGCGCCGAACCAGAAACTTGATGTGCTGAAGGCATTC | CGAACAAC | TGAAGA | ASENSQIKVFSKADS |
| | | | | ATCCTGCCGAGACTGCAACATATGTACAGAAACGCCACTCCAAAGCTGA | CTCGGGTG | GTTTAAT | MKLVTKLKDLVKSA |
| | | | | CGGAGTTAAAGGAGTTTGAGAACACAGTCATGAAAAGTGTGAAGATGT | ACCTGAAT | GATTTCT | MLKNFLENKKVKSKV |
| | | | | ATCACAACATCCCGATTAAAGGATCACCACTCGAATATGTCCAAATTCCA | CTTGGGCG | TACATCA | VQVLQHHPQSNKFV |
| | | | | GTAAAGAATGGAGGACTCGGAGTTATGTCTCCCCGATTCACGTGTCTCA | AAATTTTC | CAGCTA | NDGKNXSISSQKFVH |
| | | | | TAACGTTCCTGGCGTCCACACTGTTCAAACTGTGGTCAGACGACGAATA | GCATTGAC | GCGGAC | PARLSQLVCNGNSYS |
| | | | | CATCTCGTCCATCCACAAAAAGGCGTTGAGTAGAATCACGGCAAAGGTG | ACAAGATA | CTACCGT | KDLPKNCRWCGYEC |
| | | | | ATGGGACTGAAGACCCAAAAAGCCACGCTCCAAGAGCAGTGCGAGTAC | AMACAAA | GAGGTA | ESQAHILQHCTYSLSS |
| | | | | CTGAACACCAAGAAAGCAATCACGAAAGGAGGTTACAGCCTCTTCTCGC | TTACTGTK | GACTCC | GITQRHDRVLNRILXE |
| | | | | GAATGAACGAAGCTATTCGAACGCTCAGTGTCAACCTTGGAGCACCGCT | GAAAATAA | CGCCGC | VIKGRKNNDYYDIMV |
| | | | | CAAATCAATGCAATTCATTCCGGAAAATGGCGAAATTGCTTTAGAAGTG | ATCAGAAC | TGTAGC | DTEPGPTRERPDIIMI |
| | | | | CAAGCATCAGAAAACTCACAGATCAAAGTATTCTCGAAAGCTGACAGTA | AAACTGTC | AGGCTC | QKDGPEVLLADVTVP |
| | | | | TGAAACTGGTGACAAAGCTGAAAGATCTGGTGAAATCGGCGATGCTCA | AAAAAGA | GCCATT | YENGVVAIEAAWDW |
| | | | | AGAACTTCTTGGAAAACAAGAAGGTCAAAAGCAAGGTTGTGCAGGTGC | GAGACAA | G (SEQ | KMEKYSHFIDYFARL |
| | | | | TTCAACACCACCCACAATCAAACAAATTCGTCAATGATGGAAAGAACWK | AAAGTATT | ID NO: | GKRAVILPLVVGSLGT |
| | | | | CAGCATWTCCTCCCAAAAGTTCGTACACCCAGCACGGCTGAGCCAGCTG | GATTAACA | 1297) | YWPDTSNSLRMLGL |
| | | | | GTCTGCAACGGGAACAGCTACAGTAAAGACCTTCCGAAAAACTGCAGAT | ACATC | | SDGQIRNLIPDISMIA |
| | | | | GGTGCGGCTACGAATGCGAGTCTCAGGCTCACATCCTCCAGCATTGCAC | (SEQ ID | | LESSKQIYWRHIFGDS |
| | | | | ATACAGCCTTTCATCTGGAATCACCCAGAGGCATGACCGTGTCCTGAAC | NO: 1174) | | YRIVSDLYCRKDQQEI |
| | | | | AGGATCTTGCASGAGGTGATAAAAGGCAGAAAAAACAACGACTACTAT | | | RFGDEPMENVQVSD |
| | | | | GACATAATGGTGGATACGGAGCCCGGACCAACCAGAGAGCGTCCAGAT | | | RFQPFKTREREKKSEE |
| | | | | ATCATCATGATACAGAAAGATGGTCCGGAAGTCCTACTGGCGGATGTTA | | | EKKRRSKSKKGKTWR |
| | | | | CGGTACCATACGAGAATGGAGTTGTTGCGATCGAAGCCGCGTGGGATT | | | GSKKQTDSRQSGKSN |
| | | | | GGAAGATGGAGAAGTACAGTCACTTTATTGATTACTTCGCAAGACTGGG | | | QNQGFQRSVGQGVS |
| | | | | AAAGAGAGCAGTAATCCTTCCACTAGTGGTTGGAAGTCTTGGGACCTAC | | | R (SEQ ID NO: 1419) |
| | | | | TGGCCAGACACCTCAAACTCTCTGAGAATGCTGGGTCTCTCTGATGGGC | | | |
| | | | | AAATCAGAAACCTGATCCCAGACATCTCCATGATTGCTCTAGAGTCTTCC | | | |
| | | | | AAACAAATCTACTGGAGGCATATCTTCGGAGATAGCTACAGAATTGTGA | | | |
| | | | | GTGATCTATACTGCAGAAAAGACCAGCAGGAGATCAGATTCGGAGATG | | | |
| | | | | AACCCATGGAAAATGTTCAAGTCTCAGATCGATTCCAGCCTTTTAAAACA | | | |
| | | | | AGAGAGCGTGAGAAGAAATCCGAGGAAGAGAAAAAGAGAAGATCAAA | | | |
| | | | | GTCCAAAAAAGGCAAAACTTGGCGAGGATCCAAAAAACAAACTGATTC | | | |
| | | | | CCGGCAATCCGGCAAAAGCAATCAGAATCAGGGCTTCCAAAGAAGCGT | | | |
| | | | | TGGACAAGGCGTATCACGGTGAATACCGTCAGATAAGCCCCCAACATAA | | | |
| | | | | AAATAAAAGTCGGCGTTAGCTAACCACTAAACCGGCTCCTCATTGGGGG | | | |
| | | | | AGAGTATCATTCCGGTGCTCTCCGTTTGGGCGGTAGGGAGGAGTTGGG | | | |
| | | | | TAGCGACCCGGAAGTATGGATGCCCAACCACCGCAATCTGATCTGGCAT | | | |
| | | | | TGTGTTTCGGATGGTCTCTGTCTCTAGATCTGAAATAGAGCTCTGGCCTG | | | |
| | | | | AAGAACACACGCGCGGACCGGTTGGATGCCGACTCGATCTGGAGGGTG | | | |
| | | | | CAAACCTGAAAGGGAAAGTTGAAGGCCGTGAGGCTCCTGGCGGGAAAC | | | |
| | | | | TCCGTCATAGTCAGTGGTGTGCCAACACCCGACGACTATGACATAGTTG | | | |
| | | | | GAGGAATCCTGATCTGATAATAATCATTGTTCATATAAGGGAGGGGGAT | | | |
| | | | | GGTAAATACCCAGGGTCCGAAACCATCAAAGCAGCTACTGACCAGCATA | | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTAGTGATGAACACATAGACCCTGGGGTTCCCTGAACTCGACCCATCTG | | | |
| | | | | CACAAACCCACTTTGTACAAATGAACCAAACTGATGAAGAGTTTAATGA | | | |
| | | | | TTTCTTACATCACAGCTAGCGGACCTACCGTGAGGTAGACTCCCGCCGCT | | | |
| | | | | GTAGCAGGCTCGCCATTG (SEQ ID NO: 1051) | | | |
| NeSL | NeSL- | chrUn | *Caenor-* | CCCTTTTCTATCGTATTAACTACGATAACCGCTCATTTGAGTGTAAAAAA | CCCTTTTCT | TAACAT | MTKTEWSWRHRSRS |
| | 4_CRem | | *habditis* | GGTTCCCCCCTCCTCGCCTGCCTTACCCACGCATCTCTGCCTCTGGGAAG | ATCGTATT | GCCTTG | RSVGIVVKIDTSDYAN |
| | | | *remanei* | GCGGAGGGTCAACTTGCGGGTCTGTGGATTTCCTTTCCTATCCACCGCCC | AACTACGA | GAAGGC | VRVHVAADLSNEDG |
| | | | | ATATTCTCTGTCGAAAGCCTACCTAGATCAGCCGGGAGTTTTTCCTATCC | TAACCGCT | ACCACG | HTSHNNGIILPIPMKP |
| | | | | CATTCAGGCGATCGCTCAAGGCTGTTTTATCGACACTCCTTCTTGACAAG | CATTTGAG | CCAAAA | SVDRFCQIQYPPRGY |
| | | | | TATTTATTTCTTGACAAATTCTATTTTTCCTTTTATCGATTTTCTCTTATTTA | TGTAAAAA | GTCCTG | YVPHPQSQKGHDAK |
| | | | | TCGATTCTTGTGAAAATATGACCAAGACCGAATGGTCCTGGCGTCATCG | AGGTTCCC | GCAACT | PSRHWNEEAQPPYY |
| | | | | ATCTCGCTCCCGCTCTGTTGGAATCGTTGTGAAAATCGATACAAGCGACT | CCCTCCTC | GATTTG | HNNNHGRRGRSAKP |
| | | | | ATGCTAACGTCCGAGTGCATGTCGCGGCGGACCTTTCCAATGAGGATGG | GCCTGCCT | AATAAT | SGRRPPRKPILQEESL |
| | | | | CCACACGAGCCACAACAACGGCATCATTCTCCCCATCCCAATGAAGCCC | TACCCACG | GTATAA | AAHPQIPGDTASAVP |
| | | | | AGCGTCGATCGATTCTGTCAAATTCAATACCCTCCAAGAGGGTACTATGT | CATCTCTG | AAGTAA | LYSDVVNNENKSQG |
| | | | | TCCGCATCCTCAAAGTCAGAAAGGCCATGATGCAAAGCCCTCGCGTCAT | CCTCTGGG | CTGGAA | KPPQGSHRRSGRPGT |
| | | | | TGGAATGAAGAGGCACAACCTCCCTACTACCACAACAACAATCATGGGA | AAGGCGG | CCAAAT | KPSVPVGEAEQETNS |
| | | | | GAAGGGGGCGTTCGGCAAAACCAAGTGGACGCCGACCCCCACGAAAGC | AGGGTCAA | GCCCGA | RPIAPEPIVKFKHDKH |
| | | | | CCATACTTCAGGAAGAGTCCCTGGCAGCGCACCCCCAAATACCCGGGGA | CTTGCGGG | TAGGTA | GWTTVQGSHSSGRP |
| | | | | TACTGCGTCAGCGGTCCCACTGTACTCCGACGTCGTCAACAATGAAAAC | TCTGTGGA | GGGCGG | VPKPSVPVVSEANRF |
| | | | | AAGAGTCAGGGGAAACCACCGCAAGGGTCCCACAGAAGAAGTGGAAG | TTTCCTTTC | GAGAAA | QLLQEGDFPPLTTSES |
| | | | | ACCAGGAACAAAGCCCTCTGTTCCGGTTGGTGAGGCAGAGCAAGAAAC | CTATCCAC | ATGACC | SQEEIKVPNYQRIVSP |
| | | | | GAATTCCCGTCCAATTGCTCCAGAACCCATCGTGAAATTCAAACACGATA | CGCCCATA | TAGAAA | IPLPSEEDSKLPTKSNY |
| | | | | AACACGGGTGGACTACTGTCCAAGGGTCCCACAGTAGTGGAAGGCCGG | TTCTCTGT | ACACAA | RAPKGRKSRNYKKPQ |
| | | | | TACCAAAGCCCTCGGTACCGGTGGTTTCAGAGGCAAATCGGTTCCAGTT | CGAAAGCC | AGTCCC | QQNPKKYQQRLPYQ |
| | | | | ACTCCAGGAAGGGGATTTTCCACCCCTTACAACATCCGAATCTTCGCAA | TACCTAGA | AAGCCC | PKVNNAPTDRMAPE |
| | | | | GAAGAGATTAAAGTACCGAACTACCAACGAATAGTGTCACCGATTCCTC | TCAGCCGG | CCGGAT | QLKGGGGKTAHNDI |
| | | | | TCCCCTCTGAAGAGGATAGTAAGTTGCCGACTAAATCAAATTACAGAGC | GAGTTTTT | TCGAAA | EEMEIEEDTDEKIIQV |
| | | | | GCCCAAGGGACGAAAGAGTCGCAACTACAAGAAGCCACAACAACAAAA | CCTATCCC | GACCTA | KRIKIVNKLTPHHFVC |
| | | | | TCCGAAGAAATATCAGCAGAGGTTACCCTATCAACCCAAGGTCAACAAT | ATTCAGGC | TAGGAA | MMTYPTDNIYRCFV |
| | | | | GCTCCGACGGATCGCATGGCCCCAGAACAACTCAAAGGAGGAGGAGGA | GATCGCTC | GTCAGT | KGCTATSQGGWGAE |
| | | | | AAAACCGCCCACAATGACATTGAAGAGATGGAAATTGAGGAAGACACT | AAGGCTGT | GAATAG | DLKYLTVHIRQEHKIK |
| | | | | GACGAGAAGATTATCCAAGTGAAACGAATCAAAATCGTCAATAAGCTAA | TTTATCGA | AGAGAA | VEWTYECGICGDLSG |
| | | | | CTCCGCATCACTTTGTTTGCATGATGACGTATCCAACCGACAACATCTAT | CACTCCTT | ATATCA | GAGKHISKWIKPHM |
| | | | | AGATGCTTCGTCAAAGGTTGCACAGCAACATCACAAGGTGGTTGGGGA | CTTGACAA | AACAAA | RKKHNRDAPTNFKM |
| | | | | GCAGAGGACCTTAAGTACCTGACTGTCCATATCAGACAAGAACACAAAA | GTATTTAT | TCTCACC | GSRSSGKPKITELLEES |
| | | | | TTAAGGTCGAATGGACGTACGAATGCGGGATATGCGGTGACCTATCGG | TTCTTGAC | CATTCAC | APSCSNPRRKTLNQK |
| | | | | GAGGTGCTGGCAAACATATCAGTAAATGGATCAAACCCCATATGAGGA | AAATTCTA | AAGGAC | KTAIITQVTPEKLKTG |
| | | | | AGAAACACAATAGAGATGCCCCAACCAATTTCAAGATGGGTTCAAGAA | TTTTTCCTT | TTACTG | YQTRSVTKALSVLKES |
| | | | | GTTCAGGTAAACCCAAGATTACTGAACTACTGGAGGAGAGCGCCCCGTC | TTATCGAT | GTCGAG | RQKELEVLREEEKAN |
| | | | | TTGCTCGAATCCAAGAAGGAAAACCCTCAACCAGAAGAAGACTGCTATA | TTTCTCTTA | TAGAAA | AKQKSKLHPFFTKAP |
| | | | | ATCACGCAAGTCACTCCGGAGAAATTGAAAACGGGCTATCAAACGAGA | TTTATCGA | ACAAGC | HIDGVKPTVRRELSK |
| | | | | AGTGTCACGAAGGCTCTCAGCGTCCTGAAAGAGTCACGACAAAAAGAG | TTCTTGTG | CAAAAC | MITPGGEHKGTKIPM |
| | | | | CTGGAAGTGTTGAGAGAAGAAGAAAAGGCTAACGCTAAACAAAAGTCT | AAAAT | ATCAAG | VHTKRGLIQKINRKAK |
| | | | | AAACTTCATCCTTTCTTCACCAAAGCCCCTCATATAGATGGTGTGAAACC | (SEQ ID | CACGAC | KAKPMHLDESTIIEAS |
| | | | | AACAGTACGGAGAGAACTATCAAAAATGATTACTCCCGGAGGAGAACA | NO: 1175) | GCAAAA | QLDVITIDDDDEDDN |
| | | | | TAAGGGAACAAAGATACCAATGGTCCACACCAAGCGCGGTCTCATCCAA | | AGGGGT | MTPMRRRFNTWCL |
| | | | | AAGATAAACAGAAAAGCTAAAAAGGCTAAACCAATGCATCTTGACGAA | | AACTTTG | DHETTQEAWLTDDVI |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGTACCATCATAGAAGCGTCACAGCTCGACGTCATCACTATTGACGACG | | GGCAAC | NWYLKDLCFGNEQY |
| | | | | ACGACGAAGACGACAACATGACACCAATGCGAAGAAGATTCAACACTT | | TAATTAA | MLVDPLVWLIYKMG |
| | | | | GGTGTCTTGACCACGAGACGACTCAAGAAGCATGGTTAACTGACGACG | | CGGATA | GMAGVEQRFKSKKT |
| | | | | TAATCAATTGGTACTTGAAAGACCTATGCTTTGGTAACGAACAATACAT | | CCTCCGT | CLFPICEADHWILLVF |
| | | | | GCTCGTAGACCCACTAGTATGGCTGATATACAAGATGGGAGGAATGGC | | GTATCA | DETNLCYANSLGSQP |
| | | | | AGGCGTCGAACAAAGGTTCAAAAGCAAGAAGACGTGCCTATTCCCAATC | | GGCAAA | NGQVKNFIQQLNRKL |
| | | | | TGCGAAGCTGACCACTGGATTCTTCTTGTATTCGATGAGACCAACTTGTG | | GCCGCC | CSFEKEVPLQKDSVN |
| | | | | CTACGCGAATAGTCTTGGATCCCAACCAAACGGACAAGTTAAGAACTTC | | ACCAAC | CGVHVCLIAKSIVNG |
| | | | | ATTCAACAACTCAACCGAAAGCTCTGCAGCTTTGAGAAAGAAGTTCCAC | | AGCAAA | QFWYDDSDVRTFRT |
| | | | | TTCAGAAAGATAGTGTAAACTGCGGAGTACATGTCTGCCTGATAGCAAA | | TTACTGC | NAKAALKAQGYELFS |
| | | | | GTCAATAGTCAATGGACAATTTTGGTACGATGATTCAGACGTTCGAACG | | CCGATA | EAPKQIENPDSSHRE |
| | | | | TTTAGAACCAACGCCAAGGCGGCTCTGAAAGCCCAGGGCTACGAGCTCT | | GGTAGG | DIKENSMEMCSESL |
| | | | | TCTCGGAAGCACCAAAACAAATCGAAAACCCAGACTCCAGCCACAGAG | | GCGTGA | MIVATPQRSEAPMEL |
| | | | | AAGACATCAAGGAGAACAGTATGGAAATGTGTTCGGAATCTTTGATGAT | | GAAAAT | VDTEPSDLESPKSDR |
| | | | | CGTTGCGACTCCACAGAGGAGTGAAGCACCTATGGAACTAGTCGACACT | | GACCTA | VVYEDCITALSDVSEP |
| | | | | GAGCCTAGTGATCTGGAATCGCCAAAGTCAGACAGAGTAGTCTACGAA | | CAACCTC | RMTPEKSETPEVPVV |
| | | | | GACTGCATCACAGCTCTATCTGATGTTTCGGAGCCAAGAATGACTCCAG | | CAAGAC | EERDLDWPKLESPKS |
| | | | | AAAAGAGCGAAACTCCAGAGGTGCCAGTGGTGGAAGAAAGAGATCTG | | CCGAGC | DRVVYEDCITDLSDVS |
| | | | | GATTGGCCAAAACTGGAATCGCCAAAGTCAGACAGAGTAGTCTATGAA | | CCACGG | EQRMTPEKCETPEAP |
| | | | | GACTGCATCACAGATCTGTCTGATGTTTCGGAGCAAAGAATGACTCCAG | | AATCGA | LVVECVELERLPKDLP |
| | | | | AAAAGTGCGAAACCCCAGAAGCGCCATTGGTTGTAGAATGTGTTGAGTT | | AAGACC | VTDRSTVVAIPEAVKL |
| | | | | GGAAAGGCTACCTAAGGATCTGCCAGTCACAGACAGGTCAACTGTCGT | | TATAGG | EEKSEVVIPRLMELSY |
| | | | | GGCAATCCCTGAAGCAGTAAAACTGGAGGAAAAGTCAGAAGTGGTAAT | | AAGTCA | TVPPEPSPVVEYTQP |
| | | | | TCCACGGCTCATGGAGTTATCATACACCGTCCCTCCAGAACCCTCTCCAG | | GTGAAT | YTHTHTKPKVKATCQ |
| | | | | TGGTTGAATACACCCAACCATACACTCACACTCACACTAAACCAAAGGTC | | TGATGG | MGKKRKVPTGKPDE |
| | | | | AAAGCTACATGCCAGATGGGAAAGAAAAGGAAGGTACCAACTGGGAA | | AAATAC | LIQIVRQWFEKEFND |
| | | | | ACCAGACGAACTGATTCAGATTGTGAGACAATGGTTTGAGAAAGAATTC | | AAAACC | YVTEGRNFQRLEWLT |
| | | | | AACGATTATGTTACGGAAGGACGAAACTTTCAACGACTGGAATGGCTTA | | AAATTTC | NLLTAAIQKASAGDE |
| | | | | CGAACTTACTCACCGCCGCAATACAGAAGGCATCAGCTGGTGATGAGG | | TTCCATT | ETIEKIRKRCPPPEVRE |
| | | | | AAACAATCGAAAAGATTCGAAAGAGATGCCCACCTCCAGAAGTTAGAG | | CACAAG | NEMSTQTSQRQKPT |
| | | | | AAAACGAAATGTCCACTCAGACATCTCAACGTCAAAAGCCTACCACAAC | | GACTTA | TTNQKKRSRNTTQSD |
| | | | | GAATCAGAAGAAACGCTCTAGAAACACTACTCAATCGGATACACAAGCC | | CTGGTC | TQANTYWRNRAKTY |
| | | | | AACACATACTGGCGAAATCGAGCCAAGACATATAATCAAATCATAGGTC | | GAGTAG | NQIIGQDFKQCDIPIA |
| | | | | AAGATTTCAAACAGTGTGACATACCGATCGCGATACTAGAAGAATTCTA | | AGCACA | ILEEFYKKTTSVTNVP |
| | | | | TAAAAAGACTACCTCAGTGACCAATGTCCCTCAGGAAACCCTTGTGAAA | | AGCCAA | QETLVKVTSRLPRLDI |
| | | | | GTCACCTCAAGACTACCAAGGTTAGACATTGGAAAGTGGATCGAGGATC | | AATATC | GKWIEDPFTEQEVFG |
| | | | | CGTTCACGGAACAAGAGGTATTTGGTGCCCTCAAAAAGACAAAAGACA | | AAGTAT | ALKKTKDTAPGTDGL |
| | | | | CTGCGCCAGGAACAGATGGGCTCAGATACTATCACCTCCAATGGTTTGA | | GACGCA | RYYHLQWFDPDCKM |
| | | | | TCCCGACTGTAAAATGTTGAGTAGCATTTACAATGAATGCCAGCACCAT | | AAAATG | LSSIYNECQHHLKIPA |
| | | | | CTGAAAATTCCTGCCCAATGGAAAGAAGCTGAAACAATTCTCCTCTTCAA | | GGTAAC | QWKEAETILLFKSGD |
| | | | | AAGTGGCGACGAATCCAAACCAGACAACTGGCGGCCTATAAGTCTCATG | | CTTGGG | ESKPDNWRPISLMPT |
| | | | | CCCACCATCTACAAGCTATACTCAAGTCTCTGGAATAGGAGAATACGGA | | CATCCA | IYKLYSSLWNRRIRTV |
| | | | | CGGTGAAGGGGATTATGAGCAAGTGCCAACGAGGATTCCAAGAGAGA | | ATCAAC | KGIMSKCQRGFQERE |
| | | | | GAAGGTTGCAATGAGAGTATCGGAATACTGCGGAGTGCTATTGATGTG | | GGATAC | GCNESIGILRSAIDVA |
| | | | | GCTAAAGGGAAAAGATCCCACCTGTCCGTTGCATGGCTGGACCTCACCA | | CTCTGC | KGKRSHLSVAWLDLT |
| | | | | ATGCCTTCGGTTCAGTACCTCACGAGCTGATTGAAAGCACGTTAAGTGC | | GTATCA | NAFGSVPHELIESTLS |
| | | | | ATACGGCTTTCCGGAGATGGTTGTACACATTGTCAAGGACATGTATAAA | | GGCAAA | AYGFPEMVVHIVKD |
| | | | | GACGCTTCCATAAGAGTCAAGAATAGAACGGAGAAAAGTGAGCAGATT | | GTCGCC | MYKDASIRVKNRTEK |
| | | | | ATGATAAAATCTGGGGTAAAACAAGGCGACCCTATCTCACCAACACTAT | | ACCAAA | SEQIMIKSGVKQGDP |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCAACATGTGCCTCGAAACGGTGATTAGACGACATCTGAAAGAATCATC | | CTGTACT | ISPTLFNMCLETVIRR |
| | | | | AGGTCACAAATGCATTGACACCAGAATCAAGCTTCTTGCATTTGCAGAT | | ACTCCG | HLKESSGHKCIDTRIK |
| | | | | GATATGGCCGTTCTAGCAGAATCAAAAGAGCAGCTACAAAAGGAGCTT | | AAAAAA | LLAFADDMAVLAESK |
| | | | | ACAGAAATGGATGAAGACTGTACACCTCTCAACCTAATTTTCAAGCCGG | | CCAAGA | EQLQKELTEMDEDCT |
| | | | | CGAAGTGTGCAAGTCTCATCATAGAGTTCGGGAAAGTGAGGACCCATG | | AACATG | PLNLIFKPAKCASLIIEF |
| | | | | AGCAGATCATGTTGAAGCGAGAGCCGATCCGAAACCTCAATGATGACG | | ATTTTCC | GKVRTHEQIMLKREP |
| | | | | GAACATACAAGTATCTGGGAGTGCATACGGGAGCAGATGCAAGGACAT | | CACTCC | IRNLNDDGTYKYLGV |
| | | | | CAGAAGAGGAGCTGATCATTTCTGTAACAAAAGAGGTAGACCTTGTCAA | | GTTAAA | HTGADARTSEEELIIS |
| | | | | TCGCTCGGCGCTTACGCCACCCCAGAAACTGGACTGTCTTAAGACGTTC | | GCATCTC | VTKEVDLVNRSALTP |
| | | | | ACACTCCCAAAGATGACCTACATGTATGCCAACGCCATACCAAAACTTAC | | AACCAA | PQKLDCLKTFTLPKM |
| | | | | CGAACTTTCAGCGTTCGCTAACATGGTCATGCGAGGAGTCAAGATAATC | | GCTAAA | TYMYANAIPKLTELSA |
| | | | | CACTATATCCCAGTTAGAGGATCTCCTCTTGAATATATTCAAATTCCGAC | | GCGGTA | FANMVMRGVKIIHYI |
| | | | | CGGCAAAGGAGGACTTGGAGTTCCATGCCCTAGAATCACGGCATTGATT | | AGGTTA | PVRGSPLEYIQIPTGK |
| | | | | ACCTTCCTTGTCTCAACCATGAAGAAACTGTGGTCTGATGATGAATACAT | | TCATGTC | GGLGVPCPRITALITF |
| | | | | TCGTAAGCTCTACAACTCTTATCTGAAGAAGGTTGTGGAGGCGGAAACG | | AAAAGG | LVSTMKKLWSDDEYI |
| | | | | GGAATAGTGGAGGTCTCCACAAAGGATCTAGCAGAGTACCTCAGCAAC | | TGTAGC | RKLYNSYLKKVVEAET |
| | | | | AAGGTACCATCCAGAAAGCACGAATTCGGGTATAACTGCTACTCGAGGA | | TACAGC | GIVEVSTKDLAEYLSN |
| | | | | TTCGCGAAGTTTGTAATGGGCTAGCTCTCAACCAAGCTGCCCCTCTCTAC | | AACCTA | KVPSRKHEFGYNCYS |
| | | | | AAACTTGAATTCATCGAACAAGACAATGAGTTAGCAGTTGTTGTCCAGC | | AAGCCC | RIREVCNGLALNQAA |
| | | | | CGACTGAGGAGAGCAAGGAAAGGATTTTCACTAAAGATCATGTGAAAA | | GAAAGG | PLYKLEFIEQDNELAV |
| | | | | AGCTCCAGTCGCTACTGAAAGCCAGCGTGAATGACGCACTGCTACACAG | | TAGGGC | VVQPTEESKERIFTKD |
| | | | | ATTCTTGACAACAAAACCCGTCAAAAGTGAAGTGGTACAAGTTCTCCAG | | CGTATA | HVKKLQSLLKASVND |
| | | | | CAGCACCCTCAAAGCAACAGCTTCGTCCGAATGGGAGGTAAAGTAAGT | | AAAAGA | ALLHRFLTTKPVKSEV |
| | | | | ATATCGGTACATGTATGGATCCACAGGTCACGGTTAAACCAACTAACGT | | CCTACAC | VQVLQQHPQSNSFV |
| | | | | GCAATTATAACATCTTTGATCCAAAGCAACCGAAAAACTGCCGGAGGTG | | CCTCCAA | RMGGKVSISVHVWI |
| | | | | TGGTTATAAGAACGAGACTCAATGGCACATCCTGCAAGACTGCACATAT | | GACCTA | HRSRLNQLTCNYNIF |
| | | | | GGCTGGGCTAAACTTATACGAGAAAGACACGATGCCGTACATCACAAG | | AACCCA | DPKQPKNCRRCGYK |
| | | | | GTAGTCACAATGATTTGCGCTGGGGCAAAGAAGAACTGGGGCCGGAAA | | CGAACT | NETQWHILQDCTYG |
| | | | | ATCGACCAAGAACTGCCCGGTTTCACTTCACTCCGTCCAGACATTTGTCT | | CGAACG | WAKLIRERHDAVHH |
| | | | | GACGAGTCCGGATGGCAAAGAGGTTATCTTTGCGGATGTTTGTGTCCCT | | ACCTAC | KVVTMICAGAKKNW |
| | | | | TACTCAAGGACAAGGAACATCGAATTCGCGTGGAAAGAGAAAATCCGA | | AGGAAG | GRKIDQELPGFTSLRP |
| | | | | AAGTATACAGAAGGATACAGTCATCTTGTTGCACAAGGAATCAAAGTGA | | TCCGTG | DICLTSPDGKEVIFAD |
| | | | | CAGTCCTTCCGATAGCCATAGGATCACTCGGAACTTGGTGGACGCCAAC | | AATGGA | VCVPYSRTRNIEFAW |
| | | | | CAACGAAAGTCTCTATCAACTGGGTATCAGCAAGAGCGATATTCGCAGT | | GAGAAA | KEKIRKYTEGYSHLVA |
| | | | | GCCATTCCATTACTATGCTCTACTGTGATGGAGTATAGTAAGAACGCCTA | | TATCTCA | QGIKVTVLPIAIGSLG |
| | | | | CTGGAATCACATATACGGAAACTCATATACCTCGGTCCCACTGAGATAC | | CCAAAT | TWWTPTNESLYQLGI |
| | | | | GGACACCAGAAGCCCGATGGAGACGATTGGAAGAAAGAACTGAGTTGC | | CTCTTCC | SKSDIRSAIPLLCSTV |
| | | | | GAACCAGTTCTAGCTCTCCAACAATAACATGCCTTGGAAGGCACCACGC | | ATTCACA | MEYSKNAYWNHIYG |
| | | | | CAAAAGTCCTGGCAACTGATTTGAATAATGTATAAAAGTAACTGGAACC | | AAGGCT | NSYTSVPLRYGHQKP |
| | | | | AAATGCCCGATAGGTAGGGCGGGAGAAAATGACCTAGAAAACACAAA | | AACTGG | DGDDWKKELSCEPV |
| | | | | GTCCCAAGCCCCCGGATTCGAAAGACCTATAGGAAGTCAGTGAATAGA | | TCAAGT | LALQQ (SEQ ID NO: |
| | | | | GAGAAATATCAAACAAATCTCACCCATTCACAAGGACTTACTGGTCGAG | | AGAGCA | 1420) |
| | | | | TAGAAAACAAGCCAAAACATCAAGCACGACGCAAAAAGGGGTAACTTT | | CAAGCT | |
| | | | | GGGCAACTAATTAACGGATACCTCCGTGTATCAGGCAAAGCCGCCACCA | | AAGCCT | |
| | | | | ACAGCAAATTACTGCCCGATAGGTAGGGCGTGAGAAAATGACCTACAA | | CCAAGC | |
| | | | | CCTCCAAGACCCGAGCCCACGGAATCGAAAGACCTATAGGAAGTCAGT | | ACGAAG | |
| | | | | GAATTGATGGAAATACAAAACCAAATTTCTTCCATTCACAAGGACTTACT | | TGATAT | |
| | | | | GGTCGAGTAGAGCACAAGCCAAAATATCAAGTATGACGCAAAAATGGG | | GGGTAA | |
| | | | | TAACCTTGGGCATCCAATCAACGGATACCTCTGCGTATCAGGCAAAGTC | | TTTAGG | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCCACCAAACTGTACTACTCCGAAAAAACCAAGAAACATGATTTTCCCAC | | CAACCA | |
| | | | | TCCGTTAAAGCATCTCAACCAAGCTAAAGCGGTAAGGTTATCATGTCAA | | ATCAAC | |
| | | | | AAGGTGTAGCTACAGCAACCTAAAGCCCGAAAGGTAGGGCCGTATAAA | | GGATAC | |
| | | | | AAGACCTACACCCTCCAAGACCTAAACCCACGAACTCGAACGACCTACA | | CTCCGT | |
| | | | | GGAAGTCCGTGAATGGAGAGAAATATCTCACCAAATCTCTTCCATTCAC | | GTATCA | |
| | | | | AAAGGCTAACTGGTCAAGTAGAGCACAAGCTAAGCCTCCAAGCACGAA | | GGCAAA | |
| | | | | GTGATATGGGTAATTTAGGCAACCAATCAACGGATACCTCCGTGTATCA | | GTCGCC | |
| | | | | GGCAAAGTCGCCACAAACACTGTACTACTCCGTTACTCCCAAACACATG | | ACAAAC | |
| | | | | GATCTCCTTCTCTCACCAAAAAGCTTTATAACCAAGCTAACGGTGGAAAG | | ACTGTA | |
| | | | | GACATCATGTCACGAGGAGTAGCTACAGTAACCTCTCTCTTGAGACTGC | | CTACTCC | |
| | | | | AAAGTCGAGGATGGATTGGGAAGGCCGCGAGGCAAAAGGCGGGTAAC | | GTTACTC | |
| | | | | TCGGCCAGACGCTAGTGATCTTCGGATCCGACAGCCCTGGCCTTAGAGG | | CCAAAC | |
| | | | | AACCCTGGGATAAGGAGCACGACGGGAAGGATGTTCCGCAAGGATTTC | | ACATGG | |
| | | | | CCTTCCCATTAGTCAGGGCTGGCAGTTGGTAATATAGCCTTTCTACACAC | | ATCTCCT | |
| | | | | CACCGTCTTGCACCCACTAAACCAGTGGGATATGCGGGTGGACTCAATG | | TCTCTCA | |
| | | | | TAGAAAGGTGTTCCCACTGCCTGACTCGCCAACTTTATATGTCTTGTCAA | | CCAAAA | |
| | | | | CATAATGGCCCCTCACTATAAACTCCCTAGCAACTGGTGGTCCGGCGAA | | AGCTTTA | |
| | | | | GCCGGTTCTTGCCACTATTGCGCCCCAGGCTCGCC (SEQ ID NO: 1052) | | TAACCA | |
| | | | | | | AGCTAA | |
| | | | | | | CGGTGG | |
| | | | | | | AAAGGA | |
| | | | | | | CATCAT | |
| | | | | | | GTCACG | |
| | | | | | | AGGAGT | |
| | | | | | | AGCTAC | |
| | | | | | | AGTAAC | |
| | | | | | | CTCTCTC | |
| | | | | | | TTGAGA | |
| | | | | | | CTGCAA | |
| | | | | | | AGTCGA | |
| | | | | | | GGATGG | |
| | | | | | | ATTGGG | |
| | | | | | | AAGGCC | |
| | | | | | | GCGAGG | |
| | | | | | | CAAAAG | |
| | | | | | | GCGGGT | |
| | | | | | | AACTCG | |
| | | | | | | GCCAGA | |
| | | | | | | CGCTAG | |
| | | | | | | TGATCTT | |
| | | | | | | CGGATC | |
| | | | | | | CGACAG | |
| | | | | | | CCCTGG | |
| | | | | | | CCTTAG | |
| | | | | | | AGGAAC | |
| | | | | | | CCTGGG | |
| | | | | | | ATAAGG | |
| | | | | | | AGCACG | |
| | | | | | | ACGGGA | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | AGGATG TTCCGCA AGGATT TCCCTTC CCATTA GTCAGG GCTGGC AGTTGG TAATATA GCCTTTC TACACA CCACCG TCTTGCA CCCACTA AACCAG TGGGAT ATGCGG GTGGAC TCAATGT AGAAAG GTGTTC CCACTG CCTGACT CGCCAA CTTTATA TGTCTTG TCAACAT AATGGC CCCTCAC TATAAA CTCCCTA GCAACT GGTGGT CCGGCG AAGCCG GTTCTTG CCACTAT TGCGCC CCAGGC TCGCC (SEQ ID NO: 1298) | |
| NeSL | NeSL-4_SM | — | *Schmidtea mediterranea* | TTAAATCATTTTTAAATGTGTTTGAATATCTTAAATTATCAAATCATATTA ATATCAATGCTAAAAAAAAATCGTGCKCATCAGGCGCACGAAAATAATG GACACAACTCGTCGACCTGCTGTCGACTCACAGAGAACCTCAATTTGGA AGAATGGGAAGCCTATAATGCTACAATTCCGCCAACCCCTATTTGAATG ACAGATAGTCAAATATCAAAAAATATACAAACTGCTGTCAAGCGTGACT | TTAAATCA TTTTTAAAT GTGTTTGA ATATCTTA AATTATCA | TGAGTG TGCTAC GAGGCA GCGCTG GTAATT | MNVDLDATIKSIGM NTKETTYPNSQLRVE TTPCTSTTIMHASCN TTSTISYSPLPSAVSLP ESPASSITITTTDDNC |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CACTTCCTTCCAATCGAAAAATAGGAAKATGTAAGAAACATGAAAGTCA | AATCATAT | GCATCG | DIIETPYPLPQTNGDL |
| | | | | AGCTGAAAAACCAATAATATGTCCTAAAATAAAACAATTTGAAAATATG | TAATATCA | GCGTTG | SEILKDIEANKDTTMS |
| | | | | CAAAAAATACCTATAAAATCACAGCCGAATAAATTCCCATCCGTTCTAAG | ATGCTAAA | CAGATTT | NKVLDCDSDSGDDR |
| | | | | CAGAAACCGCTACGAACTACTGCAAGAATCGGATCAAGTATATTAATTT | AAAAAATC | GTGTAC | DMIIENDRESDMDLF |
| | | | | CCCCCCMGGGGGAAATTAATATACTTGTTAKAAAATTAATTTTTTAATAA | GTGCKCAT | GATAGA | SQSLLNTNQSDERRE |
| | | | | AAATAAATAAATCGAATAAATATAAAATAAAAATAAATCAAATTAAACTT | CAGGCGCA | TAAAAA | KNLTENAPTEITTEKS |
| | | | | TTATTAACAATAAAATCGCAGTAAGTAAATTTCCACTGTTATTAAATTTA | CGAAAATA | CCAATA | YFDIISKASDNTTSKKL |
| | | | | AAACAAAATTCCTTTAAAAATGCCTCTCTTTTTCAGTAATAACACCTTTTC | ATGGACAC | GTAATA | LNVKNELTAGLPPMP |
| | | | | TTGCTTTTATTACTATTTCTTGTGTACTGTACAAATCGAGCACAGTTATTG | AACTCGTC | AATGCT | PVTNTAKFIRNVRPE |
| | | | | CAAATAGGACATAGAAATTCCTTTTTAAGTAAATTTAAATCCATGAGAAA | GACCTGCT | GAGCCT | DIADPTLYRLDSRGKL |
| | | | | TAAAATAAAATCCTTTTGATTCAAAGTTTCTATGTTGCTTTCTAATAGAAT | GTCGACTC | AGCTCG | GCRTQYKKPGCGDIA |
| | | | | GGTGTAAGCATTAATGGGTCTTGATTTTTATAAATTAAATATATTTAATC | ACAGAGA | CATATCT | VYDYEAIVEHAAFIHT |
| | | | | TATTAAATTAATATGTTTTTATTAATTATTAATTTTTATAGTGGGGGAAA | ACCTCAAT | AAGCCG | IPFNEQNNVDCQPC |
| | | | | TTAATATACTTGATCCCAAGAATCAACTGATGATGAAGAATATGTTATTT | TTGGAAGA | AAAGGC | HPKKGKDVHTIVLIKY |
| | | | | CAAAATACATACAAGAAGCTGGAAAAAACAAATCAATCGCTACAATGAA | ATGGGAA | AGCATA | ADIFNHIEAHSHVVQ |
| | | | | TGTGGATCTCGATGCAACAATTAAAAGTATTGGAATGAACACAAAAGAG | GCCTATAA | TATATG | TAITDNMKTYLRLTKE |
| | | | | ACGACCTATCCAAATTCACAACTGCGAGTTGAGACGACTCCCTGTACCTC | TGCTACAA | AGACAA | NXFYCSYRNNKKKNK |
| | | | | AACGACTATTATGCATGCATCTTGCAACACAACCAGCACTATATCTTACT | TTCCGCCA | TTTAAAA | CKKAFNLESNMMDI |
| | | | | CTCCATTACCATCGGCTGTGTCACTTCCCGAAAGCCCTGCCTCGTCAATC | ACCCCTAT | AAAAA | TEHMKTHTGYSFDX |
| | | | | ACAATAACCACAACAGACGATAATTGCGATATTATAGAGACCCCTTACC | TTGAATGA | (SEQ ID | NLNILCYCGIWKPFTE |
| | | | | CATTACCTCAAACAAATGGTGACTTGAGTGAAATATTAAAGGATATAGA | CAGATAGT | NO: | LIAHIKTEHLQEYINSI |
| | | | | AGCTAATAAGGACACCACCATGTCGAATAAAGTATTGGACTGTGACTCT | CAAATATC | 1299) | PNKENIHNTTTIVSPL |
| | | | | GACAGCGGCGATGATCGGGACATGATAATAGAAAATGACCGAGAATCT | AAAAAATA | | NFAGILASGETQNIP |
| | | | | GACATGGACCTGTTTTCGCAATCTTTATTGAACACTAATCAATCTGATGA | TACAAACT | | DEEIIKPRDLPENLAF |
| | | | | GAGGAGGGAGAAAAACTTAACAGAAAATGCTCCAACAGAGATTACTAC | GCTGTCAA | | NRNIENELSWSQHLV |
| | | | | TGAGAAGAGCTACTTTGATATCATCAGTAAAGCATCTGATAATACAACCT | GCGTGACT | | KAYIFSYAVKTSTIFIN |
| | | | | CTAAGAAACTGCTTAATGTAAAAAACGAATTGACTGCTGGACTACCTCCT | CACTTCCT | | PYTCNALIQCNYKTFF |
| | | | | ATGCCTCCAGTGACCAATACTGCAAAATTCATTCGAAATGTTCGACCTGA | TCCAATCG | | ETFPFKDFAKWNEIV |
| | | | | GGATATTGCAGATCCTACCCTATATCGACTTGACAGCAGGGGAAAGCTT | AAAAATAG | | LPIHNNTSSWSFFFL |
| | | | | GGATGCAGAACWCAATACAAAAAACCCGGATGCGGGGACATAGCAGT | GAAKATGT | | NKKKRVAMIIDPTAD |
| | | | | ATATGACTATGAGGCGATAGTTGAACATGCCGCATTTATCCACACAATC | AAGAAACA | | DSHTLHFELATDILRTI |
| | | | | CCATTTAATGAACAAAATAATGTGGATTGTCAACCATGCCACCCTAAAAA | TGAAAGTC | | LNVQNIFEDLNFPLTE |
| | | | | AGGAAAAGATGTCCATACAATAGTTCTGATAAAATATGCAGATATCTTT | AAGCTGAA | | VEYPVCHEANLSAFX |
| | | | | AACCATATTGAAGCCCATAGCCACGTTGTGCAAACCGCGATTACAGATA | AAACCAAT | | VCHFLKCLMSDLPIDI |
| | | | | ACATGAAAACCTATCTACGTTTAACAAAGGAAAATTTKTTCTACTGCTCA | AATATGTC | | PDIDHMKETMRPIIR |
| | | | | TATCGTAACAACAAAAAAAAGAATAAATGCAAAAAGGCTTTTAACCTTG | CTAAAATA | | KYNCAKFPESDVRNY |
| | | | | AATCAAACATGATGGACATAACAGAGCACATGAAAACTCATACCGGATA | AAACAATT | | RVLIEDLIYQLNLDTIT |
| | | | | CAGTTTCGACMAAAACTTAAACATTCTATGCTATTGTGGTATCTGGAAG | TGAAAATA | | CEEILCEIERINGRLNP |
| | | | | CCGTTCACAGAGCTCATTGCCCACATCAAGACTGAGCATTTGCAAGAAT | TGCAAAAA | | KRYFKESKPKTDIIHL |
| | | | | ATATTAACTCAATACCAAACAAAGAAAATATCCATAATACTACTACCATA | ATACCTAT | | QKKKSAELLCVKRLKF |
| | | | | GTTTCCCCTCTAAACTTTGCTGGGATACTTGCATCTGGCGAAACTCAAAA | AAAATCAC | | QISQKTEIGKIWEND |
| | | | | TATCCCCGATGAAGAAATAATTAAACCCAGAGATCTGCCAGAAAATCTT | AGCCGAAT | | DVDHRPPMARFLKT |
| | | | | GCCTTCAACCGAAACATCGAAAATGAATTAAGTTGATGGTCGCAGCACT | AAATTCCC | | FASQDCPVSNTSSINL |
| | | | | TGGTCAAAGCATATATCTTCTCTTATGCTGTTAAAACATCAACCATCTTCA | ATCCGTTC | | PYYMDTDTDXCTDC |
| | | | | TCAATCCTTATACTTGCAATGCTTTGATCCAGTGCAACTACAAAACTTTCT | TAAGCAGA | | ENLSHIMKNLDSSAP |
| | | | | TTGAAACCTTCCCTTTCAAAGACTTTGCCAAGTGGAACGAGATAGTCCTG | AACCGCTA | | GMDLITGGDWKKISP |
| | | | | CCAATTCACAACAACACTTCTTCTTGGTCCTTCTTCTTCTTGAACAAGAAA | CGAACTAC | | KHELITAICNCILRNKV |
| | | | | AAACGAGTTGCGATGATTATCGATCCAACTGCAGATGACAGTCATACCC | TGCAAGAA | | CPEKWKLFRTVLILKP |
| | | | | TGCACTTTGAATTGGCTACAGATATCCTAAGGACTATACTTAACGTCCAG | TCGGATCA | | GKMSESFRANSWRP |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AATATATTTGAGGACTTAAATTTCCCTCTTACTGAGGTCGAATACCCCGT | AGTATATT | | LAIMDTAYRIFTTLLN |
| | | | | GTGTCATGAGGCAAACCTTTCCGCATTTTMTGTATGCCACTTTCTTAAAT | AATTTCCC | | NRLLQWIRNGNLISP |
| | | | | GTTTAATGTCGGACTTGCCAATTGATATTCCGGATATCGATCACATGAAA | CCCMGGG | | NQKAIGIPDGCAEHN |
| | | | | GAGACWATGAGACCAATTATTAGAAAATATAACTGCGCAAAGTTTCCG | GGAAATTA | | ATLHFAIDRAKRCKTE |
| | | | | GAGAGTGATGTTAGGAATTACCGCGTACTTATCGAGGACCTGATATACC | ATATACTT | | LHIVWLDIADXFGSLP |
| | | | | AATTGAACCTTGACACAATTACTTGTGAGGAAATACTGTGCGAAATCGA | GTTAKAAA | | HDLIWYTLANMGLK |
| | | | | AAGAATAAATGGAAGGTTAAATCCCAAAAGATATTTTAAAGAGAGTAA | ATTAATTTT | | NETLTLIKELYKDVKTI |
| | | | | ACCAAAGACGGATATAATACATCTGCAAAAGAAAAAGTCGGCGGAACT | TTAATAAA | | FDCQGTLSEPVPITKG |
| | | | | CCTCTGTGTTAAAAGATTGAAATTCCAAATCAGTCAGAAAACAGAAATC | AATAAATA | | VKQGCPLSMTLFCLSI |
| | | | | GGAAAGATATGGGAAAACGACGATGTGGATCACAGACCGCCTATGGCC | AATCGAAT | | DYILKSILTNYPFLLHD |
| | | | | AGATTCTTGAAGACTTTCGCGAGTCAAGACTGCCCCGTTTCGAATACGTC | AAATATAA | | LNISILAYADDLVLLSD |
| | | | | ATCCATAAACCTACCTTACTACATGGATACTGATACAGATAMGTGTACT | AATAAAAA | | SYLEIKKSLESTVELAA |
| | | | | GATTGTGAAAATTTGTCGCACATCATGAAGAACTTGGATAGCTCGGCAC | TAAATCAA | | FANLKFKPSKSGYLSI |
| | | | | CTGGAATGGACCTCATTACAGGTGGAGACTGGAAAAAGATCTCCCCGA | ATTAAACT | | NNVNSDILKLHLYNE |
| | | | | AGCATGAACTGATAACAGCAATCTGCAATTGTATACTACGAAATAAGGT | TTTATTAA | | EIPTISENNKYRYLGV |
| | | | | CTGCCCAGAGAAATGGAAGCTGTTTAGAACAGTTTTAATCCTAAAACCA | CAATAAAA | | DFSYKRNQDVDGRL |
| | | | | GGAAAAATGTCCGAGAGTTTCAGAGCTAACTCATGGAGACCTCTTGCAA | TCGCAGTA | | GSALALTRSLFKSYLH |
| | | | | TCATGGACACAGCCTATAGAATCTTTACGACTCTGCTGAATAACCGCCTG | AGTAAATT | | PAQKLNAYKTFIHSKL |
| | | | | CTGCAATGGATCAGGAATGGCAACCTCATAAGCCCGAACCAAAAGCG | TCCACTGT | | IFSLRNCVIGHRILDC |
| | | | | ATTGGTATACCGGATGGATGTGCTGAGCATAATGCTACTCTACACTTCG | TATTAAAT | | DRNRVTQGREKQLG |
| | | | | CAATTGACCGAGCTAAACGATGTAAAACTGAACTACACATTGTTTGGCT | TTAAAACA | | FDQEIKALLKTMIGD |
| | | | | CGATATCGCCGATKCATTTGGTTCGCTGCCTCATGACCTGATCTGGTATA | AAATTCCT | | KFQAXNNYFPYTHCK |
| | | | | CACTGGCTAATATGGGTCTGAAGAATGAAACACTAACCTTGATTAAGGA | TTAAAAAT | | LGGLGITSAIDEYLIQS |
| | | | | ACTATATAAGGATGTGAAGACTATCTTCGACTGTCAGGGAACCTTGTCC | GCCTCTCT | | ITGITRLFHSSNLSFRK |
| | | | | GAACCTGTCCCAATTACTAAAGGAGTTAAACAAGGTTGCCCATTATCAAT | TTTTCAGT | | MLITELAHSRGGKNF |
| | | | | GACACTCTTCTGCCTGTCTATTGACTACATTCTAAAGTCAATACTGACTA | AATAACAC | | EAGLKWLNCEVNKA |
| | | | | ATTATCCCTTCCTTCTTCATGATCTGAACATCAGTATTTTGGCATATGCTG | CTTTTCTTG | | FPNTSFFVKFQKSALA |
| | | | | ATGACTTGGTTCTTCTTTCTGACTCTTATCTAGAAATCAAAAAATCTTTAG | CTTTTATTA | | LKRKFCICVNLKFVED |
| | | | | AGAGTACTGTGGAATTGGCAGCMTTTGCCAACCTTAAGTTTAAACCTTC | CTATTTCTT | | NFSLEMTYKKRTSYV |
| | | | | GAAGTCTGGATACTTGTCCATCAACAATGTTAACTCCGATATCCTTAAAT | GTGTACTG | | NHQNLSTLSKELHDF |
| | | | | TACATCTCTATAATGAGGAGATACCAACGATATCCGAGAATAACAAATA | TACAAATC | | VGLYYAEQXCQMRV |
| | | | | CAGATATCTTGGAGTTGACTTCTCTTACAAAAGAAATCAGGATGTTGAT | GAGCACA | | QGHIATAIGDSITAKY |
| | | | | GGACGACTTGGGTCTGCACTTGCACTCACCAGATCTCTATTTAAATCATA | GTTATTGC | | LIASDILNDAQYYFLV |
| | | | | CTTGCATCCGGCGCAAAAGCTGAATGCTTACAAAACCTTCATCCACTCCA | AAATAGGA | | RARNNLLNLNYNAYR |
| | | | | AGCTTATCTTCTCCTTGCGTAATTGCGTGATAGGTCATAGAATCCTCGAC | CATAGAAA | | LKYNIGTKCRLCHLDE |
| | | | | TGTGATCGGAATAGAGTTACACAAGGTCGGGAAAAACAGCTGGGCTTT | TTCCTTTTT | | ETQAHXFNHCRAKP |
| | | | | GATCAGGAAATCAAGGCACTWCTGAAAACCATGATTGGAGACAAATTT | AAGTAAAT | | NARRVKHENVLVSIV |
| | | | | CAGGCAKTAAATAACTACTTTCCTTACACTCACTGCAAGCTGGGGGGAC | TTAAATCC | | AFLEKIGFEIDVEKSPK |
| | | | | TTGGTATAACCTCAGCTATTGATGAATATTTGATCCAAAGCATTACCGGA | ATGAGAAA | | YISIPTKLKPDMVIRSK |
| | | | | ATAACAAGATTATTTCACTCATCCAACCTCAGCTTCAGAAAAATGCTAAT | TAAAATAA | | RNKDIHVLDLKVPYD |
| | | | | CACAGAACTCGCTCATTCTAGAGGAGGGAAAAACTTTGAAGCGGGGCT | AATCCTTT | | SGEGFEKAREDNYVK |
| | | | | AAAATGGCTTAACTGTGAAGTTAACAAGGCATTCCCCAACACCTCTTTCT | TGATTCAA | | YKDLAIEIGKAFNQKA |
| | | | | TTGTAAAATTCCAAAAATCGGCACTTGCTCTTAAAAGAAAGTTCTGTATA | AGTTTCTA | | TISAVVIGCLGTWDK |
| | | | | TGCGTTAACCTTAAATTTGTAGAGGACAATTTCTCACTTGAGATGACCTA | TGTTGCTT | | KNNAALSKIGLTKTEII |
| | | | | CAAAAAGCGCACTTCTTATGTAAACCATCAAAACCTCAGCACACTTTCCA | TCTAATAG | | SLARIACPNAVIACYH |
| | | | | AAGAACTCCACGACTTCGTGGGCCTTTACTATGCWGAGCAATGWTGTC | AATGGTGT | | IYREHVSFTKSAMAL |
| | | | | AAATGAGAGTACAAGGACACATTGCGACTGCGATCGGGGATAGCATAA | AAGCATTA | | PFSLA (SEQ ID NO: |
| | | | | CAGCTAAATACCTAATAGCTAGTGACATCCTTAACGACGCACAGTACTAC | ATGGGTCT | | 1421) |
| | | | | TTCTTGGTACGTGCGAGAAATAATCTTCTGAATCTTAACTACAATGCGTA | TGATTTTT | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCGACTCAAGTATAATATTGGCACAAAGTGCAGACTTTGCCACCTTGAT<br>GAAGAAACTCAGGCCCATSTGTTCAATCACTGCCGTGCCAAACCAAACG<br>CTAGAAGAGTGAAACACGAAAATGTGCTAGTAAGCATAGTTGCCTTCCT<br>AGAGAAAATTGGATTTGAGATTGATGTGGAAAAATCACCCAAATATATC<br>TCAATACCAACAAAGCTGAAACCTGACATGGTAATTAGGTCTAAGAGGA<br>ATAAAGATATACATGTCCTAGACCTAAAAGTGCCATATGACTCAGGAGA<br>AGGCTTTGAAAAAGCGCGGGAAGACAACTATGTTAAATACAAAGATCT<br>AGCCATTGAAATTGGAAAGGCATTTAATCAAAAAGCGACTATATCTGCT<br>GTGGTGATTGGATGCCTGGGCACATGGGACAAGAAGAACAATGCCGCT<br>CTTTCCAAAATCGGGTTGACTAAGACCGAGATCATATCTCTTGCCAGGAT<br>AGCATGCCCAAATGCGGTAATCGCATGCTATCACATATACCGTGAGCAC<br>GTCTCATTTACAAAGAGTGCCATGGCCCTCCCCTTCAGCCTTGCATGAGT<br>GTGCTACGAGGCAGCGCTGGTAATTGCATCGGCGTTGCAGATTTGTGTA<br>CGATAGATAAAAACCAATAGTAATAAATGCTGAGCCTAGCTCGCATATC<br>TAAGCCGAAAGGCAGCATATATATGAGACAATTTAAAAAAAAA (SEQ ID<br>NO: 1053) | ATAAATTA<br>AATATATT<br>TAATCTAT<br>TAAATTAA<br>TATGTTTTT<br>ATTAATTA<br>TTAATTTTT<br>ATAGTGGG<br>GGGAAATT<br>AATATACT<br>TGATCCCA<br>AGAATCAA<br>CTGATGAT<br>GAAGAATA<br>TGTTATTT<br>CAAAATAC<br>ATACAAGA<br>AGCTGGAA<br>AAAACAAA<br>TCAATCGC<br>TACA (SEQ<br>ID NO:<br>1176) | | |
| NeSL | R5 | AY216701 | *Girardia tigrina* | GTAGGTAACTATGACTGCAAAATAATAATTCTACACCTATTGTTGATAAC<br>TCATCTCGTGCGCAAACGGAGCATGTTATTTCTAATCATTTCGTCACACA<br>GGATTCTTCTAATTCTGATAGTAATATTATAGATAGAGATAGGAACCTTG<br>TTGATTTAGATGCGTCAATAACTTCTCCTACTATTATACAGCCAGAGGAT<br>AGTAAGATATCTGAGGATGAGGACTTCATCTTAGTCAATAGGAAAAAGA<br>GCAAAAATAAGAAAAAATCTAAGAAAACAACTGAAAATAAAAATGAAA<br>TTCCTATTCAAAAGAGTAAAGATAAGAAAAAGAAGTCTAAAATTAATAC<br>CGAAAAACTAACTGAAAATATTACTACTTCTGAAATACCACTTGAAATTG<br>CTCCTTCCATACCTTTACCTTCAGCAAGTACCTCGGGTTCTCAACAACCG<br>GCCAATCCTCCAGAAGACGCTACTCTAAGTGATACGGATCTCTTCCTTAC<br>ACAGGATGATCCCGATAGTCTTATTCTTTCTGGAAGTACTCAACCAACCT<br>TTGTTGACCTCAACCCTTCACAGCAATCGGAACTTCCTTCAAATACTGAC<br>AGCCAAAGATTTGAGGCGGGTGAAACACCCAAAATCATAACTTCTTACA<br>GGGATGACCTTTTCTACTCTACAGTCCTTCACTACAACTCAGATACAGGT<br>TACGGTATAAGTGTTGACAATGGGGAGCAGAGGTTTCGAATTCTTGCTA<br>GGAATCTTGTCAGGAAAACCAAGGATAAGTTCCCCTCTTTATATGCTGG<br>ACAAGTAATTAGACACACAGTCTTCTTCAATCACTTCAACCAGGCATACT<br>ACGCCAATAATATAACTGATAGTAAAGGTAATCTAATTGAGTTTTCTGAT<br>GATAAGCCTTTTCAAAGTATACCGACTGACCCAAAAACTGAACTAGAGC<br>AAATTAGGAGAGAGAGACAACATCTAGTTGATAGAGCTCTTAGACATAA<br>TCAGTTACGGGAAACTTATATTTTAAATAAACTTAATAATAATAATGGGG<br>GGGGTGGCGAACATTTGAAAAGGAAAAAGATCAAAGTCAATACGGATG<br>ATGTCTCCAGCAATGATGGAGACAGAAAACATAGACGACAGGAAGAAA<br>CCTCGGACAATGGAGCTGCTATTCCCGCTCAATCCAACAATCAAATTACT<br>CCTTTAAACTGAGTTCGACTGAAGTGGGAGAGCTCGTTGAGCAATCTCC | GTAGGTAA<br>CTATGACT<br>GCAAAATA<br>ATAATTCT<br>ACACCTAT<br>TGTTGATA<br>ACTCATCT<br>CGTGCGCA<br>AACGGAG<br>CATGTTAT<br>TTCTAATC<br>ATTTCGTC<br>ACACAGGA<br>TTCTTCTA<br>ATTCTGAT<br>AGTAATAT<br>TATAGATA<br>GAGATAG<br>GAACCTTG<br>TTGATTTA<br>GATGCGTC<br>AATAACTT<br>CTCCTACT<br>ATTATACA<br>GCCAGAG | TGATCC<br>GTGTGT<br>TTGTGTC<br>GTATGA<br>TTGTTTC<br>CGTGTG<br>TGTCTAT<br>ATTTTTC<br>TTTTTTA<br>TACTTTC<br>AATTACC<br>TCGTTGT<br>AATGTT<br>ATAACTT<br>CATATG<br>GAATAT<br>ATGTAA<br>TTTAGTT<br>TAGTTTA<br>GTTAGTT<br>TAGTTTA<br>GTTTAGT<br>TTAGTTT<br>AGTTAG<br>TTTAGTT | TTGRNLGQWSCYSR<br>SIQQSNYSFKLSSTEV<br>GELVEQSPAPLQSPQ<br>FSNNYNNLNINNNLY<br>YSLNTFNQSNNLCCL<br>VNIEFFPTQHLLGDIV<br>NSGCINYMNNYNNF<br>DNINLYINSNVLSYNN<br>YNHSFLASPYTTNITE<br>HADINMHVQEVNM<br>QQDNNTQHAITQQV<br>SLQATSLQHTLDEMI<br>VQFNTAVRLKKKHKV<br>AKIFRGHNHRKDLPT<br>LPAREQYKTKPKLAIR<br>EVLHRKTTATSSPSEN<br>AIKAFFSSYSRPAELFT<br>GQELLESSWFPVHPE<br>DDFEFRIPGRDQIAKY<br>IKFASKSAAGLDWITY<br>EDIKLGDPSGEILQPIF<br>EYIVQNNICPSEGKAS<br>RTIMIPKPGKSDYSDP<br>SSWRPITITSAVYRLL<br>MKYLTWELYNWILL |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGCTCCCCTTCAGTCGCCTCAGTTCTCTAACAATTATAACAATCTAAATAT | GATAGTAA | AGTTTA | NQMLSRSQKSLGKFE |
| | | | | CAACAACAACTTATACTATAGTCTCAATACTTTTAATCAGTCTAATAACCT | GATATCTG | GTTAGT | GCHDHNAMLNMLI |
| | | | | TTGCTGTCTTGTTAATATTGAGTTTTTCCCAACTCAACACCTTCTTGGTGA | AGGATGA | (SEQ ID | QDVRRQTNPSNPIN |
| | | | | TATAGTTAACTCGGGGTGCATAAACTATATGAATAATTATAATAACTTTG | GGACTTCA | NO: | KNKRLYIVFLDFTNAF |
| | | | | ATAATATTAATTTATATATTAATAGTAATGTATTATCTTACAATAATTATA | TCTTAGTC | 1300) | GSVPLDTLMYVPQRF |
| | | | | ATCACAGTTTTCTCGCTTCCCCATATACTACTAACATCACAGAACATGCA | AATAGGAA | | GLGTSALTLIKNLYLD |
| | | | | GACATAAACATGCACGTGCAAGAAGTTAACATGCAGCAAGATAACAAT | AAAGAGC | | NYTNVTCGESKIENV |
| | | | | ACACAACATGCTATAACACAACAAGTCTCTCTACAAGCAACATCTCTGCA | AAAAATAA | | KLNKGVKQGCPLSM |
| | | | | ACACACGTTGGACGAAATGATAGTCCAGTTTAACACTGCTGTCAGGTTA | GAAAAAAT | | LLFNIFINIIIRAIEAMP |
| | | | | AAGAAAAAGCACAAAGTTGCAAAAATCTTTAGGGGACATAATCATCGTA | CTAAGAAA | | DVHGYPLGDMDIRIL |
| | | | | AAGACCTTCCAACATTGCCTGCTAGGGAACAGTATAAAACTAAACCGAA | ACAACTGA | | AYADDIALISDSHKDL |
| | | | | ACTTGCAATTAGAGAGGTACTTCATCGAAAAACAACAGCTACGTCTTCCC | AAATAAAA | | QEMVYKAEYIGRILGL |
| | | | | CTTCTGAAAATGCAATTAAGGCTTTTTTCTCCTCCTACAGCCGTCCAGCT | ATGAAATT | | LFNPSKCALMDIPHD |
| | | | | GAACTTTTCACTGGTCAGGAACTTCTTGAATCATCTTGGTTCCCAGTACA | CCTATTCA | | KKRTPPILVNGEMIKC |
| | | | | CCCGGAAGATGACTTTGAGTTTAGAATTCCGGGTAGAGACCAAATAGC | AAAGAGTA | | VGKADPYKYLGTFRS |
| | | | | GAAATACATCAAGTTTGCTAGTAAATCAGCTGCTGGTCTTGACTGGATC | AAGATAAG | | WFRKLDIKELLQMM |
| | | | | ACGTACGAGGATATTAAGTTAGGCGATCCGTCCGGGGAAATTCTCCAAC | AAAAAGA | | MDETKLITESNLHPH |
| | | | | CCATTTTTGAATATATAGTACAAAATAACATATGCCCATCCGAGGGGAA | AGTCTAAA | | QKIHAYETFIHSQLPF |
| | | | | GGCTAGTAGGACCATTATGATTCCCAAACCGGGAAAAAGTGACTATTCA | ATTAATAC | | HLRHSRIPFSDFITNR |
| | | | | GATCCTTCTTCTTGGCGGCCCATTACAATTACCAGCGCAGTATACAGACT | CGAAAAAC | | KTNKTTNNSNDSEKS |
| | | | | TCTCATGAAATATCTTACATGGGAGCTGTATAACTGGATTCTTCTTAATC | TAACTGAA | | IQKAYDPESGQLFLN |
| | | | | AGATGCTGTCCAGGAGCCAAAAGAGTTTAGGGAAGTTTGAGGGATGTC | AATATTAC | | TFALPSGCAKDFFYIT |
| | | | | ATGATCACAACGCAATGTTGAACATGCTCATCCAAGACGTTAGGAGACA | TACTTCTG | | KDAGGPQLTSGLDEY |
| | | | | GACCAACCCGTCTAATCCAATCAATAAGAATAAGAGGCTATACATAGTC | AAATACCA | | LIQSIMYIFRLLGSEDP |
| | | | | TTCCTAGACTTTACGAATGCTTTCGGGTCGGTTCCGTTAGATACTCTCAT | CTTGAAAT | | TLNSAIKHDLISHLNL |
| | | | | GTATGTCCCTCAACGCTTTGGCTTAGGCACCTCTGCTTTAACGCTGATTA | TGCTCCTT | | KGFVNINFSQAISIFN |
| | | | | AAAACTTATATCTAGATAACTACACAAATGTAACATGTGGGGAAAGCAA | CCATACCT | | SNFTDRTDHFSHLSR |
| | | | | AATAGAAAACGTAAAATTAAATAAAGGGGTTAAGCAAGGCTGCCCTCTA | TTACCTTC | | TEWARLQLARKKLKS |
| | | | | TCTATGCTGCTTTTCAACATTTTTATCAATATTATAATTAGGGCAATAGAA | AGCAAGTA | | TLAIQTNVCLINGHLV |
| | | | | GCTATGCCAGATGTCCATGGATACCCACTTGGAGATATGGACATCCGGA | CCTCGGGT | | LTLSLENNVLLIDSKEK |
| | | | | TACTGGCATATGCTGATGATATTGCTCTAATATCTGACTCCCACAAAGAC | TCTCAACA | | GDVKKIHASLMGFLR |
| | | | | CTGCAGGAAATGGTCTACAAGGCGGAATATATCGGTCGGATTCTTGGAC | ACCGGCCA | | LAHLIRLQKHGWSKL |
| | | | | TACTCTTCAACCCGTCAAAATGTGCACTTATGGACATTCCGCACGACAAG | ATCCTCCA | | LFSATTHHEILNKRIL |
| | | | | AAGAGGACGCCGCCTATCCTCGTCAACGGTGAGATGATCAAGTGTGTTG | GAAGACG | | NGHVPYKIWYFIHRA |
| | | | | GAAAGGCCGACCCATACAAATATCTTGGAACCTTTAGATCCTGGTTCCG | CTACTCTA | | RLGLLPTKLFSVSNLC |
| | | | | GAAGCTGGATATAAAGGAGCTCCTCCAGATGATGATGGATGAGACTAA | AGTGATAC | | RKCGGKKETMSHAL |
| | | | | ACTCATCACCGAGTCAAATCTACATCCTCACCAAAAAATCCACGCGTATG | GGATCTCT | | VNCPMMQTLINERH |
| | | | | AGACCTTCATTCACAGCCAGCTCCCATTTCACCTTAGACACAGCCGAATT | TCCTTACA | | DALEISLVQILSSKFQ |
| | | | | CCGTTCTCAGACTTCATAACAAACAGAAAAACAAACAAAACAACAAACA | CAGGATGA | | GTVIRQKTYVNELRP |
| | | | | ATTCAAACGACTCAGAAAAATCTATACAGAAAGCCTACGATCCGGAATC | TCCCGATA | | DITMESDTQYYLVEV |
| | | | | AGGACAATTATTCCTCAACACCTTCGCCCTTCCAAGTGGATGTGCTAAGG | GTCTTATT | | KCPFDTKMSFELRTQ |
| | | | | ATTTCTTTTACATTACAAAAGATGCAGGTGGACCTCAACTCACAAGCGG | CTTTCTGG | | QTTDKYNIIIEILEDVH |
| | | | | ACTGGATGAGTACTTAATCCAATCAATTATGTACATCTTCCGACTATTGG | AAGTACTC | | PGKEVRLVTFIVGTLG |
| | | | | GCAGTGAGGACCCCACCTTAAACTCTGCAATAAAACATGATCTCATTTCC | AACCAACC | | SWGPQNSDFLRDLG |
| | | | | CACTTAAATTTAAAGGGTTTTGTAAATATTAATTTTTCTCAAGCCATTTCA | TTTGTTGA | | FSKDEIDQVKTRLML |
| | | | | ATCTTTAATTCAAATTTTACCGACCGAACCGATCACTTTTCACATCTTAGC | CCTCAACC | | QNINSSCEQWKRFV |
| | | | | CGCACTGAATGGGCAAGACTTCAATTAGCTCGGAAAAAATTGAAGTCAA | CTTCACAG | | QYAPTITPGPIPDAES |
| | | | | CCTTAGCCATCCAAACTAATGTCTGTCTGATAAATGGGCATCTTGTCTTA | CAATCGGA | | EDDQGTSDNGPTAA |
| | | | | ACTCTTTCGCTAGAAAACAACGTTCTGTTAATTGATAGTAAAGAAAAGG | ACTTCCTT | | TVQGPVIGDEEEELQI |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGGATGTCAAGAAGATCCATGCATCCCTCATGGGGTTTCTTAGGTTAGC<br>TCACCTTATCAGACTGCAAAAACATGGATGGTCAAAACTGCTCTTCAGT<br>GCGACCACTCATCACGAAATACTAAATAAGCGTATCTTGAATGGTCACG<br>TCCCTTATAAGATTTGGTACTTTATTCATAGGGCGCGGCTGGGGTTGTTG<br>CCTACTAAACTCTTTAGTGTTAGTAACCTTTGTAGGAAGTGCGGGGGGA<br>AGAAAGAGACCATGTCGCATGCTTTGGTCAACTGTCCAATGATGCAGAC<br>CCTCATTAATGAGAGACATGATGCTCTTGAAATCTCCCTTGTACAAATTC<br>TTTCTTCTAAATTTCAGGGTACGGTTATAAGGCAAAAGACCTATGTCAAC<br>GAGTTAAGACCCGATATCACAATGGAATCGGATACCCAATATTATCTTG<br>TTGAGGTAAAATGCCCCTTTGACACGAAGATGAGTTTTGAATTGAGAAC<br>ACAACAAACTACTGATAAATACAACATTATTATTGAAATATTAGAAGATG<br>TACACCCTGGGAAGGAGGTGCGCCTTGTTACGTTTATTGTAGGCACCTT<br>AGGCTCATGGGGCCCGCAGAACTCGGACTTTTTGAGAGATCTGGGATTC<br>TCCAAAGACGAAATCGACCAGGTGAAGACGCGGCTGATGCTTCAGAAT<br>ATCAATTCCTCCTGCGAGCAGTGGAAAAGATTTGTGCAATATGCACCCA<br>CAATTACACCTGGGCCGATTCCAGACGCGGAGAGCGAGGACGATCAGG<br>GGACGAGCGACAATGGGCCAACAGCTGCTACAGTGCAAGGACCGGTGA<br>TTGGCGATGAGGAGGAGGAACTTCAAATCTACGATTCCGGCCTTGACG<br>AGTCCAGCGATGATGAACCCGACCCAGATGATGCTGAATTACTTTTCAC<br>AATTGACATAGAACAATATTTGAATTCTGTGATAACAGACTGATCCGTGT<br>GTTTGTGTCGTATGATTGTTTCCGTGTGTGTCTATATTTTTCTTTTTTATAC<br>TTTCAATTACCTCGTTGTAATGTTATAACTTCATATGGAATATATGTAATT<br>TAGTTTAGTTTAGTTAGTTTAGTTTAGTTTAGTTTAGTTTAGTTAGTTTAG<br>TTAGTTTAGTTAGT (SEQ ID NO: 1054) | CAAATACT<br>GACAGCCA<br>AAGATTTG<br>AGGCGGG<br>TGAAACAC<br>CCAAAATC<br>ATAACTTC<br>TTACAGGG<br>ATGACCTT<br>TTCTACTCT<br>ACAGTCCT<br>TCACTACA<br>ACTCAGAT<br>ACAGGTTA<br>CGGTATAA<br>GTGTTGAC<br>AATGGGG<br>AGCAGAG<br>GTTTCGAA<br>TTCTTGCT<br>AGGAATCT<br>TGTCAGGA<br>AAACCAAG<br>GATAAGTT<br>CCCCTCTTT<br>ATATGCTG<br>GACAAGTA<br>ATTAGACA<br>CACAGTCT<br>TCTTCAAT<br>CACTTCAA<br>CCAGGCAT<br>ACTACGCC<br>AATAATAT<br>AACTGATA<br>GTAAAGGT<br>AATCTAAT<br>TGAGTTTT<br>CTGATGAT<br>AAGCCTTT<br>TCAAAGTA<br>TACCGACT<br>GACCCAAA<br>AACTGAAC<br>TAGAGCAA<br>ATTAGGAG<br>AGAGAGA<br>CAACATCT<br>AGTTGATA | | YDSGLDESSDDEPDP<br>DDAELLFTIDIEQYLN<br>SVITD (SEQ ID NO: 1422) |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | GAGCTCTT<br>AGACATAA<br>TCAGTTAC<br>GGGAAACT<br>TATATTTTA<br>AATAAACT<br>TAATAATA<br>ATAATGGG<br>GGGGGTG<br>GCGAACAT<br>TTGAAAAG<br>GAAAAAG<br>ATCAAAGT<br>CAATACGG<br>ATGATGTC<br>TCCAGCAA<br>TGATGGAG<br>ACAGAAAA<br>CATAG<br>(SEQ ID<br>NO: 1177) | | |
| NeSL | Utopia-<br>1B_CPB | — | *Chrysemys pictabellii* | GTTTAATTCCTTCTGATGGACATCTGCAACACCCGTCCTGAAGATGGAGT<br>CTCCTGCWKCCATTTTTGAAAAAATTGATGCTGCCTTGMAGATATACTC<br>CGCTGCTGCTGMTTTGGAWGAMAATTCTCTCTCTCTCTCACCTWCAGM<br>TGCASTCWCGTCAMCTSCTGCTGCTCCTGCGTCCTCTACTCCCCAGAAA<br>ACTCAGWGGAAGCCTATCCCGAAKACCACTCTTGGTGCCTCACGGAAG<br>AMCMGGACCACCASCAAGGATGAAAAMATCAGSASCTGGCKGAAGAA<br>AGCCCCTGTGGATACCTCTKCAGGGAGAMCTAGCACCAGAAGGACAGC<br>TCTTCGGGACCTCACATCCAGGAGCAGKAATATCWCAMCAGCTCTTCA<br>GGAGGAGGACCCCCGGAGAACCCCTCCCWCTTCCCGGGACCAGGATGC<br>TGAGCGCCGCCCTGCTGCTCCTGAGAAGGCTGCTACCAGAGGAGCCCCC<br>CCGACGATCCAGGACCAGGATGCTGATCGCTGCCCTGCTGGGAGGGAT<br>GCCACCGGAGGAGCCCCCCGACGACCCAGGACCAGGATGCTGANCGCT<br>GCCCCGCTGGGAAGGATGCCGCCGGAGGAGCCCCCCCCGACGACCCGG<br>GACCAGGATGCTGACCGCCGCCCCGCTGCTCCAGAGAGGGATGCTCCM<br>GAAGGAACCACCTCCTCAACCCCGGACCCCGAAACCACTTACCACCCGC<br>CTGTCCGGAGGAGGGCCGCTCCAAGGGGAACGCACTCCGSAGCCCWG<br>GATCTCGATGCCGCACGCTGTCCTTCCGGGCAAAGAGACATCGTGGCCA<br>GTGAGTCCAGCACCCCCCCAGGAGCGACTTCACCTCCTCAAGCTTCTCTG<br>CCAGACCSAGAGGAATCACCTGCCGAGTCKGCAGGCACAACAGAGGTC<br>CGCCCCACAGAGGGTGAGGCAGGGGAAGACGACTGCATCTACCTCCAG<br>TACCCGMTCCCTACAGGCCTCCTCCTCTGCCCCTTCTGCCTCCCCKTCCAT<br>GGAGTCCAGACCCTCGGGGCCCTCAGCAAACACGTTCGKAAGGCCCAC<br>AACAAACGGATTGCCTTCCGGTGTAGCCGCTGCGATGCACCMTTCGAG<br>ACTCAAAAGAAATGCAAGTMCCATCAMGCCACATGCAAGGGACCCCTC<br>ACAACCGCGAAGGTSAACCCCACTGACACCCTGCGGGTTCCAACCCCGA<br>CCCCCACCGACGGTCCAGCTTCAGCACCCCAGCCAGCATCCCCAGAGCC<br>ACAGCANGTAAGGGGGGACCAACCGCCAACCGAGGGAAGCGCAACCC | GTTTAATT<br>CCTTCTGA<br>TGGACATC<br>TGCAACAC<br>CCGTCCTG<br>AAG (SEQ<br>ID NO:<br>1178) | TAACCG<br>AGACCG<br>CCGACC<br>AGGGAA<br>ATAACC<br>CACTTCC<br>TTCCCTG<br>ACGAAC<br>CAAGGG<br>ACGCAC<br>CCCACCC<br>ATGTACT<br>TATTCGC<br>TACACC<br>GATACT<br>GACTTG<br>GACTCCT<br>TATACAT<br>TCCATG<br>GGTGGC<br>GTACCC<br>GAGCCC<br>ACTTATC<br>CACTGA<br>CACTTTA<br>AAAACT<br>CTTGCAC | MESPAXIFEKIDAALX<br>IYSAAAXLXXNSLSLSP<br>XXAXXSXXAAPASST<br>PQKTQXKPIPXTTLG<br>ASRKXRTTXKDEXIXX<br>WXKKAPVDTSXGRX<br>STRRTALRDLTSRSXN<br>IXXALQEEDPRRTPPX<br>SRDQDAERRPAAPEK<br>AATRGAPPTIQDQD<br>ADRCPAGRDATGGA<br>PRRPRTRMLXAAPLG<br>RMPPEEPPPTTRDQ<br>DADRRPAAPERDAP<br>EGTTSSTPDPETTYHP<br>PVRRRAAPRGTHSXA<br>XDLDAARCPSGQRDI<br>VASESSTPPGATSPP<br>QASLPDXEESPAESA<br>GTTEVRPTEGEAGED<br>DCIYLQYPXPTGLLLC<br>PFCLPXHGVQTLGAL<br>SKHVRKAHNKRIAFR<br>CSRCDAPFETQKKCK<br>XHXATCKGPLTTAKV<br>NPTDTLRVPTPTPTD<br>GPASAPQPASPEPQX |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCGCCTCGAGGACTGACGATGCCACCAAAAGGACCAGCCCCGCCTCCAG | | CCCAATC | VRGDQPPTEGSATPA |
| | | | | AATCCCCACGCTGGACCCTGCCGTGAGGGGGATCACCGCCACCTCSCAG | | TGGGTC | SRTDDATKRTSPASRI |
| | | | | GTCAGCGACCTCACCAGATGCCTCAGCGACCTCATAAAAACCATCCGGC | | TATGCC | PTLDPAVRGITATSQ |
| | | | | ACAACACGGATACGAGACGGKGCAGCGCTCCCCCACAGGTMACCTCAT | | GGTTAT | VSDLTRCLSDLIKTIRH |
| | | | | GCCGCCCTGCCGTAGGAGCAACTAGCACTGCCCCCAGGCCGCACGGC | | GCGATA | NTDTRRXSAPPQVTS |
| | | | | GAGACCCAGCCAACGGAGGAGCCTCCCGCAGCCCCCAGATCCCACGGC | | TGTATGT | CRPAVGATSTAPQA |
| | | | | CGGACCCCGCCCCCGGGAGACCCAACACCTCCTCCAAGGTTACCCAACG | | ATCTCTT | ARRDPANGGASRSP |
| | | | | AGACTCCGACCGCCAAAAACCCCATGCCCCACCGAGGACCCCCCAGCCG | | CATCCTT | QIPRPDPAPGRPNTS |
| | | | | GATACCACCCGCAGAAGAACCAGAACCATCCCCAGCGCTTCCAAACACG | | GCAACC | SKVTQRDSDRQKPH |
| | | | | ACCGCGCCCCCACAAAGCCCAACACCGGTGTTTCCAGAACCCCACTCCCT | | GATACC | APPRTPQPDTTRRRT |
| | | | | CCCGGAAGATCCAGCGCTGCCTCGGAGACACCGAGAGCTGCCCCCCCCC | | TGTAATC | RTIPSASKHDRAPTKP |
| | | | | CACCGCACCAGGACCCCCGCCTCAAGACCCACCTGAACACCGCTCCCCA | | CCTCATA | NTGVSRTPLPPGRSS |
| | | | | GTCCGAGGGACAACAAGGCCACAGACTGTCTCCGCAGCACCTGAACCC | | ACCCAA | AASETPRAAPPPPHQ |
| | | | | GCGGAGACAACGCAGCAGGAGGAACGACGGCCGCGAGCAGAGGGTCG | | GCCTGA | DPRLKTHLNTAPQSE |
| | | | | CCACGCCGTGGCAATCCGCCTGGATGGAGGAGCTGGCAAAGGCTGAGG | | CCCCAG | GQQGHRLSPQHLNP |
| | | | | ACTTCGAGACCTTCGACACCCTGATGGACAGACTGACCGCAGAACTGTC | | ATGTAC | RRQRSRRNDGREQR |
| | | | | TGCGGAAATTACAGCCAGAAGGAGGGAACCCCAGGAGGCCTCACGGG | | AGTACC | VATPWQSAWMEEL |
| | | | | CCACGCGCAGATTCCCCGCGCCGACCCGTAACAACACTGCCAGAGAAG | | TTCCCTC | AKAEDFETFDTLMDR |
| | | | | GCAGGAGAGGGGACGTCGGCCGCCGCTACGATCCGGCAGCTGCATCCC | | TTAACTC | LTAELSAEITARRREP |
| | | | | GTATTCAGAAACTATACAGGACGAACCGGACGAAAGCCATGAGGGAGA | | GTGTAT | QEASRATRRFPAPTR |
| | | | | TCCTCGACGGGACCTCCTCCTACTGTGCCATCCAGCCCGAGAGACTCTAC | | ATTTAAT | NNTAREGRRGDVGR |
| | | | | TCCTACTTCAAGGATGTGTTCGACCACGAGGCCCAGACCAACTTGCAAC | | TTTAAAC | RYDPAAASRIQKLYRT |
| | | | | GCCCAGAGTGCCTTCTCCCGCTACCCCGGATCAACCTCACGGAGGACCT | | ATTAACT | NRTKAMREILDGTSS |
| | | | | GGAGCGAGATTTTTCCCCGCAGGAGGTGCAGGCGAGGCTGATGAGGAC | | TTAATAA | YCAIQPERLYSYFKDV |
| | | | | CAAAAACACTGCCCCTGGAAAAGATGGCATCCGCTACCACCTGCTGAAG | | AATTTTT | FDHEAQTNLQRPECL |
| | | | | AAGCGAGACCCCGGCTGCCTGGTGCTTGCTGCCATCTTCACCAAATGCA | | AAA | LPLPRINLTEDLERDF |
| | | | | AGCAGTTTCATCGCGTTCCCCGCTCCTGGAAAAAGTCCATGACCGTGCTC | | (SEQ ID | SPQEVQARLMRTKN |
| | | | | ATCCACAAAAAAGGCGAGCGAGACGACCCCGGCAACTGGAGGCCCATC | | NO: | TAPGKDGIRYHLLKK |
| | | | | TCCCTCTGCTCCACCATCTACAAGCTGTATGCCAGCTGCCTCGCGGCAAG | | 1301) | RDPGCLVLAAIFTKCK |
| | | | | GATCACGGACTGGTCAGTGTGCGGGGGCGCCGTCAGCTCAGTACAGAA | | | QFHRVPRSWKKSMT |
| | | | | GGGTTTCATGTCCTGCGAGGGATGCTACGAGCACAACTTCCTCCTTCAG | | | VLIHKKGERDDPGN |
| | | | | ACGGCCATCCAGGAAGCCAGGAGGTCCAAGAGGCAGTGCGCCGTAGCA | | | WRPISLCSTIYKLYAS |
| | | | | TGGCTTGACCTGACCAACGCCTTCGGGTCCATACCCCACCATCACATCTT | | | CLAARITDWSVCGG |
| | | | | TGCCACCCTGGGAGAGTTCGGGATGCCAGAAACCTTCATCCAGATCCTC | | | AVSSVQKGFMSCEG |
| | | | | CGGGACCTCTACAAGGACTGCACCACCACCATCCGCGCCACGGACGGA | | | CYEHNFLLQTAIQEA |
| | | | | GAGACGGACGCCATCCCCATCCGCCGCGGCGTGAAACAAGGATGCCCC | | | RRSKRQCAVAWLDL |
| | | | | CTCAGCCCCATCATCTTCAACCTGGCCATGGAACCGCTCATCCGAGCCAT | | | TNAFGSIPHHHIFATL |
| | | | | CTCCAGCGGCCCGACCGGCTTCGACCTGCACGGCAAGAAAATCAGCATT | | | GEFGMPETFIQILRDL |
| | | | | CTGGCCTACGCGGACGATCTGGCCCTGGTCGCCGACAGCTCGGAAAGC | | | YKDCTTTIRATDGET |
| | | | | CTCCAGCAAATGCTCGACGTCACCAGCCAAGCCGCCGAGTGGATGGGC | | | DAIPIRRGVKQGCPLS |
| | | | | CTCCGCTTCAACCCCAAAAAGTGTGCCTCCCTCCACGTCGACGGTGGCG | | | PIIFNLAMEPLIRAISS |
| | | | | CCAGGGCGCTGGTCCGGCCATCACGATTCCTGATCCAGGGCGAGCCCAT | | | GPTGFDLHGKKISILA |
| | | | | GGCCTCCCTCGAAGAGGGAGAGGTATACCAACACCTCGGCACACCCAC | | | YADDLALVADSSESL |
| | | | | AGGAGTCCGCGTCCGACAGACCCCCGAAGACACCATCGCGGAGATCCT | | | QQMLDVTSQAAEW |
| | | | | GCGAGACGCGGCCCAAATCGACTCCTCCCTGCTCGCCCCCTGGCAAAAG | | | MGLRFNPKKCASLHV |
| | | | | ATCAACGCCCTCAATACCTTCCTGATCCCCCGCATCTCCTTTGTCCTCAGG | | | DGGARALVRPSRFLI |
| | | | | GGATCGGCCGTAGCCAAGGTGCCCCTGAACAAGGCCGACAGCACCATC | | | QGEPMASLEEGEVY |
| | | | | AGGCAGCTGGTGAAGAAGTGGCTCTACCTTCCCCAGAGGGCCAGCACG | | | QHLGTPTGVRVRQT |
| | | | | GACATCATCTACATTTCCCACAGGCAGGGCGGCGCCAACGTACCTCGGA | | | PEDTIAEILRDAAQID |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGGGTGACCTGTGCGACGTGGCGGTGATGACCCACGCCTTCCGCCTCCT | | | SSLLAPWQKINALNT |
| | | | | GACGTGCCCGGACCCGACGGTGAGGAGCATCGCGCAGGAAGCCGTAC | | | FLIPRISFVLRGSAVAK |
| | | | | GGGACGTGGTCAGGAAACGCATCGCCAGGGCCCCCTCCGAGCAGGACA | | | VPLNKADSTIRQLVK |
| | | | | TCGCCACTTACCTCAGCGGCTCCCTGGAGGCTGAGTTCGGGAGAGAGG | | | KWLYLPQRASTDIIYI |
| | | | | GGGGAGACCTGTCCTCTCTCTGGTCCCGCGCCCGCAACGCCTCGAGACG | | | SHRQGGANVPRMG |
| | | | | CCTGGGTAAGAGGATCGGCTGCTGCTGGAAGTGGTGCGAGGAGCGCC | | | DLCDVAVMTHAFRLL |
| | | | | GGGAGCTGGGAATACTGGTGCCACGCATAAAGACCCCGGACCACACCA | | | TCPDPTVRSIAQEAV |
| | | | | TCGTCACCCCGACCGCCAGAGCTATGCTGGAAAGGACCCTGAAAGACG | | | RDVVRKRIARAPSEQ |
| | | | | CCATCCGCTGCCACTATGCCGAGAACCTCAAGCGGAAGCCGGACCAGG | | | DIATYLSGSLEAEFGR |
| | | | | GCAAGGTGTTCGAGGTGTCCAGCAAGTGGGACGCCAGCAACCACTTCC | | | EGGDLSSLWSRARN |
| | | | | TCCCCGGGGGCAGCTTCACCAGGTTCGCCGACTGGCGGTTCGTCCACAG | | | ASRRLGKRIGCCWK |
| | | | | GGCCCGACTCAACTGCGTTCCCCTCAACGGAGCCATCCGCCACGGCAAC | | | WCEERRELGILVPRIK |
| | | | | CGGGACAAGCGCTGCAGGAAGTGCGGCTACGCAAACGAGACCCTGCCC | | | TPDHTIVTPTARAML |
| | | | | CACGTCCTGTGTGGATGCAAACAGCACTCCGGAGCCTGGCGGCACCGC | | | ERTLKDAIRCHYAENL |
| | | | | CACAACGCCATCCAGAACCGGCTGGTGAAAGCCATCCCGCCGTCCCTGG | | | KRKPDQGKVFEVSSK |
| | | | | GGAAGATCACCCTCGACTCCGCCATCCCCGGGACAGACAGCAGACTGC | | | WDASNHFLPGGSFT |
| | | | | GACCCGACATCGTCGTGACGGACGCAGAAAAGAAGAAGGTCCTCATGG | | | RFADWRFVHRARLN |
| | | | | TAGACGTCACGGTGCCTTTTGAAAACAGGTCACCGGCCTTCCACGAGGC | | | CVPLNGAIRHGNRDK |
| | | | | CCGAGCACGGAAGGCGTTGAAGTACACCCCGCTGGCCGAGACCCTGAG | | | RCRKCGYANETLPHV |
| | | | | AGCCCAGGGCTACGAGGTCCAGATACACGCCCTGATCGTGGGAGCCCT | | | LCGCKQHSGAWRHR |
| | | | | GGGCTCGTGGGACCCCCACAACGAGCCGGTTCTGAGAGCGTGCGGAGT | | | HNAIQNRLVKAIPPSL |
| | | | | CGGTCGACGCTACGCCCGGCTCATGAGACAGCTCATGGTGTCCGACACC | | | GKITLDSAIPGTDSRL |
| | | | | ATCAGGTGGTCCAGAGACATTTATACGGAACACATCACAGGACACCGTC | | | RPDIVVTDAEKKKVL |
| | | | | AATACCACACTGAGTAACCGAGACCGCCGACCAGGGAAATAACCCACTT | | | MVDVTVPFENRSPA |
| | | | | CCTTCCCTGACGAACCAAGGGACGCACCCCACCCATGTACTTATTCGCTA | | | FHEARARKALKYTPL |
| | | | | CACCGATACTGACTTGGACTCCTTATACATTCCATGGGTGGCGTACCCGA | | | AETLRAQGYEVQIHA |
| | | | | GCCCACTTATCCACTGACACTTTAAAAACTCTTGCACCCCAATCTGGGTC | | | LIVGALGSWDPHNEP |
| | | | | TATGCCGGTTATGCGATATGTATGTATCTCTTCATCCTTGCAACCGATAC | | | VLRACGVGRRYARL |
| | | | | CTGTAATCCCTCATAACCCAAGCCTGACCCCAGATGTACAGTACCTTCCC | | | MRQLMVSDTIRWSR |
| | | | | TCTTAACTCGTGTATATTTAATTTTAAACATTAACTTTAATAAAATTTTTA | | | DIYTEHITGHRQYHTE |
| | | | | AA (SEQ ID NO: 1055) | | | (SEQ ID NO: 1423) |
| NeSL | Utopia- | — | *Acanthamoeba* | CCCGTCAAGGGTGCTCCACGAGATCCCTGTCGCTAGCCGACCGGTTTTA | CCCGTCAA | TAACAA | MAAKSVACPHDGCA |
| | 1_ACa | | *castellanii* | CCACCCCACCCCGCCCGGACAACCACGGACCCTGCTCCGCAGCAGGACC | GGGTGCTC | CCATGT | NKYASEASLRRHIKNK |
| | | | | CCACGCACGATGGCCGCTAAATCCGTCGCCTGCCCTCACGATGGATGCG | CACGAGAT | ATGGTG | HATDEEGDETSHSCP |
| | | | | CCAACAAGTACGCGTCGGAAGCCTCCCTCCGAAGACACATTAAGAACAA | CCCTGTCG | AACCAC | HCHRPFSTARGLSVH |
| | | | | ACACGCTACAGATGAGGAAGGAGATGAGACCTCACACTCCTGTCCCCAC | CTAGCCGA | ACCTCTC | IGKSHRQAPPEPTRP |
| | | | | TGCCACCGACCTTTCTCCACCGCCCGCGGGCTCAGCGTCCACATTGGCA | CCGGTTTT | TCGATCT | PPAPAPADPGLDPDP |
| | | | | AATCGCACCGTCAGGCCCCCCCTGAGCCGACGCGCCCCCCCCCGGCCCC | ACCACCCC | TGTATTC | GPTVTPPSRDDEDRE |
| | | | | GGCCCCTGCCGATCCCGGCCTCGATCCCGACCCCGGCCCCACCGTGACG | ACCCCGCC | TGTGATT | EPDDDPVEIADLSCP |
| | | | | CCCCCCAGCCGTGATGACGAAGACCGCGAGGAACCCGACGACGACCCC | CGGACAAC | GGACAT | HCAQALPSAHGLAN |
| | | | | GTGGAGATCGCGGACCTAAGCTGCCCTCACTGCGCCCAGGCCCTCCCGT | CACGGACC | CAGAGT | HLRACKDHRVPAPG |
| | | | | CGGCCCACGGCCTCGCCAACCACCTTCGCGCCTGCAAGGACCACAGGGT | CTGCTCCG | TCCTGC | APRSGPPSSRYWTAV |
| | | | | CCCCGCCCCTGGAGCACCCCGCTCGGGTCCGCCCAGCTCCAGGTACTGG | CAGCAGG | GAAGGG | EHHRYVEAMARFAD |
| | | | | ACTGCTGTCGAGCACCACCGCTATGTGGAGGCCATGGCGCGCTTCGCG | ACCCCACG | ATACACT | HPDLLARAAAHIGTR |
| | | | | GATCACCCCGACCTACTTGCGCGCGCGGCTGCCCACATCGGGACCCGCA | CACG (SEQ | CTGCCA | TYKQVDSHRTKVIAA |
| | | | | CGTACAAACAGGTTGACTCCCACCGCACCAAGGTGATCGCGGCGGAGC | ID NO: | ATCTCGT | EREGRPVRTLDPTM |
| | | | | GCGAGGGCCGCCCTGTCCGCACGCTCGACCCCACGATGGACTGGCGCA | 1179) | GGGTTG | DWRMRPYCASTTAR |
| | | | | TGCGGCCCTACTGCGCCAGCACCACGGCCCGGTGGCTGGCTGAGCAGG | | TAATAA | WLAEQGRSPVAPRS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCGTAGCCCAGTAGCGCCCCGCTCGCCCTGCCCCGAGCCCCACGCCCC | | ATCCAC | PCPEPHAPPPAALL |
| | | | | GCCGCCTGCAGCCGCGCTGCTGTACATCCCGGCCACGCCCCCCGCGCCA | | ACCTTCA | YIPATPPAPTPRAPVA |
| | | | | ACGCCCCGTGCCCCAGTGGCGCCTCCCAAGCTTGCGCCTCCCGCCGAGA | | ACA | PPKLAPPAESTVPATP |
| | | | | GCACCGTGCCCGCCACGCCCGATGGGAATCCGGAGGCGCCAGCACCCC | | (SEQ ID | DGNPEAPAPPFSAPG |
| | | | | CGTTTAGCGCCCCCGGACCTCCCACCCCCAAGGCATTGCCGCCCCCGCCC | | NO: | PPTPKALPPPPPSRR |
| | | | | CCGTCCCGCCGCAACCTGCGCCCTCACCTCGTGCCCAAGGATGCTTGGC | | 1302) | NLRPHLVPKDAWQG |
| | | | | AGGGGGTCGCCGATGCCGTCGCCCCTGCCGCCTCGCGCCTCCTGCGCAC | | | VADAVAPAASRLLRT |
| | | | | GCCCCTTGCGCACCTCTCCACCGAGCAGTGGGCCACGTTCGAAGCCGCC | | | PLAHLSTEQWATFEA |
| | | | | CTCGCCGGCCTCGAGGCTACGCTCCACCATGCCGCCCGCAGTGCAGAGG | | | ALAGLEATLHHAARS |
| | | | | CGGTGCCCACACGCTGCGCTAGCCGAGCAAGGGAAGACGCCGAGCGCC | | | AEAVPTRCASRARED |
| | | | | AACTCCGTGAAGCCCGAAAGACGCGTGAGATCTTTGGCAAGGCCGCTG | | | AERQLREARKTREIFG |
| | | | | CCCTCTACGCAGCCGGCAAGGACCCCACTGCCACCATCGAGCGCATCCC | | | KAAALYAAGKDPTAT |
| | | | | CCCAGAAGTCCGCCTACACCTGCCAACCCCTGGCTCGGCTGAATGGCCC | | | IERIPPEVRLHLPTPGS |
| | | | | GCCAGGGCGGCCGCCGCCCGCAGGGTGATCCGCCGTGCAGTCGCGCGA | | | AEWPARAAAARRVI |
| | | | | GCGGACCGGTTGCGCAAGCGCATGGGCATCCTCGATAGCGACCGCGAC | | | RRAVARADRLRKRM |
| | | | | CTCCAACGCCTCTTCAACGCTAACCAGAAGAAGGCAGTTCGGCAGATCC | | | GILDSDRDLQRLFNA |
| | | | | TCGCCCCGTCCACCAAGGCGCCGCGGTGCCAGCTAGACCCAGCCGCCGT | | | NQKKAVRQILAPSTK |
| | | | | CGAGGAGGCCTACATCCAGACCCTCGCCAAGCCGCCGCCGATCGACCCC | | | APRCQLDPAAVEEAY |
| | | | | AGCCCCCCGTGGAAGAACTCCGTCCAGTGGCCCCGCCCGCCCACTGCCG | | | IQTLAKPPPIDPSPPW |
| | | | | CCGATGACGGAGGCAGCCCCTTCAGCGTCGCCGAGGTCCGGGCCCAGC | | | KNSVQWPRPPTAAD |
| | | | | TCCGCCGACTGCCCAACGGGTCCGCCCCAGGGATCGATGGCATACCGTA | | | DGGSPFSVAEVRAQL |
| | | | | CGAGGCCTACAAGCGTACGAAACTGGACGCCACGCTCGCCCATGTCTTC | | | RRLPNGSAPGIDGIPY |
| | | | | GAGGTCGTGCGGCTGAATGCGCGCCTGCCAGCTCGATGGGATGTGGCG | | | EAYKRTKLDATLAHV |
| | | | | CGCACGGTCCTGCTCTACAAGAAAGGCGACCCTAACGACACCGGCAACT | | | FEVVRLNARLPARW |
| | | | | GGCGACCGATAAGCCTCCAGGTCACCATCTATAAGATCTTCACGGCCGC | | | DVARTVLLYKKGDPN |
| | | | | CCTGTCGAAGCGGCTCATCTCCTGGGCTGGCAAGCACAACACTTTCTCC | | | DTGNWRPISLQVTIY |
| | | | | GCATCGCAGAAGGGATTCCTACCGGCCGAAGGCTGCCACGAGCACGCG | | | KIFTAALSKRLISWAG |
| | | | | TTTGTCTTGCGAAGCGTGCTTGACGACGCCCGTCGGCACAAGCAGAACG | | | KHNTFSASQKGFLPA |
| | | | | TGTACCTTGCCTGGTACGATCTGCGCAACGCCTTCGGATCGGTGTCGCA | | | EGCHEHAFVLRSVLD |
| | | | | CGACCTCATCGCCTGGTGCGCTGCCATGTTGGGCCTGCCCCGCTACCTCC | | | DARRHKQNVYLAWY |
| | | | | GGGATGCCATCGGCGCAATCTATCGGCACTCAGCGCTCTTCGTCCAAGT | | | DLRNAFGSVSHDLIA |
| | | | | TGGGGATCAGGAGACCACCGGCGTCATTCCTATGCGCTGCGGCGTCAA | | | WCAAMLGLPRYLRD |
| | | | | GCAGGGCTGCCCTCTCAGCCCCCTCCTCTTCAACCTGTGCGTCGAGCCG | | | AIGAIYRHSALFVQV |
| | | | | GCCCTTCGCTGCCTACGCCGCACCACCGGGTACAAGTTCTACGGCACGT | | | GDQETTGVIPMRCG |
| | | | | CGATCACCGTCGAGGGCCAGGCCTACGCCGACGACCTGCTCACTGCCGC | | | VKQGCPLSPLLFNLC |
| | | | | GCCCTCCGCCTACCATGCGGCCCGGCAGGTGGCCACGATCGAGGAATG | | | VEPALRCLRRTTGYKF |
| | | | | GGCCAACTGGGCGGGAGTCTCCTTCGTCGTCCAAGCCCTCTCCCTGGAT | | | YGTSITVEGQAYADD |
| | | | | GCGCCGGCCGGCAAGTGTGCCGCCCTCGCGATCAACTTCGAAGGTGGT | | | LLTAAPSAYHAARQV |
| | | | | CTAATGCACTCTATCGACCCTGCCCTCAAGGTCCAAGGCGCAGCCATCCC | | | ATIEEWANWAGVSF |
| | | | | GGCCATGTCAAGAAACAACGTGTACCGCTACCTCGGAGTACATGTCGGT | | | VVQALSLDAPAGKCA |
| | | | | CTCACAGATGCGCTCGGCCAAGCGAACGAGCTCCTCGAGAAGGCCTCA | | | ALAINFEGGLMHSID |
| | | | | CGCGATGCACGCACGATCTGTGCCTCTGGCCTCGAACCCTGGCAGAAGG | | | PALKVQGAAIPAMSR |
| | | | | TGGTCGCAATCAAGACCTTCATCCTCTCCCGGCTCCCCTTCTTCTTCCACA | | | NNVYRYLGVHVGLT |
| | | | | ACGGGAAGATCCAGAGGGGCCGATGCCAGCAATTCGACCGCGAGCTTC | | | DALGQANELLEKASR |
| | | | | GAGAAAACCTGCGGGCCGCCCTCCGACTCCCCGTCTGCACCACGAACGC | | | DARTICASGLEPWQK |
| | | | | CTTCTTCCATTCCCGCGTGGCCTCAGGCGGCCTTGGCATCCTGCCCATCG | | | VVAIKTFILSRLPFFFH |
| | | | | CGGAAGAACAACAAGTCTACCTGGCAGCCCACGTGTTCAAGCTCCTGAC | | | NGKIQRGRCQQFDR |
| | | | | TTCGCCAGATCTGTCGATCCGCGCCATCGCCCGACACCAACTTGCCGAG | | | ELRENLRAALRLPVCT |
| | | | | GTCACCCACGCGCGACACACCACGCCAGTCCAGGACGGCGAAGCGTCA | | | TNAFFHSRVASGGLG |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCCTTCTTCGGATGGCTCATGCGGGGGCAGGAGGTCGCATCAACTACCC | | | ILPIAEEQQVYLAAHV |
| | | | | CCTCGGGTGACGTCAGTTCAATCTGGTTCGCAGCTGCAGGCGCCTACTC | | | FKLLTSPDLSIRAIARH |
| | | | | GAGGATGGGATGGTCAGTCCGCGATGCACTCCACCCGACGCTGACAGT | | | QLAEVTHARHTTPV |
| | | | | TGGTCCGGGCGTCCAATTCGAGGGCCGATTCCAACGTGCCAACGTCATC | | | QDGEASPFFGWLMR |
| | | | | CCAGCTCTCCGGGCTAGCGCCTTTTCCCGCCATGCTGTGGAATGGAGTG | | | GQEVASTTPSGDVSS |
| | | | | CCCTCCGCACCCAGGGTCGAGCAGCAGCCTACCAACATGCCGTCCACCC | | | IWFAAAGAYSRMG |
| | | | | TGCAACGCACCACTGGGTCCACAACAGCGCTGGCCTGACGACCAAGGA | | | WSVRDALHPTLTVG |
| | | | | GTACCGATTCGCGATCAAGTGTCGATTGGGTCTCCTGCCGACGCGAGCA | | | PGVQFEGRFQRANVI |
| | | | | GCTCCACACCACCGCAATGGGCCAACAGCGTGCAGGGCGTGCTCCTAC | | | PALRASAFSRHAVEW |
| | | | | GCCCGCGAGACGGCCAACCATGTTCTCGGACACTGCCCGGCGACCAAG | | | SALRTQGRAAAYQH |
| | | | | GCCGAAGTCATCGCGCGCCACAACAGGATATGCCGAGCTCTGGCCCAG | | | AVHPATHHWVHNS |
| | | | | GCGGCTGAAGCCTCATGGACGTCTGTCCTTGAAGACGTCCCGATCCCGG | | | AGLTTKEYRFAIKCRL |
| | | | | GGGTGGACTCCCCCCTACGACCCGACATCTACTGCTCTCGGCCGGGCCA | | | GLLPTRAAPHHRNGP |
| | | | | GTGTGCCATCATCGAGGTCGCGGTCTCCTACGAGGACGCCTTCAACGCT | | | TACRACSYARETANH |
| | | | | TCGATGGAGGGCCGGGCGAAGCAGAAGACCGACAAGTACGCTGGCCT | | | VLGHCPATKAEVIAR |
| | | | | GGCTGCTACCGTCGAGGAGCAGCTGCGGCTCCAAACCCGGCACGCGGC | | | HNRICRALAQAAEAS |
| | | | | TTTCGTGGTGGGCTTCTCTGGCGTCGTGCTCCCAGCCTCGGTAACCGCTA | | | WTSVLEDVPIPGVDS |
| | | | | CGGCCACCTCCCTTGATCTCCCCCCCAAAACTTGGAATGTGCTTCTTAAA | | | PLRPDIYCSRPGQCAI |
| | | | | CGTTGTGTTGCTGCCTCAATCAAAGGCAGTTACACAGCGTGGAGAAGAT | | | IEVAVSYEDAFNASM |
| | | | | TCCGGCGCTCTACTCCATAACAACCATGTATGGTGAACCACACCTCTCTC | | | EGRAKQKTDKYAGLA |
| | | | | GATCTTGTATTCTGTGATTGGACATCAGAGTTCCTGCGAAGGGATACAC | | | ATVEEQLRLQTRHAA |
| | | | | TCTGCCAATCTCGTGGGTTGTAATAAATCCACACCTTCAACA (SEQ ID | | | FVVGFSGVVLPASVT |
| | | | | NO: 1056) | | | ATATSLDLPPKTWNV |
| | | | | | | | LLKRCVAASIKGSYTA |
| | | | | | | | WRRFRRSTP (SEQ ID |
| | | | | | | | NO: 1424) |
| NeSL | Utopia- | — | *Acromyrmex* | GGTGCACAACGGATGCATCATACGTGTACCGGAGCATACGGGCTGTCA | GGTGCACA | TAAATTA | VCSVRGCRREDSRRF |
| | 1_AEc | | *echinatior* | CGGCGGCTGCATGCGCGATCTAGCTCGGAGATTTTATTTATTTATTTATT | ACGGATGC | TTTTGTC | YKFKFPLNFVKVPKTI |
| | | | | AATTTATTTATTTATTCATCGAGTGTGAGTGTTCGCGTTTTGCCGAGAAG | ATCATACG | TTTGTCT | VIGSAFQKSSVSARS |
| | | | | CGATTTTCGTTAAGTGATACGCGCCGCGTTCATAGGTTAGGTGTGCAGT | TGTACCGG | TGGCCC | QNHSRSTRVPKTRQP |
| | | | | GTACGTGGCTGTCGTCGCGAAGATTCTCGAAGATTCTACAAGTTCAAAT | AGCATACG | CCCCTTT | RTSNTIGRYTAASAN |
| | | | | TTCCGTTAAATTTCGTTAAAGTTCCTAAAACCATCGTGATCGGGAGTGCG | GGCTGTCA | TTAAACC | NYLTVIITGNYTVFAQ |
| | | | | TTCCAAAAATCATCAGTTTCGGCTCGTTCGCAAAACCACTCCCGGTCGAC | CGGCGGCT | AAGCAG | WICYRECTWLLSKFV |
| | | | | CCGCGTTCCGAAAACCAGACAGCCACGTACAAGCAATACGATTGGTCGG | GCATGCGC | GAGAGA | NFFLTIIGYFFQLRLVV |
| | | | | TACACTGCCGCGAGTGCGAATAACTATTTAACTGTTATTATTACTGGAAA | GATCTAGC | GTGGCC | IYEGPVILDTFSNCGS |
| | | | | TTACACTGTATTCGCCCAGTGGATCTGTTATCGCGAGTGCACTTGGCTTT | TCGGAGAT | CAATGC | SLFMRGQXSKALLVR |
| | | | | TAAGTAAATTTGTTAATTTTTTCTTAACTATAATTGGATACTTTTTCCAATT | TTTATTTAT | CCAACT | LNRSALAMADPQVH |
| | | | | GCGGCTCGTCGTTATTTATGAGGGGCCAGTKATCTAAGGCCCTTTTAGTC | TTATTTATT | ATTATAT | YIDYPLPPRVKCVKCF |
| | | | | AGACTAAACCGTAGTGCACTCGCCATGGCGGATCCACAAGTGCACTATA | AATTTATTT | ATTAACT | GAEGAGKVKGEYSD |
| | | | | TAGACTACCCGCTGCCCCCTAGAGTCAAATGCGTAAAATGTTTCGGTGC | ATTTATTC | ATTTACT | PPHLAKHLKKCHPGD |
| | | | | TGAGGGGGCAGGCAAAGTAAAGGGCGAATACAGCGACCCGCCGCATTT | ATCGAGTG | GTGATA | TLNYKCSICDLRGTGK |
| | | | | AGCAAAACATCTGAAAAAGTGCCACCCGGGAGACACATTAAATTATAAA | TGAGTGTT | TTTATTA | YPLRDVKAHYAECHV |
| | | | | TGCTCAATTTGTGATCTAAGGGGGACCGGTAAATACCCCCTTAGAGATG | CGCGTTTT | TTTGACT | SPAVDAAGPSTRGSL |
| | | | | TTAAGGCACATTACGCCGAGTGCCATGTGTCTCCCGCAGTGGATGCGGC | GCCGAGA | GTTGGG | GECSGAGQPTASRA |
| | | | | GGGTCCAAGCACTCGCGGCAGCCTCGGCGAGTGCAGTGGTGCGGGTCA | AGCGATTT | CGGGCC | AKATTRLAETVGGTD |
| | | | | ACCGACAGCCAGCCGCGCGGCTAAAGCGACCACGCGATTGGCGGAGAC | TCGTTAAG | CCTCTCT | KRRAATSGSRQLTLP |
| | | | | GGTTGGGGGTACGGATAAGCGCCGTGCCGCGACATCGGGATCGCGGC | TGATACGC | GCTGGT | FAATPSPSTAAGEAR |
| | | | | AACTCACGCTGCCGTTCGCAGCCACCCCATCGCCATCCACAGCAGCCGG | GCCGCGTT | TTTATTT | APRSXSTTPTSRSPSY |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGAGGCAAGGGCCCCAAGAAGCGMGTCAACGACACCGACGAGCAGGT | CATAGGTT | ATATATA | AAVTAGPPSMRSTTT |
| | | | | CCCCCTCATATGCGGCAGTCACTGCGGGCCCGCCATCGATGAGGAGCAC | AG (SEQ ID | TTTTTTA | STTARSKTVAKGAAP |
| | | | | GACAACTTCCACCACAGCCCGCAGTAAGACTGTCGCGAAAGGCGCCGC | NO: 1180) | CTCGCG | NTTTTTTARRSGEAA |
| | | | | GCCCAACACMACGACGACGACAACGGCCAGGAGATCCGGCGAGGCCG | | TACTTTT | ATRKPPTTATVSKPR |
| | | | | CCGCAACGAGGAAGCCGCCTACGACCGCCACGGTGAGTAAACCGCGTG | | TGTACTA | VLSVETVRLPVDDIQ |
| | | | | TGTTGTCGGTAGAAACTGTTAGGTTGCCTGTCGACGACATCCAGCGAGC | | CTCTATT | RAGVQNAAKPARAP |
| | | | | AGGCGTGCAAAACGCGGCCAAACCGGCGCGCGCTCCCTCTCGCCCCCC | | TTTCTTT | SRPPQRTSPEAGGPR |
| | | | | GCAGAGAACATCACCGGAGGCGGGGGGTCCAAGAACAACGGGCGCAA | | TTATTTT | TTGAKEKCGEGAYKK |
| | | | | AGGAGAAATGCGGAGAGGGAGCATACAAGAAGTTGCCCGCAAACAGC | | AGCTAT | LPANSGNPISTRTRR |
| | | | | GGCAATCCAATTTCAACCAGGACGAGGCGGGCAACTAGCGTGCCGGTT | | GCTATTT | ATSVPVEKSEGTARR |
| | | | | GAGAAGAGCGAAGGCACGGCAAGACGGGAGCGCGTCTCCCCACACCCT | | TTATCTC | ERVSPHPPPKGIDIILS |
| | | | | CCTCCCAAAGGAATTGATATCATCCTATCGTCGACATCGGAGGAGGAGG | | TTTCTTT | STSEEEGTPYQPGGV |
| | | | | GCACGCCATACCAGCCCGGCGGCGTGGGGAGACTAAGACTAAGGAGG | | GTCTCTA | GRLRLRRKKVTGPPP |
| | | | | AAAAAGGTGACCGGACCACCCCCAAAGATGACACCCAGAGAGGGGGT | | TTTTCTT | KMTPREGVVTRARR |
| | | | | GGTCACAAGAGCCAGGCGGTCCACCAGCGCTCCCGTCGAGAAGAGTGC | | TCTTTTT | STSAPVEKSALDARLT |
| | | | | CTTGGATGCACGCCTGACGGCTCTGGACCGGACATCGTCCAGAGCGAC | | TTCTTTC | ALDRTSSRATGNPTS |
| | | | | AGGCAACCCGACGTCGCAAATCGCAGGGGGCCTTTACACCAGTAGAGG | | CTTTTCT | QIAGGLYTSRGQPER |
| | | | | CCAACCGGAGAGGACGCCCCCTGCGAGGCTCCCCAGCCTGTCTCCGACC | | TTTCTTT | TPPARLPSLSPTTRGS |
| | | | | ACCAGAGGCAGTCCATCGGGGAGCCTAGGCGAGATACGGACACCCATC | | CTTTTAT | PSGSLGEIRTPISPATS |
| | | | | TCGCCTGCGACGTCGCTACCGGCAACGCTCACCACTTGCACGGTGACGA | | TCTTCTT | LPATLTTCTVTTTTCG |
| | | | | CGACCACCTGTGGAAGCCCCATAACATCCACGGGCTTCACAGGTGGCGT | | TTATTTA | SPITSTGFTGGVGRLI |
| | | | | GGGGAGGCTGATAACACCWCCGAGCCTCCCCCAAACGAACATCCTCCC | | TCTTTTT | TPPSLPQTNILPTIGEE |
| | | | | GACCATCGGGGAGGAAGGAACGTCACCGTGCGTGGCGGTCGTCACCAC | | TTCTTTT | GTSPCVAVVTTHPRP |
| | | | | CCATCCTTAGGCGGCAGGAGCACGTCTCCGCTCATCCTACCAAGGCCAA | | CTGTTGT | TGEDAPCEAPQPVSD |
| | | | | CGACACCGGAGCCTGAGCGGGGACAAGAGGAGCGGCGGCTAGAAGGC | | GGGGCC | HQRQSIGEPRRDTDT |
| | | | | GCGGCGCAGCCACCTACCACACCCGTCGTCGAGGGGGACAACCAGTGG | | CTGACC | HLACDVATGNAHHL |
| | | | | GATGGCCAGTGGACGGTGAGCGTGAGGAGAAGAGCGAGGAGGCAACA | | GTCCGA | HGDDDHLWKPHNIH |
| | | | | ACTGAACGATACATCCCCCTCCAACTCCGAGTCCCCGCCAACCGCTGGA | | GTGTGA | GLHRWRGEADNTXE |
| | | | | CCATCGCGTTCGCCGCGCATAGCCCCACTATCTGCGCTGATAGCGGCGT | | ATGCCG | PPPNEHPPDHRGGR |
| | | | | CGACGAGCCGCCATGAGACCAGCTTAAATCTCAATTGCACGAACGGCAA | | CGAAAA | NVTVRGGRHHPSLG |
| | | | | TATTTGCATGGACCGAACTCCGCCCCGTAACATTTTGCCGGTARGGGCG | | ACAATA | GRSTSPLILPRPTTPEP |
| | | | | GAGCGCCGTCGCGAGACATCGCCACAGGATCGCGTGGAGGGAGACATC | | TTATGTT | ERGQEERRLEGAAQP |
| | | | | GGTTATGGTGCTGGAAAGGTAAGTGCCGAACACCCGAGTGCTCCCGTA | | TTATACG | PTTPVVEGDNQWD |
| | | | | AATGTCCGTGGTGTGATGTCTCGAGGGAGAGCAACCGCGTCATCCATCG | | AGTGTG | GQWTVSVRRRARRQ |
| | | | | TGCCACCGCGAGCCAACCGTGGGGAGGGCGGTCGGCAGCATCATAGTC | | CATGTG | QLNDTSPSNSESPPT |
| | | | | GGCGGCGTCCGGACGCTCCTGTCGGTCAGCCGTCGCGGGATCACCCGG | | CGTGAT | AGPSRSPRIAPLSALI |
| | | | | CGCCTGCGACTGTCGCGAGGCAGCGTAGGCGTGAGCGGGTGGCCGCCC | | ATATTTA | AASTSRHETSLNLNC |
| | | | | GCGACGCGCTGCTCGATCGGGCTAAGGACGTCGCTACGATTGCGGATC | | TCTATTT | TNGNICMDRTPPRNI |
| | | | | TGGAGGCGTTCGCGGCTTCGGTCGCGGCGTTCTTCGGGGAGGATGCAT | | TATTTTA | LPVXAERRRETSPQD |
| | | | | CGGCCACTGGTGCTGCAGCCCGCGCTCGCGATCGTTCGGTACGCTCACG | | TTTATTT | RVEGDIGYGAGKVSA |
| | | | | GGAGGCGGGTGCGCGTCGGGGGGTGAAGGGAGGTGAGCGTCCGGAG | | ATTATAA | EHPSAPVNVRGVMS |
| | | | | AGAGAGGGCGCCGGTAGGCCGGGGTCAGCGCCGGCTGACCCCGGAGC | | TTTATTG | RGRATASSIVPPRAN |
| | | | | GTCGGGAGAAGCACGCGGGGACTGGGTGCGCGAGGCCAAACGCTTGC | | CCGCGC | RGEGGRQHHSRRRP |
| | | | | AGGCGCTGTACAGGGCGAACCGCCGCAAGGCAGTGCGAGAGGTGCTC | | GCGCTC | DAPVGQPSRDHPAP |
| | | | | CAGGGACCTGCCGATCAGTGCCAGGTGCCTAAACGTCAGGTCCAGGAG | | CTCCGG | ATVARQRRRERVAA |
| | | | | TACTTCGAGCGGCTGTACAGCGGCGGGGAAGACCTGGCTGGCGCCGGC | | GACTTTT | RDALLDRAKDVATIA |
| | | | | GTGGAAGCCGAACGCCCTGACCCCTCGAGTCCGCGTGAGGTATCTGCG | | ATTCGTT | DLEAFAASVAAFFGE |
| | | | | GTCCTGGGTCCGCTCGCGGAGCGAGAGGTGGACCGTCGGCTCCGGCGT | | GACAAT | DASATGAAARARDR |
| | | | | ATGAATAACTCTGCGCCGGGTCCCGACGGTGTATCCTATCGTGACCTCC | | ACTGTG | SVRSREAGARRGVKG |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTGGGGCGGACCGGGGAGCGCGGCTCCTCACGGCGCTCTACAACATCT | | ATATTTT | GERPEREGAGRPGSA |
| | | | | GCCTGCGGCTCGAGGCAGTCCCCGCGTCCTGGAAGACCTCCAACACTGT | | TCTGCKC | PADPGASGEARGDW |
| | | | | GTTGATACACAAGAAAGGAGACCGGGGCATGTTGGAGAACTGGCGCCC | | AGGCTG | VREAKRLQALYRANR |
| | | | | TCTCGCTCTGGGGGACACCGTCCCCAAACTCTTCGCCGCGCTCTTGGCCG | | GGGGGG | RKAVREVLQGPADQ |
| | | | | ACCGATTGACCGACTGGGCGGTCACCCGCGGGAAGCTCTGCTCCGCGC | | CTTGCCC | CQVPKRQVQEYFERL |
| | | | | AGAAGGGCTTCCTGCGGGACGAGGGGTGCTACGAGCACAACTTCGTCC | | CCCAGC | YSGGEDLAGAGVEAE |
| | | | | TGCAGGAGGTCCTGACGCACGCCAAGCGCTCTAAGCGCCAGGCGGTCG | | CCCTTAG | RPDPSSPREVSAVLG |
| | | | | TCGCGTGGCTGGACCTGTCCAACGCGTTTGGATCGATCCCGCACGCGAC | | TTTTAAT | PLAEREVDRRLRRM |
| | | | | GATCCGCCGCGCGCTTATAAGATCCGCGGTGCCACGGGGTCTCATAGCG | | TGCCTAT | NNSAPGPDGVSYRD |
| | | | | ATATGGGACTCCATGTACGATGGTTGCACGACGAGGGTGCGAACCGCC | | GCGGGG | LRGADRGARLLTALY |
| | | | | GAGGGTCACACAGCACCCATCCCCATCCGGTCGGGCGTCCGTCAGGGTT | | GGGGCT | NICLRLEAVPASWKT |
| | | | | GTCCGCTAAGCCCTATTATCTTCAACCTGGCCATCGACTCGGTCGTCCGT | | TTTGTCC | SNTVLIHKKGDRGML |
| | | | | GTGGCGGCCGAGWCGAATGACGGGTATTCCCTCCACGGAAATACCTGG | | CCCGCA | ENWRPLALGDTVPKL |
| | | | | TCGGCATTGGCTTACGCGGACGACATCGCACTACTGGCCCAGACGCCCG | | AATGTA | FAALLADRLTDWAVT |
| | | | | AGGGGATGGAGAGGATGCTAGCCTCTGTGGAGGCGGAGGCAGCGTCG | | TATATAT | RGKLCSAQKGFLRDE |
| | | | | GTGGGGCTGCGGTTCAACCCTGCAAAGTGTGCCACCCTGCACGTCGGTG | | ATATATT | GCYEHNFVLQEVLTH |
| | | | | CGGGGAATGGCGGCAGGGTCCTACCGACGTCATTCCAAATCCAGGGGG | | TAGCGC | AKRSKRQAVVAWLD |
| | | | | AGACGATCAACCCCCTGGCTCAGGGTGAGTCGTACACCCACCTTGGCGT | | GCGGCT | LSNAFGSIPHATIRRA |
| | | | | TCCAACGGGGTTCTCCGTGGACCAGACGCCCTACGCCGCCGTCGGGGA | | TAGCCG | LIRSAVPRGLIAIWDS |
| | | | | CATCGTCTCGGACCTGCGCGCTGTCGACCGCTCACTCCTTGCCCCGTGGC | | CTTTTGT | MYDGCTTRVRTAEG |
| | | | | AGAAGATAGAAATGCTGGGGACCTTCATCCTATCCAGGCTTGACTTTCT | | TTGTATT | HTAPIPIRSGVRQGC |
| | | | | GCTCCGGGGGGCCAGAGTGTTCAAGGGTCCCCTCACGGCCGTGGACCT | | ACCCCA | PLSPIIFNLAIDSVVRV |
| | | | | TAACATCCGWAGGCATGTTAAATCCTGGCTTAACCTCCCTCAGCGAGCA | | GAGGGG | AAEXNDGYSLHGNT |
| | | | | AGCGCGGAGGGAGTCTACATGCCGCCCCGTTGGGGGGGATGTGGACTC | | AATTGTC | WSALAYADDIALLAQ |
| | | | | CTGCCGCTCTCTGACCTCGCCGACGTCCTCACGGTTGCCCACGCGTACCG | | CCTCTG | TPEGMERMLASVEA |
| | | | | TATGTTAACGGTGCGCGATGGCGCCGTGAGGGAGTTGGCGTGGGAATC | | GGGAAA | EAASVGLRFNPAKCA |
| | | | | GCTGAGGGGAGTGGTTGGGCGCAGGATCGGCCACGCCCCTAGTTGCGA | | AAAAAT | TLHVGAGNGGRVLP |
| | | | | GGATATCGCCTCCTTCCTATCCGGCTCGCTGGATGGAAGGATGAGGGGC | | GATTGG | TSFQIQGETINPLAQ |
| | | | | GGAGGGGAGGCTTCGCTCTGGTCGAGTGCGCGGAACGCTGCGCTCAGA | | AAAAAT | GESYTHLGVPTGFSV |
| | | | | CAGTCCGAGAGGTTGTCCCTGCGTTGGCGGTGGGTCGAGGCCACGGAG | | AAAGTG | DQTPYAAVGDIVSDL |
| | | | | GAGATGACGTTGGAGTGTCGAGGGCCCAGGGGGGCAGCGATTAAGAT | | AGCTAA | RAVDRSLLAPWQKIE |
| | | | | TCCGCCTGAAGCGCGCGGTCAGGTAGTGAATCGGTTGCGCTCAGCTGTA | | (SEQ ID | MLGTFILSRLDFLLRG |
| | | | | GCAGAGCACTACGCAAGTAGGTTGCTTAGCAAGCCTGATCAGGGTAAG | | NO: | ARVFKGPLTAVDLNI |
| | | | | GTCTTCGAGGTGTCGTCGCGGAGCCGAGTGAGCAATCACTTTATCCGCG | | 1303) | RRHVKSWLNLPQRA |
| | | | | GCGGCAGCTTCACTCGCTTCGCCGACTGGCGCTTTATCCATAAGGCCCG | | | SAEGVYMPPRWGG |
| | | | | GTTAGATGTTCTTCCTCTCAACGGCGCACGACGTTGGGAGGCCAACGAC | | | CGLLPLSDLADVLTVA |
| | | | | AAGCGCTGTCGGCGATGCGGTGAGGTATCGGAGACATTACCCCATGTG | | | HAYRMLTVRDGAVR |
| | | | | CTCTGTCACTGCGGCATCCACTCCGCCGCGATACAGCTGAGGCACGACG | | | ELAWESLRGVVGRRI |
| | | | | CTGTCCTGCACCGCCTTTGGAAGGCCACTCGCCTTCCAGGGGTAGTGCG | | | GHAPSCEDIASFLSGS |
| | | | | GGTTAACCAGCGGGTGGAGGGCGTCAGCGACGAATTGGGGGCGCTAC | | | LDGRMRGGGEASL |
| | | | | GACCTGATCTCGTGGTCAGGCACGAGCCCTCCAAAAGTGTCGTCATCTG | | | WSSARNAALRQSERL |
| | | | | CGACGTCACGGTGCCATTCGAAAACCGCTGGACCGCTTTCGAGGACGCC | | | SLRWRWVEATEEMT |
| | | | | AGGGCGAGGAAAATCGCCAAATACTCGCCTCTGGCAGAGGAGCTACAG | | | LECRGPRGAAIKIPPE |
| | | | | CGGCGAGGGTACCGTGTCGTCGTGACGGCCTTCGTCGTCGGCGCCCTCG | | | ARGQVVNRLRSAVA |
| | | | | GCTCGTGGGATCCGAGGAATGAGGCGGTGTTGAGACTGCTGCGGGTTG | | | EHYASRLLSKPDQGK |
| | | | | GCAACCAGTATGCAGCTATGATGCGGCGCCTCATTGTCTCGGATACCAT | | | VFEVSSRSRVSNHFIR |
| | | | | TCGCTGGTCACGCGACATATATGTGGAGCATGTGTCCGGCACCCGCCAG | | | GGSFTRFADWRFIHK |
| | | | | TACCTGGCTCCTTCCCGTCCCTCTGGGGATCTCGCGACGCCGCCGAGAG | | | ARLDVLPLNGARRW |
| | | | | CGGTTCGTCGACGCTGGCTCGCCGAGGAGAGAAGCGCACAGGACGCG | | | EANDKRCRRCGEVSE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCGCGTCGCGGTTCGGATAGTGTGAGTGTCGCGTAAATTATTTTGTCTT | | | TLPHVLCHCGIHSAAI |
| | | | | TGTCTTGGCCCCCCCTTTTTAAACCAAGCAGGAGAGAGTGGCCCAATGC | | | QLRHDAVLHRLWKA |
| | | | | CCAACTATTATATATTAACTATTTACTGTGATATTTATTATTTGACTGTTG | | | TRLPGVVRVNQRVE |
| | | | | GGCGGGCCCCTCTCTGCTGGTTTTATTTATATATATTTTTTACTCGCGTAC | | | GVSDELGALRPDLVV |
| | | | | TTTTTGTACTACTCTATTTTTCTTTTTATTTTAGCTATGCTATTTTTATCTCT | | | RHEPSKSVVICDVTVP |
| | | | | TTCTTTGTCTCTATTTTCTTTCTTTTTTTCTTTCCTTTTCTTTTCTTTCTTTTAT | | | FENRWTAFEDARAR |
| | | | | TCTTCTTTTATTTATCTTTTTTTCTTTTCTGTTGTGGGGCCCTGACCGTCCG | | | KIAKYSPLAEELQRRG |
| | | | | AGTGTGAATGCCGCGAAAAACAATATTATGTTTTATACGAGTGTGCATG | | | YRVVVTAFVVGALGS |
| | | | | TGCGTGATATATTTATCTATTTTATTTTATTTATTTATTATAATTTATTGCC | | | WDPRNEAVLRLLRV |
| | | | | GCGCGCGCTCCTCCGGGACTTTTATTCGTTGACAATACTGTGATATTTTT | | | GNQYAAMMRRLIVS |
| | | | | CTGCKCAGGCTGGGGGGGCTTGCCCCCCAGCCCCTTAGTTTTAATTGCCT | | | DTIRWSRDIYVEHVS |
| | | | | ATGCGGGGGGGGCTTTTGTCCCCCGCAAATGTATATATATATATATTTA | | | GTRQYLAPSRPSGDL |
| | | | | GCGCGCGGCTTAGCCGCTTTTGTTTGTATTACCCCAGAGGGGAATTGTC | | | ATPPRAVRRRWLAEE |
| | | | | CCTCTGGGGAAAAAAAATGATTGGAAAAATAAAGTGAGCTAA (SEQ ID | | | RSAQDAARRGSDSV |
| | | | | NO: 1057) | | | SVA (SEQ ID NO: |
| | | | | | | | 1425) |
| NeSL | Utopia- | — | *Alligator* | TGCTGGAAAGACGGAGAACCGCTTCCTTTTTCCCTGCGCCTGGCCTGGT | TGCTGGAA | TGAACC | CHHAGLRPGTPNRT |
| | 1_AMi | | *mississip-* | ATTGCAGTACCTCCAGGATTAGCGCCAACTAGTCCGGCAGACTGTCGGA | AGACGGA | CCCCCTC | RRPDQTAPLPDPRG |
| | | | *piensis* | ATACAGCAATAGAAAGWGAGCTGACTAGCAGCTTGCTTTCCTTCCTCCG | GAACCGCT | TGCACC | HPMPPNRRGSRSRP |
| | | | | GTGCAGCATGGGTTCTCGTCAGTCMTGACGGGCTAGGGAAGGCGGTG | TCCTTTTTC | AGATGG | EEPSRREPPXPRACQ |
| | | | | CTGCCAGTACGTCCGAAAGAGTGCCGGTTGCGCAAGCGACCGCGCCAC | CCTGCGCC | ACCTTCA | GLRVWSPPQQRMPT |
| | | | | TCAGGTGAGTAGCCAAGGGTCTTACAGTTCACCGGACCCGAWAACGCG | TGGCCTGG | CTTCGA | PWQTLWLEELSRATT |
| | | | | AAAACCCCAACTCGGGCTAGTAGCCGAAGACCTGGGTCCCCCCCMGGT | TATTGCAG | GAGGAT | FKAFEASVARLTEELS |
| | | | | CAGAGTAGGCGAACGCCWGKGCTCAGAGGACGGAACGCGGAAAACAC | TACCTCCA | TCTTCAG | AAARPGQPRGGNNR |
| | | | | CCCCAGGTCCCAAGGACGCCCTGATCCACTGACAAGAACGCTCGAGGCA | GGATTAGC | CAATGG | PATRRDHRLQPQRR |
| | | | | CGCCAGGAGACCCCCAGCTAGGGTGGACCGCCGACTGCAGGTCCGGAG | GCCAACTA | ACGACC | PRRQRYDPAAASRIQ |
| | | | | GACCCTCCCAGGAGGGTGGACCAGCGAACCCAAGTTGGCGACGAACCC | GTCCGGCA | CCGCTCC | KLYRANRPKAVREILE |
| | | | | TGACGCACCCCCCACGATGTCAGGACCCCGACAGGCGGCGGTGGACCA | GACTGTCG | ACCCGA | GPSAFCQVPRETLFN |
| | | | | CTGACCATCGACCGACCCCCAGAGGCAGAGAGACTCTCAGAGCCCGGA | GAATACAG | AGAGGA | YFSRVFNPPAEAAAP |
| | | | | ACCCCGGCTGACGAGAGCCGCCTCCCGGCGGAGGACCCCGGAGCCTGA | CAATAGAA | CCCCCG | RPATVEALTPVPPAE |
| | | | | GGATGCCCCCCGGATGACGGCGGAGCGCCCCGAGCGACAGCGGACCCC | AGWGAGC | CGATGA | GFEDAFTPQEVEARL |
| | | | | TCCGGACCCCCACGGCCCCTCGGTGACGATGGCGGGCCCCGAACGACG | TGACTAGC | GACTCT | KRTRDTAPGRDGIRY |
| | | | | ACGACCCCCGGACCCCGGCGGTCCCGAGGACGCCCCCCCCGAGGGTCT | AGCTTGCT | ATATGG | SLLKKRDPGCLVLSVL |
| | | | | CCCCACGCTGGTGGAGGAGCCCCGGACCCCCCCGACACCGGACCCCCCC | TTCCTTCCT | ACTGAG | FNRCREFRRTPTTWK |
| | | | | ACGGACGACCCAGGCGAAGGCGTAGACATGACAGCACTCACGTTCCTC | CCGGTGCA | ACACTTT | RAMTVLIHKKGDPTD |
| | | | | CCCTTCCCCCTCCCGGCGAAGCTGTTCTGCCCGACCTGCCACCCGCCAAG | GCATGGGT | TTCTTCG | PGNWRPIALCSTVAK |
| | | | | ACAGTACAGGTCGCACGGCGACATGAACAAGCACCTACGGCGCTTCCAC | TCTCGTCA | AACCAC | LYASCLAARITDWAV |
| | | | | CAGCTGCGCCTAGCCTTCTACTGCGCCCTCTGCGGCACCGAGTACGAGG | GTCMTGA | TTCCTCC | TGGAVSRSQKGFMS |
| | | | | CCCTGAAGCTCCTGAAGAACCACCAGAAGGGATGCGAGGGCCACGGAG | CGGGCTAG | ACCATT | TEGCYEHNFTLQMAL |
| | | | | CCGAGAGGAGACCCGGCACGCTGGTGAGGTCCGCTGCCCCGGCCCGCC | GGAAGGC | GCGGAC | DNARRTRKQCAVA |
| | | | | GGACCCAGGCCGCGGTGCGAAGGCCCGCCAGACTGGCCACCCCGCCGA | GGTGCTGC | CATTGTA | WLDISNAFGSVPHRH |
| | | | | CAACCCCACCGGACCAGACCTCCAGGGACCACCCGACGGAGAGACCTG | CAGTACGT | ACGGGT | IFGTLRELGLPDGVID |
| | | | | CCCCAGTGATGCCACCACGCAGGCCTCCGCCCAGGGACCCCCAACCGGA | CCGAAAGA | TTGTGT | LVRELYHGCTTTVRA |
| | | | | CACGACGCCCCGACCAGACAGCCCCCCTCCCAGACCCCCGGGGCCACCC | GTGCCGGT | GTATCTA | TDGETAEIPIRSGVRQ |
| | | | | GATGCCCCCGAACCGCCGGGGATCCCGGAGCGCCCGGAGGAACCGA | TGCGCAAG | TCTTCTT | GCPLSPIIFNLAMEPL |
| | | | | GCCGCCGGGAGCCCCCGKCCCCCGAGCGTGCCAGGGTCTCCGGGTGT | CGACCGCG | TCTCTCT | LRAVAGGPGGLDLY |
| | | | | GGAGCCCTCCCCAGCAGAGGATGCCCACCCCATGGCAAACCCTCTGGCT | CCACTCAG | CAGCGT | GQKLSVLAYADDLVL |
| | | | | GGAGGAGCTCTCCCGGGCCACCACCTTCAAGGCCTTCGAGGCCTCGGTG | GTGAGTAG | CGCGAA | LAPDATQLQQMLDV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCCCGGCTCACAGAGGAGCTCTCGGCGGCCGCCCGGCCCGGCCAGCCC | CCAAGGGT | CCCCCTC | TSEAARWMGLRFNV |
| | | | | CGGGGGGGCAACAACAGACCGGCGACGCGACGGGACCACAGACTGCA | CTTACAGT | CCTCCCC | AKCASLHIDGRQKSR |
| | | | | GCCGCAGAGGCGACCCAGGCGCCAGCGCTACGACCCGGCGGCAGCCTC | TCACCGGA | TTCCCCT | VLDSTLTIQGQAMRH |
| | | | | CCGGATCCAGAAGCTGTACCGGGCCAACCGTCCCAAGGCGGTGAGAGA | CCCGAWA | CCCCCTC | LRDGEAYCHLGTPTG |
| | | | | GATCCTGGAGGGACCCTCGGCCTTCTGCCAGGTCCCCCGGGAGACTCTG | ACGCGAAA | CCCCCCA | HRAKQTPEETINGIV |
| | | | | TTCAACTACTTCAGCAGGGTCTTCAACCCCCCAGCAGAAGCCGCCGCCC | ACCCCAAC | CCCCCG | QDAHKLDSSLLAPW |
| | | | | CACGCCCTGCGACCGTCGAAGCGCTGACCCCCGTCCCCCCGGCGGAGG | TCGGGCTA | GGCTTA | QKIDAVNTFLIPRVAF |
| | | | | GGTTCGAGGATGCCTTCACGCCGCAGGAAGTGGAAGCCCGCCTCAAGA | GTAGCCGA | GTTGGC | VLRGSAVPKTPLKKA |
| | | | | GGACCAGGGACACCGCCCCCGGCAGGGACGGCATCAGGTACAGTCTCC | AGACCTGG | TAACATT | DAEIRRLLKKWLHLPL |
| | | | | TCAAAAAGCGTGACCCGGGCTGCCTTGTTCTTTCTGTTCTCTTCAACAGG | GTCCCCCC | GTATCTC | RASNEVLHIPYRQGG |
| | | | | TGCAGAGAGTTCCGGCGCACGCCCACCACCTGGAAGAGGGCCATGACG | CMGGTCA | CTGTAA | ANVPRMGDLCDIAV |
| | | | | GTCCTCATCCACAAGAAGGGAGACCCGACCGACCCGGGCAACTGGAGA | GAGTAGG | CCTAGTT | VTHAFRLLTCPDXTVS |
| | | | | CCCATCGCCCTGTGCTCCACCGTCGCCAAGCTGTACGCCAGCTGCCTGG | CGAACGCC | GCGTTC | IIAASALEETARKRIGR |
| | | | | CGGCCCGCATCACCGACTGGGCGGTGACCGGCGGGGCCGTCAGCCGGA | WGKGCTC | CCCTCCT | QPTRRDLATFLSGSLE |
| | | | | GCCAGAAGGGCTTCATGTCGACGGAGGGCTGCTACGAACACAACTTCA | AGAGGAC | CACCCCC | GEFSRDGGDFASLW |
| | | | | CCCTCCAGATGGCCCTGGACAATGCCCGGAGGACCAGGAAGCAGTGCG | GGAACGC | ATCCCTC | SRARNATRRLGKRIG |
| | | | | CGGTGGCGTGGCTGGACATCTCCAATGCCTTCGGCTCCGTGCCCCACCG | GGAAAAC | TATTGTT | CAWTWTEERRELGV |
| | | | | CCACATCTTCGGCACCCTCCGCGAGCTGGGCCTACCGGACGGCGTCATC | ACCCCCAG | AGTCCCT | SLQPAPHADRVTVTP |
| | | | | GACCTGGTGCGAGAGCTCTACCACGGCTGCACCACGACCGTCCGCGCCA | GTCCCAAG | CGCTCG | RTRTFLERFLKDAVR |
| | | | | CCGACGGAGAGACCGCGGAGATCCCCATCCGGTCGGGGGTGAGACAG | GACGCCCT | GGCGCT | NKYAGDLRAKPDQG |
| | | | | GGCTGCCCCCTCAGCCCCATCATCTTCAACCTGGCCATGGAACCGCTCCT | GATCCACT | CTGTATT | KVFDVTSKWDSSNH |
| | | | | TCGAGCCGTGGCAGGCGGCCCCGGCGGGCTCGACCTGTACGGCCAGAA | GACAAGA | TCCCTAC | FMPSGSFTRFADWR |
| | | | | GTTGAGCGTCCTGGCCTACGCCGACGACCTCGTTCTCCTCGCCCCCGAC | ACGCTCGA | CGGCTT | FLHRARLNCLPLNGA |
| | | | | GCCACCCAGCTGCAGCAGATGCTGGACGTGACGTCCGAGGCGGCCAGG | GGCACGCC | TGTCATC | VRFGHRDKRCRRCG |
| | | | | TGGATGGGCCTGCGCTTCAACGTCGCCAAGTGCGCCTCCCTGCACATCG | AGGAGAC | TTTTTTG | YVAETLPHVLCSCKP |
| | | | | ACGGSAGGCAGAAGAGCCGCGTCCTGGACTCCACCCTCACGATCCAGG | CCCCAGCT | GATTCA | HARAWQLCHNAVQ |
| | | | | GCCAGGCGATGAGGCACCTGCGCGACGGCGAGGCCTACTGCCACCTGG | AGGGTGG | CAATCCT | DRLVRAIPAAAGEISV |
| | | | | GGACGCCCACCGGCCACCGGGCCAAGCAGACGCCGGAGGAGACCATCA | ACCGCCGA | AAACAT | NRTVPGCESQMRPD |
| | | | | ACGGGATCGTGCAGGACGCCCACAAGCTGGACTCGTCCCTGCTGGCCCC | CTGCAGGT | CTACTAA | IVITNEEAKKVVIVDV |
| | | | | CTGGCAGAAGATAGACGCGGTGAACACCTTCCTCATCCCCCGCGTCGCG | CCGGAGG | TAAAAG | TIPFENRRQAFTDAR |
| | | | | TTCGTCCTGAGAGGCTCGGCGGTCCCCAAGACCCCCCTCAAGAAGGCG | ACCCTCCC | TCAATC | ARKREKYAPLADILRG |
| | | | | GACGCCGAGATCCGGCGGCTGCTCAAGAAGTGGCTGCACCTGCCGCTG | AGGAGGG | (SEQ ID | RGYDVTVDALIVGTL |
| | | | | AGGGCCAGCAATGAGGTCCTGCACATCCCCTACCGGCAGGGAGGTGCC | TGGACCAG | NO: | GAWDPSNESVLHAC |
| | | | | AACGTCCCCCGCATGGGAGACCTCTGCGACATCGCGGTGGTCACCCACG | CGAACCCA | 1304) | RVSRRYAKLMRCLM |
| | | | | CCTTCCGCCTCCTGACCTGCCCGGACSCGACGGTAAGTATCATCGCCGCC | AGTTGGCG | | VSDTIRWSRDIYVEHI |
| | | | | AGCGCCCTCGAGGAGACCGCCCGCAAGAGGATCGGGAGGCAGCCCACC | ACGAACCC | | TGHRQYTDPTRRTAA |
| | | | | AGACGTGACTTGGCCACCTTCCTCAGCGGCTCGCTGGAGGGCGAGTTCA | TGACGCAC | | GPDPEGTA (SEQ ID |
| | | | | GCAGAGACGGCGGGGACTTTGCCTCGCTGTGGAGCCGAGCCCGCAACG | CCCCCACG | | NO: 1426) |
| | | | | CCACGCGCCGCCTCGGGAAGCGCATCGGCTGCGCCTGGACCTGGACCG | ATGTCAGG | | |
| | | | | AGGAGCGCCGGGAGCTGGGAGTCTCCCTGCAACCAGCCCCGCACGCCG | ACCCCGAC | | |
| | | | | ACCGCGTCACCGTGACGCCCCGCACGAGGACCTTCCTGGAGAGGTTCCT | AGGCGGC | | |
| | | | | GAAGGACGCCGTCCGAAACAAGTACGCCGGCGACCTGAGGGCCAAACC | GGTGGACC | | |
| | | | | CGACCAGGGCAAGGTCTTCGACGTCACCTCGAAGTGGGACTCCAGCAA | ACTGACCA | | |
| | | | | CCACTTCATGCCCAGCGGGAGCTTCACGCGCTTCGCGGACTGGCGCTTC | TCGACCGA | | |
| | | | | CTCCACCGCGCCCGCCTCAACTGCCTGCCTCTGAACGGGGCCGTCCGCTT | CCCCCAGA | | |
| | | | | CGGCCACCGGGACAAGAGGTGCCGACGGTGCGGCTACGTGGCAGAGA | GGCAGAG | | |
| | | | | CCCTCCCCCACGTGCTGTGCAGCTGCAAGCCGCACGCCAGAGCCTGGCA | AGACTCTC | | |
| | | | | GCTCTGCCACAACGCTGTCCAGGACCGCCTGGTGAGGGCCATCCCGGCC | AGAGCCCG | | |
| | | | | GCAGCGGGGGAGATCTCCGTGAACCGCACCGTCCCGGGCTGCGAGAGC | GAACCCCG | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAGATGCGCCCCGACATCGTCATCACCAACGAGGAGGCCAAGAAGGTC | GCTGACGA | | |
| | | | | GTGATCGTGGACGTGACCATCCCCTTCGAGAACCGGCGCCAAGCCTTCA | GAGCCGCC | | |
| | | | | CCGACGCCCGGGCTCGCAAGCGGGAGAAGTACGCCCCGCTGGCCGACA | TCCCGGCG | | |
| | | | | TCCTGAGGGGCCGCGGCTACGACGTGACGGTCGACGCGCTCATCGTGG | GAGGACCC | | |
| | | | | GAACGCTCGGAGCCTGGGACCCCAGCAACGAGAGCGTCCTGCATGCCT | CGGAGCCT | | |
| | | | | GCCGCGTCTCCCGCCGCTACGCCAAGCTGATGCGCTGCCTCATGGTGTC | GAGGATG | | |
| | | | | CGACACCATCCGTTGGTCCCGTGACATCTACGTGGAGCACATCACGGGC | CCCCCCGG | | |
| | | | | CACCGCCAGTACACCGACCCCACCAGACGAACCGCCGCCGGACCGGAC | ATGACGGC | | |
| | | | | CCAGAGGGGACCGCCTGAACCCCCCCTCTGCACCAGATGGACCTTCACT | GGAGCGC | | |
| | | | | TCGAGAGGATTCTTCAGCAATGGACGACCCCGCTCCACCCGAAGAGGA | CCCGAGCG | | |
| | | | | CCCCCGCGATGAGACTCTATATGGACTGAGACACTTTTTCTTCGAACCAC | ACAGCGG | | |
| | | | | TTCCTCCACCATTGCGGACCATTGTAACGGGTTTGTGTGTATCTATCTTCT | ACCCCTCC | | |
| | | | | TTCTCTCTCAGCGTCGCGAACCCCCTCCCTCCCCTTCCCCTCCCCCTCCCC | GGACCCCC | | |
| | | | | CCCACCCCCGGGCTTAGTTGGCTAACATTGTATCTCCTGTAACCTAGTTG | ACGGCCCC | | |
| | | | | CGTTCCCCTCCTCACCCCCATCCCTCTATTGTTAGTCCCTCGCTCGGGCGC | TCGGTGAC | | |
| | | | | TCTGTATTTCCCTACCGGCTTTGTCATCTTTTTTGGATTCACAATCCTAAA | GATGGCG | | |
| | | | | CATCTACTAATAAAAGTCAATC (SEQ ID NO: 1058) | GGCCCCGA | | |
| | | | | | ACGACGAC | | |
| | | | | | GACCCCCG | | |
| | | | | | GACCCCGG | | |
| | | | | | CGGTCCCG | | |
| | | | | | AGGACGCC | | |
| | | | | | CCCCCCGA | | |
| | | | | | GGGTCTCC | | |
| | | | | | CCACGCTG | | |
| | | | | | GTGGAGG | | |
| | | | | | AGCCCCGG | | |
| | | | | | ACCCCCCC | | |
| | | | | | GACACCGG | | |
| | | | | | ACCCCCCC | | |
| | | | | | ACGGACG | | |
| | | | | | ACCCAGGC | | |
| | | | | | GAAGGCG | | |
| | | | | | TAGACATG | | |
| | | | | | ACAGCACT | | |
| | | | | | CACGTTCC | | |
| | | | | | TCCCCTTC | | |
| | | | | | CCCCTCCC | | |
| | | | | | GGCGAAG | | |
| | | | | | CTGTTCTG | | |
| | | | | | CCCGACCT | | |
| | | | | | GCCACCCG | | |
| | | | | | CCAAGACA | | |
| | | | | | GTACAGGT | | |
| | | | | | CGCACGGC | | |
| | | | | | GACATGAA | | |
| | | | | | CAAGCACC | | |
| | | | | | TACGGCGC | | |
| | | | | | TTCCACCA | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | GCTGCGCC TAGCCTTC TACTGCGC CCTCTGCG GCACCGAG TACGAGGC CCTGAAGC TCCTGAAG AACCACCA GAAGGGA TGCGAGG GCCACGGA GCCGAGA GGAGACCC GGCACGCT GGTGAGG TCCGCTGC CCCGGCCC GCCGGACC CAGGCCGC GGTGCGA AGGCCCGC CAGACTGG CCACCCCG CCGACAAC CCCACCGG ACCAGACC TCCAGGGA CCACCCGA CGGAGAG ACCTGCCC CAGTGA (SEQ ID NO: 1181) | | |
| NeSL | Utopia-1_CMy | — | *Chelonia mydas* | CTCTTCTTATGAATACTTGCAACACCTGCACTGAAGATGGATTCTCCGGC TGCTATTTTTGAAAAACTGATGCTGCTTTGAAGGTGTATTCTGCTGCTGC TACCTTGGAAGGAAATTCTCTCTCTGCTCCTGAGACATCCCCAGCTGCAC CGTGTACCACCACCACCACTGCTGCTGCTCCACAGAAGGTTTCTCGGAC AATGACTACAAAGAAGGTCCTAGGTGCCTCCACAACATTACAGACCAGC AGCACGAAGGGGAAGAACAGTGGCTGCTCAAAGGACCCCCTCCGAGAT GCTGTTCCAGGAAGATCCTGGATTCTGAGGCCGGCCTGTCGGGACATCA CAACCAGAAGGAACATCCCCCCCGCCCCCCAGCAGCAGCAGCCGCCAAT GGAGAGCCCCCCCACTCTGCAGCTGCAAGATGCTCTCAGGCGACCATCT CCCACCCCCGCAGCTGCCCAGGTCGCTGACGCTGGTGGTGCTCTCGCTG CTCTACACACCATCAAGAGAGGAATCTCCGTAGACTGGACCAGCATCTC TCCAAAGASCMCCCAGAGGSTCACCAGCGCCTCGCCGGATGCCTGCCCA GCCTCAGAAACCACCCAGAGGGACCSCAGGWSCCTGCTGGACGCCCGC CCAGCCGGACCTCTCGACCCTACCCGCCCACACCAGGATGAACCAGCCA | CTCTTCTTA TGAATACT TGCAACAC CTGCACTG AAGATGG ATTCTCCG GCTGCTAT TTTTGAAA AACTGATG CTGCTTTG AAGGTGTA TTCTGCTG CTGCTACC TTGGAAGG | TGAGCC GGTACG ACATCG TGCATC AACTAT GAGAAA GGGACT GAGAGA CTTTTTC CATTGG ACCATAT GAACTG GAACCA TAAACTC | MTTKKVLGASTTLQT SSTKGKNSGCSKDPL RDAVPGRSWILRPAC RDITTRRNIPPAPQQ QQPPMESPPTLQLQ DALRRPSPTPAAAQV ADAGGALAALHTIKR GISVDWTSISPKXXQ RXTSASPDACPASET TQRDXRXLLDARPAG PLDPTRPHQDEPASD TADAAGTPLLQGNE DTIYLQYPLAADMLIC PICSPPQSFHLLGVVT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCGATACCGCTGATGCTGCTGGAACCCCCCTGCTGCAAGGTAATGAGG | AAATTCTC | ACTGAA | RHLKRCHSKRVAFSC |
| | | | | ACACCATCTACCTGCAGTATCCCCTCGCTGCGGACATGCTCATCTGCCCC | TCTCTGCT | CATTAA | ALCSLPFETQKQCKM |
| | | | | ATCTGCTCTCCGCCCCAAAGCTTCCACCTCCTCGGTGTCGTCACCAGGCA | CCTGAGAC | ATCTCAC | HQVACRKCLKGTTQS |
| | | | | CCTGAAGAGATGCCACAGCAAGCGGGTTGCCTTCAGCTGTGCCCTCTGC | ATCCCCAG | CAAATG | PAPAPSPPAARRPAA |
| | | | | AGCCTGCCCTTCGAGACGCAGAAGCAATGCAAGATGCACCAAGTCGCCT | CTGCACCG | AGGGTA | PEPQRRKXTSQAAVK |
| | | | | GCAGGAAATGCCTCAAGGGAACMACACAGTCTCCTGCCCCGGCTCCCA | TGTACCAC | AATCCAT | KPAPVARPAERDAAI |
| | | | | GCCCTCCTGCTGCACGCCGGCCCGCTGCTCCTGAGCCTCAACGAAGAAA | CACCACCA | CCTCATC | EKVPAASGNITQVLA |
| | | | | GSCGACCTCGCAAGCTGCCGTCAAGAAGCCTGCCCCCGTCGCCAGGCCA | CTGCTGCT | ATCGTAT | SRRPVSPSHVAKXIS |
| | | | | GCGGAACGGGATGCTGCGATCGAGAAGGTACCTGCTGCCTCGGGGAAC | GCTCCACA | CCACTCA | MLRRLSAASPPVQH |
| | | | | ATCACCCAGGTCCTCGCCAGCAGGAGGCCCGTCTCACCCTCTCATGTCG | GAAGGTTT | TTATACT | VPVPRRISAPPRIAAR |
| | | | | CCAAGMAGATCTCCATGCTGAGACGACTCAGTGCTGCCTCGCCACCTGT | CTCGGACA | CCACAC | DPVAGRASAAPQTA |
| | | | | CCAGCACGTCCCCGTCCCCAGAAGGATCAGCGCCCCACCGCGCATAGCT | (SEQ ID | CTGAAC | LRTPAAGGASTTPQT |
| | | | | GCTCGAGATCCTGTCGCCGGAAGAGCCAGCGCCGCCCCTCAGACCGCCC | NO: 1182) | ATAGCC | ALRTPTAGGASAMP |
| | | | | TGCGAACTCCAGCCGCCGGAGGAGCCAGCACCACGCCTCAGACCGCCC | | ATTATAT | QTTLPXPRRPDWRN |
| | | | | TGCGAACTCCAACCGCCGGAGGAGCCAGTGCCATGCCTCAGACCACCCT | | GAACAA | QPRSHSKAPGLHRQT |
| | | | | GCCAGMCCCCAGACGTCCAGACTGGAGGAACCAGCCCCGCAGCCACAG | | CATACCC | DQHGPQVHSAGHCL |
| | | | | CAAAGCACCGGGCCTTCATCGCCAGACGGACCAGCACGGCCCCCAAGTC | | CCATATC | REISRSSSNRLGSSHS |
| | | | | CATTCTGCGGGACACTGCCTACGGGAGATCTCACGCTCCAGCAGCAACC | | TCAATGT | AAATHRRTGGVPAT |
| | | | | GCCTAGGCAGCAGCCACTCATAGAAGGACCGGCGGTGTCCCAGCAACC | | CTGTACT | PEPDRVSPTTSNAXIP |
| | | | | CCCGAGCCGGACCGCGTCTCTCCGACCACCAGCAACGCCASCATCCCGC | | TTGACCC | PEIPPQHPTEGNPDP |
| | | | | CAGAGATCCCGCCCCAGCACCCAACCGAAGGGAATCCTGACCCACGAG | | GTTAAC | RDRRQADHTAGSEP |
| | | | | ATAGACGGCAGGCCGACCATACAGCAGGCTCWGAGCCTGCACCAGAC | | CTTTTAC | APDEVEDXEGQRPM |
| | | | | GAGGTCGAGGACCMTGAGGGCCAGCGGCCGATGGTGAGGGCTGCCAC | | CCCCAAT | VRAATPWQTAWTEE |
| | | | | NCCGTGGCAGACTGCCTGGACCGAGGAGCTACAAGCGGCAGCTTCCTT | | CGGGGA | LQAAASFDDFDLLVD |
| | | | | TGACGACTTCGACCTCCTCGTAGACAGGCTCACCCGAGAACTGTCTGCG | | TATTGCA | RLTRELSAEIAPRRSS |
| | | | | GAAATCGCTCCCAGGAGGAGTTCGAACCAGGAGAACGCCCCGCCTGCC | | GATTAT | NQENAPPAHRTPAP |
| | | | | CACAGAACGCCTGCTCCGAACCACAACACCACCACCAGGGGAGCCAGA | | GTATTCC | NHNTTTRGARSRDA |
| | | | | AGTAGAGACGCCAGCCGCCGCTACGATCCAGCAGCGGCTTCAAGGATC | | TTACGCC | SRRYDPAAASRIQKLY |
| | | | | CAAAAGCTGTACCGGGCAAACCGCTCCAAGGCCATGAGGGAGATCCTA | | ACCCGA | RANRSKAMREILDGP |
| | | | | GACGGGCCCTCGCCCTACTGCACGATCCCATCTGAGCGTCTCTACAGCT | | TCCTAAA | SPYCTIPSERLYSYFKD |
| | | | | ACTTCAAGGATGTATTCGACCGCATAGCCCGGAATGACGCGCAGCGCCC | | CCGAAT | VFDRIARNDAQRPEC |
| | | | | AGAGTGCCTCCGCCCCCTGCCCCGTGTCGACGAAGCAGGTGTCCTGGAA | | TTCGCAC | LRPLPRVDEAGVLET |
| | | | | ACTGACTWTACGCCCAAGGAAGTGATGGCCAGACTCTCAAAAACAAAA | | CCCTTGA | DXTPKEVMARLSKTK |
| | | | | AACACAGCTCCTGGGAAAGACGGCATCCCCTACAGCCTCCTGAAAAAGC | | TAATCTG | NTAPGKDGIPYSLLKK |
| | | | | GAGATCCCGGCTGCCTGGTCCTCGCCACGCTCTTCAACCAGTGCAAGCG | | TACCTTA | RDPGCLVLATLFNQC |
| | | | | ATTCTGCCGGACTCCCAGCTCCTGGAAGAAGGCCATGACGGTACTGGTG | | TTCCCTG | KRFCRTPSSWKKAM |
| | | | | TACAAGAAGGGCGAGCGGGATGACCCCAGCAACTGGAGGCCCATCTCC | | ATAACC | TVLVYKKGERDDPSN |
| | | | | CTCTGCTCCACGATGTACAAGCTCTATGCCAGCTGCCTGGCGTCGAGGA | | AGAAAC | WRPISLCSTMYKLYA |
| | | | | TCACGGAGTGGTCGGTGAGCGGGGGAGCCATCAGCTCCATCCAGAAAG | | TTCTATG | SCLASRITEWSVSGG |
| | | | | GCTTCATGTCCTGCGAGGGCTGCTACGAACACAACTTCGTCCTCCAAACC | | CTTAAAC | AISSIQKGFMSCEGCY |
| | | | | ACCATCGAAACGGCCAGAAGGGCGCGGAGGCAGTGCGCGGTAGCGTG | | TCTGTAC | EHNFVLQTTIETARR |
| | | | | GCTCGACCTGGCTAACGCCTTTGGGTCCATGCCCCACCACCACATCTTTG | | CGTTTTT | ARRQCAVAWLDLAN |
| | | | | CCACGCTCCAGGAGTTTGGGATGCCAGAGAACTTCCTTCGTGTGATCCG | | TTTTATT | AFGSMPHHHIFATLQ |
| | | | | AGAGGTGTACGAGGGATGCAGCACCACCATTCGCTCGGTCGAAGGGGA | | TCAACAT | EFGMPENFLRVIREV |
| | | | | GACCGCCGAGATCCCGATCCGGAGCGGAGTTAAGCAGGGCTGTCCCCT | | CATCTTA | YEGCSTTIRSVEGETA |
| | | | | CAGCCCCATCATCTTTAACCTCGCCATGGAGCCGTTGCTGCGAGCGATCT | | ATAAAA | EIPIRSGVKQGCPLSPI |
| | | | | CCAATGGCACAGATGGCTTCAACCTCCACGGTGAGAGGGTGAGCGTCC | | TTATTAA | IFNLAMEPLLRAISNG |
| | | | | TGGCTTACGCGGATGACCTGGTCCTGACCGCGGATGACCCAGAGAGCC | | A (SEQ | TDGFNLHGERVSVLA |
| | | | | TCCAAGGTATGCTAGATGCCACCAGTCGAGCTGCCGACTGGATGGGGC | | ID NO: | YADDLVLTADDPESL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCCGCTTCAATGCAAAGAAGTGCGCAACTCTCCACATCGACGGCAGCAA | | 1305) | QGMLDATSRAADW |
| | | | | AAGGGACTCGGTGCAGACGACGGGGTTCCAGATCCAGGGCGAGCCCGT | | | MGLRFNAKKCATLHI |
| | | | | CATCCCCCTGGCAGAGGGGCAGGCGTACCAGCACCTCGGCACGCCGAC | | | DGSKRDSVQTTGFQI |
| | | | | GGGTTTCCGTGTCCGGCAGACACCCGAGGACACCATCCAGGAGATCTTG | | | QGEPVIPLAEGQAYQ |
| | | | | CAGGATGCCGCCAAGATCGACGCCTCCCTGCTAGCACCGTGGCAGAAG | | | HLGTPTGFRVRQTPE |
| | | | | ATAAACGCCCTGAACACCTTCCTGATCCCCCGCATCTCGTTCGTCCTAAG | | | DTIQEILQDAAKIDAS |
| | | | | GGGATCCGCCGTGGCGAAGGTACCCCTCAACAAGGCAGACAAGATCGT | | | LLAPWQKINALNTFLI |
| | | | | CCGGCAGCTGGTGAAGAAGTGGCTGTTCCTTCCCCAGAGAGCCAGCAA | | | PRISFVLRGSAVAKVP |
| | | | | CGAGCTGGTCTACATCGCCCACAGGCATGGCGGTGCCAACGTCCCCCGC | | | LNKADKIVRQLVKKW |
| | | | | ATGGGCGACCTGTGTGACATCGCGGTGATCACCCACGCCTTCCGCCTGC | | | LFLPQRASNELVYIAH |
| | | | | TGACGTGTCCCGACGCCATGGTAAGGAACATCGCGGCAAACGCCCTCCA | | | RHGGANVPRMGDL |
| | | | | TGACGCGACAAAGAAGCGGATCGGCAGAGCCCCCTCCAACCAAGACAT | | | CDIAVITHAFRLLTCP |
| | | | | CGCCACCTTCCTGAGCGGTTCCCTGGATGGCGAATTCGGACGGGACGG | | | DAMVRNIAANALHD |
| | | | | GCGCGACATCGCTTCACTGTGGTCCCGCGCTCGCAACGCCACGCGTCGC | | | ATKKRIGRAPSNQDI |
| | | | | CTGGGGAAGCGCATCGGCTGCCGCTGGGAGTGGTGCGAGGAGCGCCA | | | ATFLSGSLDGEFGRD |
| | | | | GGAGCTGGGAGTCCTGGTGCCGCAGATCAGGTCCAACGACAACACCAT | | | GRDIASLWSRARNAT |
| | | | | CGTCACCCCGAGCGCCAGGGGCATGCTGGAGAGGACCCTGAAGGCAGC | | | RRLGKRIGCRWEWC |
| | | | | CATCCACTCACTGTACGTGGAAACCCTGAAGCGTAAACCGGACCAGGGT | | | EERQELGVLVPQIRS |
| | | | | AAAGCCTTCGAACTGACCAGCAAGTGGGACGCCAGCCAACCACTTCCTC | | | NDNTIVTPSARGMLE |
| | | | | GCCGGGGGCGGCTTCACCCGTTTCGCCGACTGGCGGTTCATCCACCGTG | | | RTLKAAIHSLYVETLK |
| | | | | CCCGGCTCAACTGCGTCCCGCTCAACGGAGCCGTCCGCCACGGGAACCG | | | RKPDQGKAFELTSK |
| | | | | AGACAAGCGTTGCAGGAAGTGCGGCTACTCCAACGAGACCCTGCCCCA | | | WDASQPLPRRGRLH |
| | | | | CGTCCTGTGCAGCTGCAAGCCCCACTCCAGAGCCTGGCAGCTGCGCCAC | | | PFRRLAVHPPCPAQL |
| | | | | AATGCCATCCAGAACCGCCTGGTGAAAGCCATCGCACCGCGCCTGGGG | | | RPAQRSRPPREPRQA |
| | | | | GAGGTCGCCGTGAACTGCGCCATCCCCGGTACTGACAGCCAGTTGCGAC | | | LQEVRLLQRDPAPRP |
| | | | | CTGACGTGGTAGTCACCGACGAGGCCCAGAAAAAGATCATCCTCGTCG | | | VQLQAPLQSLAAAP |
| | | | | ACGTCACGGTCTCCTTTGAGAACAGGACCCCGGCCTTCCGCGAAGCCCG | | | QCHPEPPGESHRTAP |
| | | | | AGCTCGTAAGCTGGAAAAATACGCCCCCCTGGCCGACACCCTGAGAGC | | | GGGRRELRHPRYPAS |
| | | | | GAAGGGCTACGAGGTGCAGATGGATGCCCTGATCGTCGGAGCCCTGGG | | | GTPANHFLAGGGFT |
| | | | | CGCTTGGGACCCCTGCAATGAGCGTGTGCTGCGGACCTGTGGGATCGG | | | RFADWRFIHRARLNC |
| | | | | TCGACGCTACGCACGGCTCATGCGGCGCCTCATGGTCTCGGACACCATC | | | VPLNGAVRHGNRDK |
| | | | | CGATGGTCCAGGGACATCTACATCGAACACATCACCGGCCACCGACAGT | | | RCRKCGYSNETLPHV |
| | | | | ACCAGGAGGTGTGAGCCGGTACGACATCGTGCATCAACTATGAGAAAG | | | LCSCKPHSRAWQLR |
| | | | | GGACTGAGAGACTTTTTCCATTGGACCATATGAACTGGAACCATAAACT | | | HNAIQNRLVKAIAPR |
| | | | | CACTGAACATTAAATCTCACCAAATGAGGGTAAATCCATCCTCATCATCG | | | LGEVAVNCAIPGTDS |
| | | | | TATCCACTCATTATACTCCACACCTGAACATAGCCATTATATGAACAACA | | | QLRPDVVVTDEAQK |
| | | | | TACCCCCATATCTCAATGTCTGTACTTTGACCCGTTAACCTTTTACCCCCA | | | KIILVDVTVSFENRTP |
| | | | | ATCGGGGATATTGCAGATTATGTATTCCTTACGCCACCCGATCCTAAACC | | | AFREARARKLEKYAPL |
| | | | | GAATTTCGCACCCCTTGATAATCTGTACCTTATTCCCTGATAACCAGAAA | | | ADTLRAKGYEVQMD |
| | | | | CTTCTATGCTTAAACTCTGTACCGTTTTTTTTTATTTCAACATCATCTTAAT | | | ALIVGALGAWDPCN |
| | | | | AAAATTATTAAA (SEQ ID NO: 1059) | | | ERVLRTCGIGRRYARL |
| | | | | | | | MRRLMVSDTIRWSR |
| | | | | | | | DIYIEHITGHRQYQEV |
| | | | | | | | (SEQ ID NO: 1427) |
| NeSL | Utopia- | — | *Chrysemys* | TTTTTTCTGATGCTTGACTGCAAACACCCATCCAGAAGATGGAATCTCCT | TTTTTTCTG | TGAGCC | MTQDQDADCCPAG |
| | 1_CPB | | *pictabellii* | GCAGCCATTTTTGAAAAAATTGATGCTGCTTTAAAGATATACTCCATTCT | ATGCTTGA | AGAGTG | KDATRGAPPMTQDQ |
| | | | | CCTWKTTTGKAAGAAAACTCTTTTTCAGCTTCAGCTATTCTGTCATCGGC | CTGCAAAC | ACATCG | DADRCPAAPERDAP |
| | | | | TGCTGCTGTTCCTGCTTCCCAGAAAGCTCAGCMAAAACCTATCCTGAAG | ACCCATCC | TTCTCCC | EGTTSSTPDPKTTYHP |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACCWCCCTTGGTGCCTCACGGAAGACCCGGASCACCTGCAAGAACCAA | AGAAGAT | ACTACG | AVRRRAARRGMHLR |
| | | | | AACATTAGGAGCTGGCTGAAGAAACCCCCCGTGGATACCTCWGCAGGG | GGAATCTC | AGAAAG | AQDLDAARCPSGQR |
| | | | | AGACCTGGSTCCAGMAGGACAKCTCTTCGGGACCTCMCATCSAGGAGC | CTGCAGCC | GGACCA | DNVASESSAPPRATS |
| | | | | AAGAATATCTCAACAGCTCTTCAGGAGGGGGACCCCCGGAGAACCCTG | ATTTTTGA | AGTGAC | PPQASLPDPEESPGE |
| | | | | CCCGCTTCCCAGAACCAGGATGCTGATCGCCGCCCCACCGGGAAGGAT | AAAAATTG | CTTCTCC | SAGTTEIRPTEGEAGE |
| | | | | GCCACCGCAGGAGCCCCCCCAATGACCCAGGACCAGGATGCTGATTGCT | ATGCTGCT | GTTGGA | EDRIYLQYPLPTGLLL |
| | | | | GCCCCGCCGGGAAGGATGCCACCAGAGGAGCCCCCCCGATGACCCAGG | TTAAAGAT | TCATATG | CPFCLPVHGVQTLAA |
| | | | | ACCAGGATGCTGATCGCTGCCCCGCTGCTCCAGAGAGGGATGCTCCGG | ATACTCCA | AACTGG | LSKHVRKTYNKRIAFR |
| | | | | AAGGAACCACCTCCTCAACCCCAGACCCCAAAACTACTTACCACCCGGCT | TTCTCCTW | AACCAT | CSRCDLPFETQKKCKF |
| | | | | GTCCGGAGGAGGGCCGCTCGAAGGGGAATGCACCTCAGAGCCCAAGA | KTTTGKAA | AAACTC | HQATCRGPPTTAKV |
| | | | | TCTCGATGCCGCACGCTGCCCTTCCGGGCAAAGAGACAACGTGGCCAGT | GAAAACTC | CCTGAA | NPTDILRVPTLTPTDD |
| | | | | GAGTCCAGCGCCCCCCCAAGAGCGACTTCACCTCCCCAAGCTTCTCTACC | TTTTTCAG | CATTAA | LASAPQPASPESQQI |
| | | | | AGACCCAGAGGAATCACCTGGCGAGTCTGCAGGCACAACAGAGATCCG | CTTCAGCT | ATCTCAC | RGDQPPTEGSVTPAS |
| | | | | CCCCACGGAGGGTGAGGCAGGGGAAGAAGACCGCATCTACCTCCAGTA | ATTCTGTC | CAAATG | RTDDATKRTSPVSRIP |
| | | | | CCCGCTCCCTACAGGTCTCCTCCTCTGCCCCTTCTGTCTCCCCGTCCATGG | ATCGGCTG | AGGGTC | TLDPAVRGTTATSQV |
| | | | | AGTCCAGACCCTCGCGGCCCTCAGCAAACACGTTCGTAAGACCTACAAC | CTGCTGTT | AATCCAT | NNLTRRLSDLIKTIRH |
| | | | | AAACGGATTGCTTTCCGGTGTAGCCGCTGCGATCTCCCCTTCGAGACCC | CCTGCTTC | CCTCATC | NTDTRRCSAPPQVTS |
| | | | | AAAAGAAATGTAAGTTTCATCAAGCCACGTGCAGGGGACCCCCCACGAC | CCAGAAAG | ATCATAT | CRPAVGATSIVPQAA |
| | | | | CGCGAAAGTGAATCCCACTGACATCCTCCGGGTTCCAACCCTGACCCCC | CTCAGCM | CCACTCA | RRDPANGGASRSPQI |
| | | | | ACCGATGATCTGGCTTCAGCACCCCAGCCAGCATCCCCAGAGTCACAGC | AAAACCTA | TTATAM | PQPDPAPGRPNTSSK |
| | | | | AGATAAGGGGGGACCAACCGCCAACTGAGGGAAGCGTAACCCCCGCCT | TCCTGAAG | TCCACAC | VTQRASDRQKPHAP |
| | | | | CGAGGACTGACGATGCCACCAAAAGGACCAGTCCCGTCTCCAGAATCCC | ACCWCCCT | CCGAAC | PRTHQPDAARRRTRT |
| | | | | CACGCTGGACCCTGCTGTGAGGGGGACCACCGCCACCTCTCAGGTCAAC | TGGTGCCT | ACAGCC | IPSASKHDRAPTKPST |
| | | | | AACCTCACCAGACGCCTCAGCGACCTCATAAAAACCATCCGGCACAACA | CACGGAA | ACTCTAT | GASRTPLPPGRSSAA |
| | | | | CGGACACGAGACGCTGCAGCGCTCCCCCACAGGTAACCTCATGCCGCCC | GACCCGGA | GAACTT | SETPRAALPTTPGPPP |
| | | | | TGCCGTAGGAGCAACTAGCATCGTCCCCCAGGCTGCACGGCGAGATCC | SCACCTGC | CATACCC | QDPPEHRSTVRGTTR |
| | | | | AGCCAACGGAGGAGCCTCCCGTAGCCCCCAGATCCCACAGCCAGACCCC | AAGAACCA | TCATATC | PQTVPAAPEPAETTQ |
| | | | | GCCCCCGGGAGACCCAACACCTCCTCCAAGGTTACCCAAAGAGCCTCTG | AAACATTA | TCAATGT | QEERRPRARVATPW |
| | | | | ACCGCCAAAAACCCCATGCCCCACCGAGGACCCACCAGCCGGATGCCGC | GGAGCTG | CTGTACT | QSAWMEELAKAEDF |
| | | | | CCGCAGAAGAACCAGAACCATCCCCAGCGCTTCCAAACACGACCGCGCC | GCTGAAGA | TTGACCC | ENFDTLMDRLTAELS |
| | | | | CCGACAAAGCCCAGCACCGGTGCTTCCAGAACCCCACTCCCTCCCGGAA | AACCCCCC | ATCAAC | AEITARRREPQEAAR |
| | | | | GATCCAGTGCTGCCTCGGAGACACCGAGAGCTGCCCTCCCCACCACACC | GTGGATAC | CTTTTAC | ATRRFPAPSRNNTAR |
| | | | | AGGACCCCCGCCTCAAGACCCACCTGAACACCGCTCCACAGTCCGAGGG | CTCWGCA | CCCCAAT | EGRRGDVGRRYDPA |
| | | | | ACAACAAGGCCGCAAACCGTCCCCGCAGCACCTGAACCTGCAGAGACA | GGGAGAC | CGGGGA | AASRIQKLYRMNRTK |
| | | | | ACGCAGCAGGAGGAGCGACGGCCACGAGCGAGGGTCGCCACGCCGTG | CTGGSTCC | TATTGCA | AMREILDGTSSYCAI |
| | | | | GCAATCCGCCTGGATGGAGGAGCTGGCAAAGGCTGAGGACTTTGAGAA | AGMAGGA | GATTAT | QPERLYSYFKDVFDH |
| | | | | CTTCGACACCCTGATGGACAGACTGACTGCAGAACTGTCTGCGGAAATT | CAKCTCTT | GTATTCC | EAQTNLRRPECLSPLP |
| | | | | ACGGCCAGAAGGAGGGAACCCCAGGAAGCCGCACGGGCCACTCGCAG | CGGGACCT | TCATGCC | RIDLTEDLERDFSPQE |
| | | | | ATTCCCTGCGCCGAGCCGTAACAACACCGCCAGAGAAGGCAGGAGAGG | CMCATCSA | ACCTGA | VQARLSRTKNTAPGK |
| | | | | GGACGTCGGCCGCCGCTACGATCCGGCGGCTGCATCCCGTATTCAGAAA | GGAGCAA | TCTTAAA | DGIRYPLLKKRDPGCL |
| | | | | CTATACAGGATGAACCGGACGAAAGCCATGAGGGAGATCCTCGACGGG | GAATATCT | CCAAAC | VLAAIFNKCKQFHRV |
| | | | | ACCTCCTCCTACTGTGCCATCCAGCCCGAGAGGCTCTACTCCTACTTCAA | CAACAGCT | TTTGCAC | PRSWKKSMTVLIHKK |
| | | | | GGATGTGTTTGATCACGAGGCCCAGACCAACTTGCGACGCCCAGAGTG | CTTCAGGA | CCTCGAT | GXRDDPGNWRPISL |
| | | | | CCTTTCCCCGCTACCCCGGATCGACCTCACGGAGGACTTGGAGCGAGAT | GGGGGAC | AATCTGT | CSTIYKLYASCLAARIT |
| | | | | TTTTCCCCGCAGGAGGTGCAGGCGAGGCTGTCGAGGACCAAAAACACC | CCCCGGAG | ATGTTAT | DWSVCGGAVSSVQK |
| | | | | GCCCCTGGAAAAGATGGCATCCGCTACCCCCTGCTGAAGAAGCGAGAC | AACCCTGC | TCCCTGA | GFMSCEGCYEHNFLL |
| | | | | CCCGGCTGCTTGGTGCTCGCTGCCATCTTCAACAAATGCAAGCAGTTCCA | CCGCTTCC | TAACCA | QTAIQEARRSKRQCA |
| | | | | TCGCGTTCCCCGCTCCTGGAAAAAGTCCATGACCGTGCTCATCCACAAA | CAGAACCA | GAAACT | VAWLDLTNAFGSIPH |
| | | | | AAAGGCGAMCGAGACGACCCCGGCAACTGGAGGCCCATCTCCCTCTGC | GGATGCTG | TCTATGC | HHIFATLGEFGMPET |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCCACCATCTACAAGCTGTATGCCAGCTGCCTCGCGGCAAGGATCACAG | ATCGCCGC | TCAAACT | FIQILRDLYKDCTTTIR |
| | | | | ACTGGTCAGTGTGCGGGGGCGCCGTCAGCTCAGTGCAGAAGGGTTTCA | CCCACCGG | CTGTTCA | ATDGETDAIPIRRGV |
| | | | | TGTCCTGCGAGGGATGCTACGAGCACAACTTCCTCCTTCAGACGGCCAT | GAAGGAT | CTATTTT | KQGCPLSPIIFNLAME |
| | | | | CCAGGAGGCCAGGAGGTCCAAGAGGCAGTGCGCAGTAGCATGGCTTG | GCCACCGC | TTTTAAC | PLIRAISSGPTGFDLH |
| | | | | ACCTGACCAACGCCTTTGGGTCCATACCCCACCATCACATCTTTGCCACC | AGGAGCCC | ATCATCT | GKKLSILAYADDLVLT |
| | | | | CTGGGAGAGTTCGGGATGCCAGAAACCTTCATCCAGATCCTCCGGGACC | CCCCA | TAATAA | ADDPESLQGMLDAT |
| | | | | TCTACAAGGACTGCACCACCACCATCCGCGCCACGGACGGAGAGACGG | (SEQ ID | AATTTTT | SRATDWMGLRFNAK |
| | | | | ACGCCATCCCCATCCGCCGCGGCGTGAAACAAGGATGCCCCCTTAGCCC | NO: 1183) | AAATCT | KCATLHIDGSKRDSV |
| | | | | CATCATCTTCAACCTGGCCATGGAACCGCTCATCCGAGCCATCTCCAGCG | | GTT (SEQ | QTTGFQIQGEPVIPL |
| | | | | GCCCGACCGGCTTCGACCTGCACGGCAAGAAACTCAGCATTCTGGCCTA | | ID NO: | AEGQAYQHLGTPTG |
| | | | | CGCGGACGATCTGGTCCTGACCGCGGATGACCCAGAGAGCCTCCAAGG | | 1306) | FRVRQTPEDTIQEILQ |
| | | | | TATGCTAGATGCCACCAGCCGAGCTACTGACTGGATGGGGCTCCGCTTC | | | DAAKIDASLLAPWQK |
| | | | | AATGCGAAGAAGTGCGCAACTCTGCACATTGACGGCAGCAAAAGGGAC | | | INALNTFLIPRISFTLR |
| | | | | TCGGTGCAGACAACGGGGTTCCAGATCCAGGGTGAGCCCGTCATCCCCC | | | GSAVAKVPLNKADKII |
| | | | | TGGCAGAGGGGCAGGCATACCAGCACCTGGGCACGCCAACAGGGTTCC | | | RKLVKKWLFLPQRAS |
| | | | | GTGTCCGGCAGACACCCGAGGACACCATCCAGGAGATCTTGCAGGACG | | | NELVYIAHRHGGANV |
| | | | | CCGCCAAGATTGATGCCTCCCTGCTGGCACCGTGGCAGAAGATAAACGC | | | PRMGDLCDVAVITH |
| | | | | CCTGAACACCTTCCTGATCCCACGCATCTCGTTCACCCTAAGGGGATCCG | | | AFRLLTCPDATVRNIA |
| | | | | CCGTGGCGAAGGTGCCCCTCAACAAGGCAGACAAGATCATCCGGAAGC | | | ANALRDATEKRIGRA |
| | | | | TGGTGAAGAAGTGGCTGTTCCTTCCCCAGAGAGCCAGCAACGAGCTGG | | | PSNQDIATFLSGSLD |
| | | | | TCTACATCGCCCACAGGCACGGCGGCGCCAACGTCCCCCGCATGGGTGA | | | GEFGRDGRDIASLWS |
| | | | | CCTGTGCGACGTCGCGGTGATCACCCACGCCTTCCGCCTGCTGACATGT | | | RTRNATRRLGKRIGC |
| | | | | CCCGACGCCACGGTGAGGAACATTGCGGCGAACGCCCTGCGTGATGCG | | | RWEWCEERQELGIR |
| | | | | ACAGAGAAGCGGATCGGCAGAGCCCCCTCGAACCAAGACATCGCCACC | | | VPQIRSDDNTIVTPTA |
| | | | | TTCCTGAGCGGCTCCCTGGATGGGGAATTCGGACGGGACGGGCGCGAC | | | RGLLERTLKAAIRSLY |
| | | | | ATCGCTTCACTGTGGTCCCGCACTCGCAACGCCACGCGTCGCCTGGGGA | | | VETLKRKPDQGKAFE |
| | | | | AGCGCATCGGCTGCCGCTGGGAGTGGTGCGAGGAGCGCCAGGAGCTG | | | LTSKWDASNHFLDG |
| | | | | GGAATCCGGGTGCCGCAGATCAGGTCCGACGACAACACCATCGTCACC | | | GGFTRFADWRFIHRA |
| | | | | CCGACGGCCAGGGGCTTGCTGGAGAGGACTCTGAAGGCCGCCATCCGC | | | RLNCVPLNGAVRHG |
| | | | | TCGCTGTACGTGGAAACCCTGAAGCGTAAACCGGACCAGGGTAAAGCC | | | NRDKRCRKCGYPNET |
| | | | | TTTGAGTTGACCAGCAAGTGGGACGCCAGCAACCACTTCCTCGACGGG | | | LPHVLCSCKPHSRAW |
| | | | | GGCGGCTTCACCCGTTTCGCCGACTGGCGGTTCATCCACCGTGCCCGGC | | | QLRHNAIQNRLVKAI |
| | | | | TCAACTGCGTCCCGCTCAACGGAGCCGTCCGCCACGGGAACCGAGACA | | | APRLGEISVNCTIAGT |
| | | | | AGCGTTGCAGGAAGTGCGGCTACCCCAACGAGACCCTGCCCCACGTCCT | | | DSQLRPDVVVTDEA |
| | | | | GTGCAGCTGCAAACCCCACTCCAGAGCCTGGCAGCTGCGCCACAACGCC | | | QKKIILVDVTVSFENR |
| | | | | ATCCAGAACCGCCTGGTGAAAGCCATCGCGCCACGCCTGGGGGAGATC | | | TPAFREARARKLEKY |
| | | | | TCCGTGAACTGCACCATCGCCGGTACCGACAGCCAGCTACGACCTGACG | | | APLADTLRAKGYEVQ |
| | | | | TGGTCGTCACCGACGAGGCCCAGAAAAAGATCATCCTCGTCGACGTCAC | | | MDALIVGALGAWDP |
| | | | | GGTCTCCTTTGAGAACAGGACCCCGGCATTTCGCGAAGCCCGAGCTCGT | | | CNERVLRTCGIGRRY |
| | | | | AAGCTGGAAAAGTACGCCCCCCTGGCTGACACCCTGAGAGCGAAGGGC | | | ARLMRRLMVSDAIR |
| | | | | TATGAGGTGCAGATGGACGCCCTGATTGTCGGAGCCCTGGGCGCCTGG | | | WSRDIYIEHITGHRQ |
| | | | | GACCCCTGCAACGAGCGTGTGCTGCGGACCTGCGGGATCGGTCGACGC | | | YQEA (SEQ ID NO: |
| | | | | TACGCACGTCTCATGCGGCGCCTCATGGTCTCAGACGCCATCCGATGGT | | | 1428) |
| | | | | CCAGGGACATCTACATCGAGCACATCACCGGCCACCGACAGTACCAGGA | | | |
| | | | | GGCGTGAGCCAGAGTGACATCGTTCTCCCACTACGAGAAAGGGACCAA | | | |
| | | | | GTGACCTTCTCCGTTGGATCATATGAACTGGAACCATAAACTCCCTGAAC | | | |
| | | | | ATTAAATCTCACCAAATGAGGGTCAATCCATCCTCATCATCATATCCACT | | | |
| | | | | CATTATAMTCCACACCCGAACACAGCCACTCTATGAACTTCATACCCTCA | | | |
| | | | | TATCTCAATGTCTGTACTTTGACCCATCAACCTTTTACCCCCAATCGGGG | | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATATTGCAGATTATGTATTCCTCATGCCACCTGATCTTAAACCAAACTTTG | | | |
| | | | | CACCCTCGATAATCTGTATGTTATTCCCTGATAACCAGAAACTTCTATGCT | | | |
| | | | | CAAACTCTGTTCACTATTTTTTTTAACATCATCTTAATAAAATTTTTAAATC | | | |
| | | | | TGTT (SEQ ID NO: 1060) | | | |
| NeSL | Utopia- | — | *Drosophila* | AAAGTGTAGTTCTTTTCTGTTTTAGTGTAGTGGGAAGTCTGTTTCTTTTTA | AAAGTGTA | TAAAAA | YAPGYEAAQSPCGRE |
| | 1_DYak | | *yakuba* | TTATGTTTTTTACGAAAAAGTCCTGGTCTTTGAAATTCATTGTCTAAATTT | GTTCTTTTC | ATTAAA | PPRDHHRRPRDACG |
| | | | | TAAATAAAATTATAAAATTTAAAAAGAAAATTAATTAAAGAAGCGATGA | TGTTTTAG | ATGCCTT | SSHSPEPCLTTPRLLP |
| | | | | AATATCTCTGAAATTCAATCAATCAATTAATCATGGCGTCTCAGCGAGTG | TGTAGTGG | AAAAAT | ETVSAEPCDDESQRT |
| | | | | CACGTATTTGCCTACCCCTTCGTGGGACCATTCCGGTGCTCCGTATGCAT | GAAGTCTG | AAATAA | RYASPHKQARTLHDA |
| | | | | GGATGCGTCCGGGATGCATCCCACTAGGTCGCTGGGCGAATACGGCAC | TTTCTTTTT | ATATATC | EPRDASREHAPSCAE |
| | | | | ATACGCTGCGGCATATCAGCACATAACCCGGCGCCACCCACAAGTGGTT | ATTATGTT | AAAATTT | PRCHRCQWTHWKD |
| | | | | ATTACATACCGTTGCCGGGTCTGTGGCGCTGATATGCCCCGGGGTATGA | TTTTACGA | AAAAAA | CCPHSTNTTDGPEGT |
| | | | | AGCAGCTCAAAGCCCATGTGGCCGCGAGCCACCCCGAGACCACCACAG | AAAAGTCC | AAAAAC | DRCADTITSPATAAC |
| | | | | ACGCCCACGGGATGCTTGTGGAAGCAGCCACAGCCCCGAACCCTGCCTT | TGGTCTTT | GAGGAA | PQRSPCPLGSSNGCD |
| | | | | ACCACTCCCCGCCTTCTCCCCGAGACAGTCAGCGCTGAGCCCTGTGACG | GAAATTCA | CAAATA | ETAPEKRQPAADLVH |
| | | | | ACGAGAGCCAGCGAACGCGGTACGCCTCTCCCCACAAGCAGGCGCGTA | TTGTCTAA | AACACA | TAPFAVLVRAGPFAD |
| | | | | CTCTGCACGACGCCGAGCCGCGCGATGCTTCCCGGGAACATGCCCCATC | ATTTTAAA | AATTCTG | LVRAGPFADHHQDD |
| | | | | CTGCGCTGAGCCCCGTTGTCACAGGTGCCAGTGGACGCACTGGAAGGA | TAAAATTA | AAAGAT | DPLPHRSGSLGPLCSK |
| | | | | CTGTTGCCCCCATTCCACCAACACGACAGATGGCCCCGAGGGCACCGAC | TAAAATTT | TTATATA | QKDPRKTHQHRHSG |
| | | | | CGCTGCGCAGACACCATCACCAGCCCCGCAACGGCCGCCTGCCCGCAAC | AAAAAGA | ATTTAAA | QAGNQTHTDIPRAA |
| | | | | GTTCCCCCTGCCCCCTTGGGTCAAGTAACGGGTGTGACGAGACGGCTCC | AAATTAAT | AWATAA | PSRRAAICLMANAAA |
| | | | | TGAGAAGCGGCAACCAGCCGCCGATCTCGTCCATACCGCCCCGTTCGCC | TAAAGAAG | ATCGAA | TREDLLRAATSLSEM |
| | | | | GTCCTCGTCCGTGCCGGCCCGTTCGCCGATCTCGTCCGCGCCGGCCCGT | CGATGAAA | AATAAA | AAANQPTRSPTGGG |
| | | | | TCGCCGACCACCACCAGGACGACGACCCCCTCCCGCACCGGTCTGGGAG | TATCTCTG | TGTTGA | EPTSQGRRGPQALA |
| | | | | TCTCGGCCCCCTCTGCTCCAAGCAGAAGGACCCCCGAAAGACCCACCAG | AAATTCAA | AAACAA | DAAKRIQQIYRTNIPR |
| | | | | CACCGCCACAGCGGGCAGGCCGGGAACCAAACCCACACGGACATACCC | TCAATCAA | AAAAAA | AMRKVLRTLLTAVFS |
| | | | | AGAGCCGCCCCCAGCAGAAGGGCCGCAATCTGCCTGATGGCCAATGCC | TTAATCAT | AATAAT | ACLRTGHVPDLCKKS |
| | | | | GCGGCCACCAGGGAGGACCTGCTGAGGGCCGCCACCAGCCTTTCCGAA | GGCGTCTC | AATAAT | RTVLIHKKGDRTDLS |
| | | | | ATGGCGGCCGCGAACCAGCCTACCCGCTCGCCCACTGGAGGTGGCGAG | AGCGAGT | AATAAA | NWRPLSMGDTIPKLF |
| | | | | CCCACCTCACAGGGTAGGCGCGGACCGCAAGCACTGGCAGACGCAGCG | GCACGTAT | AACACA | AAVMADRLTAFLTN |
| | | | | AAAAGGATCCAACAAATATACAGGACCAACATACCTCGCGCCATGAGAA | TTGCCTAC | ATAACA | GGRLSEEQKGFLQHE |
| | | | | AAGTCCTGAGAACACTGCTCACGGCAGTGTTTAGCGCCTGCCTGAGGAC | CCCTTCGT | CTCACCC | GCHEHNFVLGQVLEE |
| | | | | AGGTCATGTCCCCGATCTGTGTAAAAAGTCCAGAACGGTCTTAATCCAC | GGGACCAT | GGCCTG | SRRQGKDLVMGWL |
| | | | | AAGAAAGGSGACAGAACTGACCTGTCAAATTGGAGGCCTCTTTCCATGG | TCCGGTGC | CCCCAG | DLSNAFGSIPHATIM |
| | | | | GTGACACCATCCCCAAATTGTTCGCAGCCGTCATGGCGGACAGGCTGAC | TCCGTATG | AGGCAG | DAVAGMGIPSRIRTII |
| | | | | GGCGTTCCTCACTAACGGAGGAAGGCTCAGCGAGGAGCAGAAGGGCTT | CATGGATG | GTAAAC | HQLATGAATTAKTID |
| | | | | CCTCCAGCACGAAGGCTGCCATGAACACAATTTTGTTCTTGGCCAAGTG | CGTCCGGG | ATTTACT | GMSEEIPIEAGVRQG |
| | | | | CTGGAGGAGAGCAGACGCCAAGGCAAGGACCTCGTCATGGGCTGGCT | ATGCATCC | GGCCAT | CPASPILFNIAIERVLR |
| | | | | GGACCTGTCCAACGCGTTCGGGTCGATTCCGCATGCCACCATCATGGAC | CACTAGGT | ATGGCT | KIKTVNAGYLLYGSRI |
| | | | | GCGGTCGCCGGTATGGGGATCCCTTCGAGGATCCGGACCATAATCCACC | CGCTGGGC | TTTTTTT | SPLAYADDLVLIASSP |
| | | | | AGCTGGCCACCGGCGCCGCGACCACCGCCAAAACCATTGATGGCATGTC | GAATACGG | TAA | EEMRSLLRAADDAAI |
| | | | | GGAAGAGATCCCGATCGAAGCGGGGGTCAGACAGGGCTGCCCAGCCA | CACATACG | (SEQ ID | EAGLHFNPKKCATLH |
| | | | | GCCCAATCCTCTTTAACATCGCAATAGAGCGGGTACTTCGCAAAATCAA | CTGCGGCA | NO: | LTGKKSSRRAVQTGF |
| | | | | AACCGTCAACGCGGGGTACCTGCTCTATGGGAGCCGCATTAGCCCGCTG | TATCAGCA | 1307) | LVRGTPIPAMTEGDA |
| | | | | GCGTACGCCGATGACCTGGTGCTAATTGCGAGCTCCCCAGAGGAGATG | CATAACCC | | YEYLGIPLGLKKNQTP |
| | | | | AGGTCCTTGCTGCGTGCTGCGGACGACGCCGCAATAGAAGCCGGTCTG | GGCGCCAC | | RAAMEAIVGDIAKID |
| | | | | CACTTCAACCCCAAGAAGTGCGCGACCCTACACCTCACGGGGAAGAAAT | CCACAAGT | | DSLLAPWQKIDAART |
| | | | | CCTCGCGGAGGGCAGTGCAGACCGGCTTCCTCGTCCGTGGCACGCCAAT | GGTTATTA | | FVAPKLDFVLRSGATL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACCGGCCATGACAGAGGGGGATGCCTACGAATACCTCGGCATCCCCCT<br>GGGTTTAAAAAAAAACCAAACACCCAGGGCAGCGATGGAAGCGATAGT<br>TGGGGACATAGCCAAGATAGATGACTCGCTGCTCGCCCCGTGGCAAAA<br>GATCGACGCGGCCCGCACCTTCGTGGCACCGAAGCTTGACTTCGTGCTA<br>CGAAGTGGCGCCACCTTGCGGGCCCCGCTGCGTCATCTGGATACAGTCA<br>TTAAAAAACACATTAAAAAATGGCTGTATCTGCCGCAGAGGGCGAGCG<br>CGGAGGTAGTATACACCCCGCTGAAGAAAGGTGGAGCGGGCATACTAC<br>CTTCATCTATATTGGCTGATGTCCTAACTATCGCCCAGGCTCACCGCATG<br>GTGTCCTGCCCTGGGGAGGTCGTCTCCCGGATTGCAAGTGAGGGCCTG<br>AGAGAAGCGGTAAAGCGAAAAATAAACCGGGAGCCATCCGGCGACGA<br>GATGGCCCACTTTCTCTCAGGCTCCACTCTATCCGGGGAGACAGCCAGC<br>TTTGGCGACGCCGGATTCTGGTCGAGGGTGAGGATGGCCACCAAAAGG<br>CAAGCTGTGCATCTGGGGGTGCGTTGGGCCTGGAGAGGAGGTGAGCTA<br>CTGGTCGAGAGTAGAGGACAAAGAAACCGACCAGTGGCCACCGACTCG<br>AACTCCAGGTCCCAACTCATCCAACGTCTCAGGTGCGCAGCTCAGGATG<br>AGTTCCTGACCATCCTCATAAATAAACCCGACCAGGGGAAGGTGGCGAA<br>GCTCTCCACGCTAACCCCAGTCAGCAACGCGTTCATACGCGACGGTAGC<br>TTTACCAGGTTTGCTGACTGGCGGTTTATCCACAGAGCCCGACTGGGAG<br>TCCTCCCACTCAACGGAGCGATCCGATGGGGCAGCGGCGACAAGCGCT<br>GCCGGGTCTGTGGATATCAGCTGGAGAGCGTTCCACACGTGTTGTGCCA<br>CTGCATGCACCACTCAAACGCAATGCAGCAGAGGCACAACGCGGTGAT<br>GGATCGCCTCGCCAAGGCTGGCTCACGGCTGGGGACCCCCAGGGTGAA<br>CTGCCGCGTGGAAGGGGTCGCCGAGGACATGGCGGCCCTCAGGCCGG<br>ACCTGGTATGGCGCGACGAACGGAGCAGAAAAATCGTCATAGTTGACG<br>TGACTGTTCCGTTCGAGAACGGGGCTGAAGCGTTTGATAACGCGAGGG<br>GCGAGAAAGAAGAAAAATACCGCCCCCTAGCTGAAGCCCTGCGCGCCA<br>TGGGATACCAGGTAAAACTGGAGGCATTCATTGTCGGAGCCTTGGGCTC<br>GTGGGACCCTAAAAACGAAAGGGTCCTTAAGACTTTGGGTGTCTCCAG<br>GTTTTATGCTGGCCTGATGCGCAGACTGATGGTGGCCGACACCATCAGG<br>TGGTCCCGGGACATTTATGTGGAGCATGTATCCGGGATCAGGCAGTTCA<br>CCCTGCCAAGTGGAGCTCCCTCCAACTAAAAAATTAAAATGCCTTAAAA<br>ATAAATAAATATATCAAAATTTAAAAAAAAAAACGAGGAACAAATAAAC<br>ACAAATTCTGAAAGATTTATATAATTTAAAAWATAAATCGAAAATAAAT<br>GTTGAAAACAAAAAAAAAATAATAATAATAATAAAAACACAATAACACT<br>CACCCGGCCTGCCCCAGAGGCAGGTAAACATTTACTGGCCATATGGCTT<br>TTTTTTTAA (SEQ ID NO: 1061) | CATACCGT<br>TGCCGGGT<br>CTGTGGCG<br>CTGA (SEQ<br>ID NO:<br>1184) | | RAPLRHLDTVIKKHIK<br>KWLYLPQRASAEVVY<br>TPLKKGGAGILPSSILA<br>DVLTIAQAHRMVSCP<br>GEVVSRIASEGLREAV<br>KRKINREPSGDEMAH<br>FLSGSTLSGETASFGD<br>AGFWSRVRMATKR<br>QAVHLGVRWAWRG<br>GELLVESRGQRNRPV<br>ATDSNSRSQLIQRLR<br>CAAQDEFLTILINKPD<br>QGKVAKLSTLTPVSN<br>AFIRDGSFTRFADWR<br>FIHRARLGVLPLNGAI<br>RWGSGDKRCRVCGY<br>QLESVPHVLCHCMH<br>HSNAMQQRHNAV<br>MDRLAKAGSRLGTP<br>RVNCRVEGVAEDMA<br>ALRPDLVWRDERSRK<br>IVIVDVTVPFENGAEA<br>FDNARGEKEEKYRPL<br>AEALRAMGYQVKLE<br>AFIVGALGSWDPKNE<br>RVLKTLGVSRFYAGL<br>MRRLMVADTIRWSR<br>DIYVEHVSGIRQFTLP<br>SGAPSN (SEQ ID<br>NO: 1429) |
| NeSL | Utopia-<br>1_Gav | — | *Gavialis gangeticus* | CGCTGGAAAGACGGAGAACCGCTTCTTTTTCCTGCGCCCGGCCTGGTAT<br>TGCACTTCCTCCAGGACCAGCGCCAACCTAGTCCGGCAGACTGCCGGAA<br>TAATAGCCTCAGAAAGAGAGCTGGCTAGCAGCCCTCTTTTCTTTCCTCCG<br>GTGCAGCGTGGGTTCTTGTCAGTCCTGATGGGCTAGGGAAGGCGGTGC<br>CGCCAGTACGTCCGAAAGAGCGCCGGTTGCGCGAGCGACCGCGCCGCT<br>CAGGCGAGTAGCCCAAGGGTCTTACGGTTCGCCGGACCCGATAACGCG<br>AAAGCCCCGACTCGGGCCAGTAGCCGAAGACCNTGGGCCTCCCTCCCCA<br>GGTCGGAGTAGGCGAACGCCCGTGCTCGGAGGACGGAACGTGGACAA<br>AACACCCCCAGGTCCCAATGACGCCCTGATCCACTGACAAGAACGCTCG<br>AGGCACNCCAGGAGACCCCCAGCTAGGGCAGACCGCCGACCACGGGTC<br>GCGGAGGACCCTCCCAGGAGGGTGGACCAGCGAACCCGAGTCGGCGA<br>CGAACCCCGACGCACCCCCCCCGCGATGTCGGGACCCCGACAGGCGGC | CGCTGGAA<br>AGACGGA<br>GAACCGCT<br>TCTTTTTCC<br>TGCGCCCG<br>GCCTGGTA<br>TTGCACTT<br>CCTCCAGG<br>ACCAGCGC<br>CAACCTAG<br>TCCGGCAG<br>ACTGCCGG | TGAACC<br>GCCCCC<br>CCTCCGC<br>GCCAGA<br>CGGACC<br>TTCACTT<br>CACTCC<br>GAGAGG<br>ATTCTTC<br>GACCAC<br>GGACGA<br>CCCCGCT | MSGPRQAAADPRPS<br>TDPRRQRDSQSPEPR<br>LTRAASRRRTPDPED<br>APRTTAEHPERRRTP<br>PDPRGPSATTAGPER<br>RRPPDPGGPEDDPPE<br>GLPTLVEEPRTPPTPD<br>PPDGRPRRGCRRGS<br>AHVPPLPPPCEAAVP<br>DLPPAKAVQVAQRH<br>EQTPTALPPAAPSVLL<br>LPLRHRVRGPEAPEE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCGGACCCCCGGCCATCGACCGACCCCCGGAGGCAGAGAGACTCTCA | AATAATAG | CCACCC | PPQGMPGPRGREET |
| | | | | GAGCCCGGAACCCCGGCTGACGAGAGCCGCCTCCCGGCGGAGGACCCC | CCTCAGAA | GAAGAG | RHAGEVRRPTTRAAA |
| | | | | GGACCCCGAGGACGCCCCCCGGACGACGGCGGAGCACCCCGAGCGAC | AGAGAGCT | GACCCC | RRPARPAAPPATPPD |
| | | | | GGCGGACTCCTCCGGACCCCCGCGGNCCCTCGGCGACGACGGCGGGCC | GGCTAGCA | CGCGAT | QTSGDRPTERPAPAT |
| | | | | CCGAGCGGCGACGNCCCCCGGACCCCGGCGGTCCCGAGGACGACCCCC | GCCCTCTT | GAGACT | PPRRSAPRDPRPDVT |
| | | | | CCGAGGGCCTCCCCACNCTGGTGGAGGAGCCCCGAACCCCCCCGACAC | TTCTTTCCT | CTATAC | PRPDGPPPGPPGPP |
| | | | | CGGACCCCCCCGACGGACGACCCAGGCGAGGGTGCAGACGCGGCAGC | CCGGTGCA | GGACTG | DAPDPPRIPEPPGEP |
| | | | | GCTCACGTTCCTCCCCTTCCCCCTCCCTGCGAAGCTGCTGTGCCCGACCT | GCGTGGG | AGGCAC | EPPGALQLPSVPGSP |
| | | | | GCCACCCGCCAAGGCAGTACAGGTCGCACAACGACATGAACAAACACC | TTCTTGTC | TTCCTTC | GAETSAQQRMPTPR |
| | | | | TACGGCGCTTCCACCAGCTGCGCCTAGCGTTCTACTGCTCCCTCTGCGGC | AGTCCTGA | GAACCA | QALWLEELSRATAFE |
| | | | | ACCGAGTACGAGGCCCTGAAGCTCCTGAAGAACCACCACAAGGTATGC | TGGGCTAG | CTTCCTC | AFEASVARLTEELSAA |
| | | | | CAGGGCCCCGGGGCCGAGAGGAGACCCGGCACGCTGGTGAGGTCCGC | GGAAGGC | CACCATT | ARPGQPRRGADNGP |
| | | | | CGCCCCACGACCCGGGCCGCGGCGCGAAGGCCCGCCAGACCGGCCGCC | GGTGCCGC | GCGGAC | TTRRDHRPQPQRRP |
| | | | | CCGCCGGCGACCCCACCGGACCAGACCTCCGGGGACCGCCCGACGGAG | CAGTACGT | CATTGTA | RRQRYDPAAASRIQK |
| | | | | AGACCCGCCCCGGCGACGCCACCACGCAGGTCTGCACCCAGGGACCCC | CCGAAAGA | ACGGGT | LYRANRPKAAREILEG |
| | | | | CGACCGGACGTGACGCCCCGACCGGACGGCCCCCCTCCCGGACCCCCG | GCGCCGGT | TTGTGT | PSAFCQVPRETLFNYF |
| | | | | GGGCCGCCCGACGCCCCCGACCCGCCGAGGATCCCGGAGCCGCCCGGN | TGCGCGAG | GTATCTA | SRVFNPPAEAAAPRP |
| | | | | GAGCCCGAGCCGCCGGGAGCCCTCCAGCTCCCGAGCGTGCCGGGGTCT | CGACCGCG | TCTCCTT | ATVEALTPVPPAEGF |
| | | | | CCGGGTGCGGAGACCTCCGCACAGCAGAGGATGCCCACCCCGCGGCAA | CCGCTCAG | TCTCTCT | EEAFTPREVEARLKRT |
| | | | | GCCCTCTGGCTGGAGGAGCTCTCCCGGGCCACCGCCTTCGAGGCCTTCG | GCGAGTA | CAGCGT | RDTAPGRDGIRYGLL |
| | | | | AGGCCTCGGTGGCCCGGCTCACGGAGGAGCTCTCGGCGGCCGCCCGGC | GCCCAAGG | CGCGAA | KKRDPGCLVLSVLFN |
| | | | | CCGGCCAGCCCCGGAGGGGCGCCGACAACGGACCGACGACGCGACGA | GTCTTACG | CCCCCTC | RCREFRRTPAAWKR |
| | | | | GACCACAGACCGCAGCCGCAGAGGCGACCCAGGCGCCAGCGCTACGAC | GTTCGCCG | CCCCACC | AMTVLIHKKGDPTDP |
| | | | | CCGGCGGCAGCCTCCCGGATCCAGAAGCTGTACCGGGCCAACCGCCCC | GACCCGAT | CCCCACC | GNWRPIALCSTVAKL |
| | | | | AAGGCGGCGAGAGAGATCCTGGAGGGACCCTCGGCTTTCTGCCAGGTC | AACGCGAA | CCCGGG | YASCLAARITDWAVT |
| | | | | CCCCGGGAGACTCTGTTCAACTATTTCAGCAGGGTCTTCAACCCCCCGGC | AGCCCCGA | CTTAGTT | GGAVSRSQKGFMST |
| | | | | AGAAGCCGCCGCCCCACGCCCCGCGACCGTCGAAGCGCTGACCCCCGTC | CTCGGGCC | GGCTAA | EGCYEHNFTLQMAL |
| | | | | CCCCCGGCAGAGGGGTTCGAGGAGGCCTTCACGCCGCGGGAAGTGGA | AGTAGCCG | CATTGTA | DNARRTRKQCAVA |
| | | | | AGCCCGCCTGAAGAGGACCAGGGACACCGCCCCCGGCAGGGACGGCAT | AAGACCNT | TCTCCTG | WLDISNAFGSVPHRR |
| | | | | CAGGTACGGTCTCCTNAAGAAACGTGACCCGGGCTGCCTCGTTCTTTCT | GGGCCTCC | TAACCTA | IFGTLRELGLPDGVID |
| | | | | GTTCTCTTCAACAGGTGCAGAGAGTTCCGGCGCACGCCCGCCGCCTGGA | CTCCCCAG | GTCGCG | LVRELYHGCTTTVRA |
| | | | | AGAGGGCCATGACGGTCCTCATCCACAAGAAGGGAGACCCGACCGACC | GTCGGAGT | TTCCCCT | TDGETAEIPIRSGVRQ |
| | | | | CGGGCAACTGGAGACCCATCGCCCTGTGCTCCACCGTGGCCAAGCTGTA | AGGCGAA | CCTCACC | GCPLSPIIFNLAMEPL |
| | | | | CGCCAGCTGCCTGGCGGCCCGCATCACCGACTGGGCGGTGACCGGCGG | CGCCCGTG | CCCATCC | LRAVAGGPGGLDLY |
| | | | | GGCCGTCAGCCGGAGCCAGAAGGGCTTCATGTCGACGGAGGGCTGCTA | CTCGGAGG | CTCTATT | GQKLSVLAYADDLVL |
| | | | | CGAACACAACTTCACCCTCCAGATGGCCCTGGACAACGCCCGGAGGACC | ACGGAAC | GTTAGT | LAPDATQLQQMLDV |
| | | | | AGGAAGCAGTGCGCGGTGGCGTGGCTGGACATCTCCAACGCCTTCGGC | GTGGACAA | CCCTCGC | TSEAARWMGLRFNV |
| | | | | TCCGTGCCCCACCGCCGCATCTTCGGCACCCTCCGCGAGCTGGGCCTAC | AACACCCC | TCGGGC | AKCASLHIDGRQKSR |
| | | | | CGGACGGCGTCATCGACCTGGTGCGAGAGCTCTACCACGGNTGCACCA | CAGGTCCC | GATCTG | VLDSTLTIQGQAMRH |
| | | | | CGACCGTCCGCGCCACCGACGGAGAGACCGCGGAGATCCCCATCCGGT | AATGACGC | TATTTCC | LRDGEAYCHLGTPTG |
| | | | | CGGGGGTGAGGCAGGGCTGCCCCCTCAGCCCCATCATCTTCAACCTGGC | CCTGATCC | CTATCG | HRAKQTPEETINGIV |
| | | | | CATGGAACCGCTCCTTCGAGCCGTGGGGGCGGCCCCGGCGGGCTCGA | ACTGACAA | GCTTTGT | QDAHKLDSSLLAPW |
| | | | | CCTGTACGGCCAGAAGTTGAGCGTCCTGGCCTACGCCGACGACCTCGTC | GAACGCTC | CATCTTT | QKIDAANTFLIPRVAF |
| | | | | CTCCTCGCCCCCGACGCCACCCAGCTGCAGCAGATGCTGGACGTGACGT | GAGGCAC | TTTCTGG | VLRGSAVPKTPLKKA |
| | | | | CCGAGGCGGCCAGGTGGATGGGCCTGCGCTTCAACGTCGCCAAGTGCG | NCCAGGA | ATTCCCG | DAEIRRLLKKWLHLPL |
| | | | | CCTCCCTGCACATCGACGGCAGGCAGAAGAGCCGCGTCCTGGACTCCAC | GACCCCCA | ATCCTAA | RASNEVLHIPYRQGG |
| | | | | CCTCACGATCCAGGGCCAGGCGATGAGGCACCTGCGCGACGGCGAGGC | GCTAGGGC | ACATTTA | ANVPRMGDLCDIAV |
| | | | | CTACTGCCACCTGGGGACGCCCACCGGCCACCGGGCCAAGCAGACGCC | AGACCGCC | CTAATA | VTHAFRLLTCPDATV |
| | | | | GGAGGAGACCATCAACGGGATCGTGCAGGACGCCCACAAGCTGGACTC | GACCACGG | AAAGTC | SIIAASALEETARKRIA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTCCCTGCTGGCCCCCTGGCAGAAGATAGACGCGGCGAACACCTTCCTC<br>ATCCCCCGCGTCGCGTTCGTCCTGAGAGGCTCGGCGGTCCCCAAGACCC<br>CCCTCAAGAAGGCGGACGCCGAGATCCGGCGGCTGCTCAAGAAGTGGC<br>TGCACCTGCCGCTGAGGGCCAGCAACGAGGTCCTGCACATCCCCTACCG<br>GCAGGGAGGCGCCAACGTCCCCCGCATGGGAGACCTCTGCGACATCGC<br>GGTGGTCACCCACGCCTTCCGCCTCCTGACCTGCCCGGACGCGACGGTA<br>AGTATCATCGCCGCCAGCGCCCTCGAGGAGACCGCCCGCAAGAGGATC<br>GCGAGGCAGCCGACCGGACGNGACTTGGCCACCTTCCTCAGCGGCTCG<br>CTGGAGGGCGAGTTCGGCCGAGACGGCGGGGACTTTGCCTCGCTGTGG<br>AGCCGAGCCCGCAACGCCACGCGCCGCCTCGGGAAGCGCATCGGCTGC<br>GCCTGGACCTGGACCGAGGAGTGCCGGGAGCTGGGAGTCTCCCTGCAA<br>CCAGCCCCGCACGCCGACCGCGTCACCGTGACGCCCCGCACGAGGACCT<br>TCCTGGAGAGGTTCCTGAAGGACGCCGTCCGAAACAAGTACGCCGGCG<br>ACCTGAGGGCCAAACCCGACCAGGGCAAGGTCTTCGACGTCACCTCGA<br>AGTGGGACGCTAGCAACCACTTCATGCCCAGCGGGAGCTTCACGCGCTT<br>CGCGGACTGGCGCTTCCTCCACCGCGCCCGCCTCAACTGCCTGCCTCTGA<br>ACGGGGCCGTGCGCTTCGGCCACCGGGACAAGAGGTGCCGACGGTGC<br>GGCTACGCGGCAGAGACCCTCCCCCACGTGCTGTGCAGCTGCAAGCCG<br>CACGCCAGAGCCTGGCAGCTCCGCCACAACGCTGTCCAGGACCGCCTG<br>GTGAGGGCCATCCCGGCCGCGGCGGGGGAGATCTCCGTGAACCGCACC<br>GTCCCGGGCTGCGAGAGCCAGATGCGACCCGACATAGTCATCACCAAC<br>GAAGAGGCCAAGAAGGTCGTGATCGTGGACGTCACCATCCCCTTCGAG<br>AACCGGCGCCAAGCCTTCACCGACGCCCGGGCTCGCAAGCGGGAGAAG<br>TACGCCCCGCTGGCCGACACCCTGAGGGGCCGCGGCTACGACGTGACG<br>GTCGACGCGCTCATCGTGGGAACGCTCGGAGCCTGGGACCCCAGCAAC<br>GAGAGCGTCCTGCGTGCCTGCCGCGTCTCCCGCCGCTACGCCAAGCTGA<br>TGCGCTGCCTCATGGTGTCCGACACCATCCGTTGGTCCCGCGACATCTAC<br>GTGGAACACATCACGGGCCACCGCCAGTACTCCGACCCCACCAGACGA<br>GCCGCCGCCGGACCGGACCCGGAGGGGACCGCCTGAACCGCCCCCCCT<br>CCGCGCCAGACGGACCTTCACTTCACTCCGAGAGGATTCTTCGACCACG<br>GACGACCCCGCTCCACCCGAAGAGGACCCCCGCGATGAGACTCTATACG<br>GACTGAGGCACTTCCTTCGAACCACTTCCTCCACCATTGCGGACCATTGT<br>AACGGGTTTGTGTGTATCTATCTCCTTTCTCTCTCAGCGTCGCGAACCCC<br>CTCCCCCACCCCCCACCCCCGGGCTTAGTTGGCTAACATTGTATCTCCTG<br>TAACCTAGTCGCGTTCCCCTCCTCACCCCCATCCCTCTATTGTTAGTCCCT<br>CGCTCGGGCGATCTGTATTTCCCTATCGGCTTTGTCATCTTTTTTCTGGAT<br>TCCCGATCCTAAACATTTACTAATAAAAGTCAATCTGTTCTTT (SEQ ID<br>NO: 1062) | GTCGCGGA<br>GGACCCTC<br>CCAGGAG<br>GGTGGACC<br>AGCGAACC<br>CGAGTCGG<br>CGACGAAC<br>CCCGACGC<br>ACCCCCCC<br>CGCG (SEQ<br>ID NO:<br>1185) | AATCTGT<br>TCTTT<br>(SEQ ID<br>NO:<br>1308) | RQPTGRDLATFLSGS<br>LEGEFGRDGGDFASL<br>WSRARNATRRLGKRI<br>GCAWTWTEECRELG<br>VSLQPAPHADRVTVT<br>PRTRTFLERFLKDAVR<br>NKYAGDLRAKPDQG<br>KVFDVTSKWDASNH<br>FMPSGSFTRFADWR<br>FLHRARLNCLPLNGA<br>VRFGHRDKRCRRCG<br>YAAETLPHVLCSCKP<br>HARAWQLRHNAVQ<br>DRLVRAIPAAAGEISV<br>NRTVPGCESQMRPD<br>IVITNEEAKKVVIVDV<br>TIPFENRRQAFTDAR<br>ARKREKYAPLADTLR<br>GRGYDVTVDALIVGT<br>LGAWDPSNESVLRA<br>CRVSRRYAKLMRCL<br>MVSDTIRWSRDIYVE<br>HITGHRQYSDPTRRA<br>AAGPDPEGTA (SEQ<br>ID NO: 1430) |
| NeSL | Utopia-<br>1_LV | AGCV01358106 | *Lytechinus variegatus* | ATCTACTATCATGTCTTGTCCAAGAGAGGGAAGCGATCACCTCGGTCCT<br>GATCCTGAGACACCCGCCCTCCATCAGGGTTCTGACATCCGGGTTACCA<br>GTTCTCGCCTTCGAGGTTCCCGCGGAAAGAGTTCTCGCCAACCAAGCTC<br>CCGACACCAAGTTCCTGCCAGCGAGGCTTCCGCCACCGCCCAGCAGACT<br>GCCGCCAACGAGTGCCAGGTGTGTGGATCTTCCTTCGCCACCTCCAGTG<br>GACTCCGCCGCCACATGGCCAGGCTTCATCGAGCTGCCTCTGCGGATCC<br>TGAGGGTGCTGCGCCGGCTTCCATCACAGAGATTTTCGACTACCCCTTG<br>CCTTCCCGGTGGAAATGCTCGGCATGCTCGGAGAACTTTTTCAACCAGC<br>AGACCCTCAAGCGACACCAGACCAGGCATCATCCAGCTACCACCTTCGC<br>GTATGCCTTTCGGTGTTCGTCATGCCGGTCCGAGTTCGACTCAGCACGG | ATCTACTA<br>TC (SEQ ID<br>NO: 1186) | TGAATA<br>GCATTTA<br>TATTGTG<br>TTCCAAA<br>CAACAT<br>ACTCATT<br>ATTATAT<br>CTAAAC<br>ATTTTTT<br>TTTCTGT | MSCPREGSDHLGPD<br>PETPALHQGSDIRVT<br>SSRLRGSRGKSSRQP<br>SSRHQVPASEASATA<br>QQTAANECQVCGSS<br>FATSSGLRRHMARLH<br>RAASADPEGAAPASI<br>TEIFDYPLPSRWKCSA<br>CSENFFNQQTLKRH<br>QTRHHPATTFAYAFR |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGGGCTGCGAACCATTGGCAGGTCCACAAGAAGGAGCGATCTCAACTC | | TCCTGAC | CSSCRSEFDSARRAA |
| | | | | TCTGGCACCGAGCCCCAGGCCTCTTCCCAAGCCAGAGTTAGCATGGCTC | | AATCTAC | NHWQVHKKERSQLS |
| | | | | ATTCTCCTCCACCTCTGCCCAACACTTCTTGGGCGGAGCTCGCCTCGAAT | | GTAAAG | GTEPQASSQARVSM |
| | | | | CCTGCCGAGATACCTTCCTTCGTCTGGGAGTCTCCTCCCAAGAACCGCCC | | TCTGCTA | AHSPPPLPNTSWAEL |
| | | | | CTCGGTTGAGGAGTTCGGTTCGTCTCTGCCAACTGATGTTACGATGATG | | ACCAAC | ASNPAEIPSFVWESP |
| | | | | TCTCAAAGTCCTCCACCGCAGGTACAGTCGTCTCCTGTCCCTGCTCTGAC | | TGGCAT | PKNRPSVEEFGSSLPT |
| | | | | TCCTCTTTCACCCGCTGCCACTGCCTCCAGTTCTCCTCCAGGGGCTGCAA | | GATGAA | DVTMMSQSPPPQV |
| | | | | GGCAGCTGACCCCTCCTACACAGACTAACACCCCAGTCACCCAGAGGGC | | ATAAGA | QSSPVPALTPLSPAAT |
| | | | | TCGCCTGCAACCTGAAGCAGACGTCGTACCTGAACTCCCTCCTTCAGTCA | | TAAAAT | ASSSPPGAARQLTPP |
| | | | | CCGAGCACCCTGTGTCTGACGCTCAACACTGGGTTGATGCTGTATCCTCT | | CCCCTTA | TQTNTPVTQRARLQ |
| | | | | GCATCAGATTGGTCTGAGTTTGAAGCAGTATGTGATCAATTTGTCATCCA | | CACATTA | PEADVVPELPPSVTE |
| | | | | CGCTGTTGCTGTTTCCCGTCCCAATCTTGCTCGACCCCAGCAGCAAGATA | | ATTTCTT | HPVSDAQHWVDAV |
| | | | | GGCAGAGATCTGGTGACCACCCTCCTAGACAGCAAAGAGGTCAGCATC | | GTCACA | SSASDWSEFEAVCD |
| | | | | GACCAACCTTCGATGTCCGTGAGGCAAGTAGAATCCAGAAGCTCTATCG | | TCATAAT | QFVIHAVAVSRPNLA |
| | | | | TACCAGCAAGAAAAGAGCCATCAGACACATACTGAAAGAGAAATCACC | | GCTTTGT | RPQQQDRQRSGDH |
| | | | | TTCCTTCTCTGGTTCCGAGTCAGACGTCTTAGACTTCTTCCGCGAGGTGT | | CAAAGC | PPRQQRGQHRPTFD |
| | | | | ATTCTGCTAAAGAAGTTGACGAGGAAGCAGTTGGTAAACTAGCATCCTC | | AATGTC | VREASRIQKLYRTSKK |
| | | | | GCTCTTCGATGTCCCTCAAGGTGATGACTCTGCGACATCTCTGTCTCTGC | | CTACATA | RAIRHILKEKSPSFSGS |
| | | | | CCACGTCAGCGAAGGAGATCGGAGCAAGGCTGTCAAGGATGACAAACT | | ATATCTC | ESDVLDFFREVYSAKE |
| | | | | CTGCCCCCGGGAAGGATCGCTTGGAGTACAGACACATTCGACGTGCGG | | GATGTC | VDEEAVGKLASSLFD |
| | | | | ACGGGTCCTTCAGCATCTCTGAGGCCATCTTTAACAAATGCCTGGCTGA | | ACCCCA | VPQGDDSATSLSLPT |
| | | | | AGGTCGGATCCCAGCTCCTTGGAAGACAGCATCTACCATCCTACTTCACA | | ATTAATT | SAKEIGARLSRMTNS |
| | | | | AGGCTGGCCCCACGGATGATCCCGCCAACTTCCGCCCAATCGCCTTACA | | TTACATC | APGKDRLEYRHIRRA |
| | | | | GTCATGTCTCTACAAGCTTTTTATGGCTGTACTTGCGGACCGGCTGACCA | | CTTCGG | DGSFSISEAIFNKCLA |
| | | | | AGTGGGCCTGTGAGAACCAGTACCTCAGCCCCGAGCAGAAGTCCGCTC | | TAACCTT | EGRIPAPWKTASTILL |
| | | | | GCCCCTGCGAGGGGTGCTTCGAGCACTCCTTCCTTCTCTCAGCTGCCCTG | | TATACC | HKAGPTDDPANFRPI |
| | | | | AAGGACTGCAGGAGAAACCAGAAGACCATCTGCATCGGTTGGTTGGAC | | GTTGGA | ALQSCLYKLFMAVLA |
| | | | | CTTAGGAATGCATTTGGAAGCATTCCTCATCCTGTCATCAAGATCGTCCT | | TCAACAT | DRLTKWACENQYLSP |
| | | | | GTCCAGTCTGGGTGTCCCTGATTCGCTTGTTACCCTCCTCATGGATGCCT | | ATATGA | EQKSARPCEGCFEHS |
| | | | | ACAATGGTGCGTCAACCTCGTTCACGCTGACCGGGGGCCAGACCGACA | | TTTGTAA | FLLSAALKDCRRNQK |
| | | | | CCGTACCCATCAGATCAGGGGTGAAGCAAGGCTGCCCGATGTCCCCAAT | | AACTGTT | TICIGWLDLRNAFGSI |
| | | | | CCTCTTCAACCTGGCCATCGAACTTATCATCAGGGCAGTCAAGAAGAAT | | ATTTCTG | PHPVIKIVLSSLGVPD |
| | | | | GCATCAGACAACCATCTCGGAGTGACTGTCCAGGGCAAGAACCTCTCCA | | AGTTTTT | SLVTLLMDAYNGAST |
| | | | | TCCTGGCCTATGCTGATGACCTAGTGCTGCTCAGCCGAGACACTGAAGG | | TCTATGC | SFTLTGGQTDTVPIRS |
| | | | | CCTCCAATCCCTCCTTCAAGTTGCTGGCTCTTCTGCATCTACCCTTCAGAT | | TAATAA | GVKQGCPMSPILFNL |
| | | | | GCAGTTTAAGCCCCAGAAGTGTGCAACACTCACCCTTGACTGCAAGCGT | | A (SEQ | AIELIIRAVKKNASDN |
| | | | | GGTACCAATGTTAGGCAGTCTGCTCACCATATCCAAGGGGCTGCCATCC | | ID NO: | HLGVTVQGKNLSILA |
| | | | | CATCGCTTACTGAAGAGGAGCGTTACCGCTACCTTGGGGTCCCCATTGG | | 1309) | YADDLVLLSRDTEGL |
| | | | | ACTCCCAAGGCTCACAAGTCTACAGGAGAGCTCTAGGAAGCTGTCGTCA | | | QSLLQVAGSSASTLQ |
| | | | | GACATCGAGACCATTTCATCCTCCCTTCTAGCGCCTTGGCAGAAACTGGA | | | MQFKPQKCATLTLDC |
| | | | | TGCAATCAAGACCTTTGTGATACCCATCCTTCAGTATACCTTGCGGGCCA | | | KRGTNVRQSAHHIQ |
| | | | | CAGAATACCTCAAGTCCGACTTGAAACCCCTACGAGCAGCCATTATCAA | | | GAAIPSLTEEERYRYL |
| | | | | GCACGTGAAGAAGATCTGCCATCTTCCGGTAAGATCATCCAACGCCTTC | | | GVPIGLPRLTSLQESS |
| | | | | GTCTTCGCGTCCCGACCCTCCGGTGGTTTGGCTTTTGTTGACCCAGGAGT | | | RKLSSDIETISSSLLAP |
| | | | | GGATGCCGACATCCTTGTCGTAACCCAAGCCGTCCGTACCCTGGCATCG | | | WQKLDAIKTFVIPILQ |
| | | | | GATGATGACACGGTGAGAGCCGTTGCTCTAGGACAGCTGACCTCAGTG | | | YTLRATEYLKSDLKPL |
| | | | | GTCCACAGGACGGTCCATTCTGCACCATCAGATGACTGCATCGACAAGT | | | RAAIIKHVKKICHLPV |
| | | | | TCTTGTCCGGAAGCAGTGAGGGCCCTCTGGCAAACTCAGGGAACAGTG | | | RSSNAFVFASRPSGG |
| | | | | GCCAGGCATCATCTCTTTGGTCACGTACAAGGGCTGCATCCCGTCGCCT | | | LAFVDPGVDADILVV |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAAGATAAGGATCGTCGGAGCCTCGAGCGGCGACATCAAGGTCGAGA | | | TQAVRTLASDDDTVR |
| | | | | GTGGAGGCCGTGCCATCCCCTCCAAGAAAGTGACTGCAGGTCTCCGCTC | | | AVALGQLTSVVHRTV |
| | | | | CGACCATCACAACGAGATGTCAGAGAAGCTGCGGTCCCTTCCAGACCAG | | | HSAPSDDCIDKFLSGS |
| | | | | GGCAAGGTAGCCAGGGCACTCTCCTTGGATAGTTTCGCCAACGCAACAT | | | SEGPLANSGNSGQAS |
| | | | | CATGGCTGACATCCGGGAGTTTCATCCGATTTTGCGACTGGAGGTTCAT | | | SLWSRTRAASRRLKIR |
| | | | | CCACCGTGCTCGCCTAAACTGTCTACCTACCAACGCTGCTGTCCGGCGGT | | | IVGASSGDIKVESGGR |
| | | | | GGAAACAGAACGCCAACACCAAGTGCCGAAGGTGTGATCACCAGTTGG | | | AIPSKKVTAGLRSDH |
| | | | | AGACGTTGCCCCACATTATTAACAACTGCCGTCCCAACATGGTACCGATC | | | HNEMSEKLRSLPDQ |
| | | | | CGCCGGAGGCACAACTCCATCCAAGAACGCCTGGTGAAGGCGATTCAC | | | GKVARALSLDSFANA |
| | | | | TACGGTGACATCTACCAGGACCAGCATGTCCCCGGCGACCCGAACCCAA | | | TSWLTSGSFIRFCDW |
| | | | | GGGAGCGACCCGACATCACAGTGGTTGAGGGTAACAAGGTGACCATTG | | | RFIHRARLNCLPTNA |
| | | | | TCGACATCACCATCCCATTCGACAATGGTCCGGATGCCCTCTCCACGGCT | | | AVRRWKQNANTKCR |
| | | | | GCCAACGCCAAAGTCATGAAATATGACACACTGCGACAAGAGCTGGCC | | | RCDHQLETLPHIINNC |
| | | | | AGCCGTGGTATGGATGTCGAGGTCCACGCTTTTGTAATCGGCTCCCTTG | | | RPNMVPIRRRHNSIQ |
| | | | | GGTCGTGGCACGGGGACAACGAGCGTGTTCTGGGACGTCTAGGTATCT | | | ERLVKAIHYGDIYQD |
| | | | | CTCGCCGATACAGAACACTGATGAGGCGCCTGTGCTGCATAGATGCGAT | | | QHVPGDPNPRERPDI |
| | | | | CAAAGGCAGCCGGGATATCTATATCGAACATGTTACCGGTCACCGGCAG | | | TVVEGNKVTIVDITIP |
| | | | | TATTGAATAGCATTTATATTGTGTTCCAAACAACATACTCATTATTATATC | | | FDNGPDALSTAANA |
| | | | | TAAACATTTTTTTTCTGTTCCTGACAATCTACGTAAAGTCTGCTAACCAA | | | KVMKYDTLRQELASR |
| | | | | CTGGCATGATGAAATAAGATAAAATCCCCTTACACATTAATTTCTTGTCA | | | GMDVEVHAFVIGSL |
| | | | | CATCATAATGCTTTGTCAAAGCAATGTCCTACATAATATCTCGATGTCAC | | | GSWHGDNERVLGRL |
| | | | | CCCAATTAATTTTACATCCTTCGGTAACCTTTATACCGTTGGATCAACATA | | | GISRRYRTLMRRLCCI |
| | | | | TATGATTTGTAAAACTGTTATTTCTGAGTTTTTTCTATGCTAATAAA (SEQ | | | DAIKGSRDIYIEHVTG |
| | | | | ID NO: 1063) | | | HRQY (SEQ ID NO: |
| | | | | | | | 1431) |
| NeSL | Utopia- | — | *Nasonia* | CCATTCCTTCGTACGGGTTTTCGTGCCGGCATAGCCGGGTGGGAGACTC | CCATTCCT | TAGTGG | SGXTGREVKCITVNV |
| | 1_NVit | | *vitripennis* | GCGCGGGGGAGGTCATATCTCACCACCATCCTCGAGCTTTTGCTGCAC | TCGTACGG | GGCCAT | LMEQQPHTKAIREG |
| | | | | CTGATCCGGGMTAACTGGCCGAGAAGTTAAATGTATTACTGTTAATGTA | GTTTTCGT | AACACC | DFIVILLPQSDDETLC |
| | | | | CTCATGGAGCAACAACCACACACCAAAGCGATCCGGGAGGGGGACTTC | GCCGGCAT | TAGGCC | CPLCVGRGRYSGKTR |
| | | | | ATCGTGATACTCCTCCCGCAAAGTGACGACGAGACACTTTGCTGTCCACT | AGCCGGGT | CCACAG | VECLNRHVKEVHPDL |
| | | | | CTGCGTGGGACGCGGACGGTACTCCGGCAAGACGCGGGTTGAGTGTCT | GGGAGAC | TGTGGC | TTTFRCWGCGFAAP |
| | | | | CAATAGACATGTCAAAGAGGTGCACCCAGACCTAACCACCACCTTTAGG | TCGCGCGG | GATGTC | GDKKYPRKIVTQHCA |
| | | | | TGCTGGGGGTGCGGGTTCGCGGCTCCCGGGGATAAGAAATATCCCCGG | GGGAGGT | CATGTG | TCVPEVSSAPSGRVD |
| | | | | AAGATCGTGACCCAGCACTGCGCCACCTGCGTCCCCGAGGTTTCGTCCG | CATATCTC | TGTCGT | GERRVNTRRRLGIAA |
| | | | | CGCCCTCGGGCAGAGTGGACGGAGAGAGGAGAGTTAACACCCGCCGTC | ACCACCAT | CCTTACT | ATEASPVRRTRRNGL |
| | | | | GGTTGGGTATTGCCGCGGCAACCGAGGCCAGTCCCGTGAGACGTACTC | CCTCGAGC | TATTTAT | ASPPVEQNISQSAAP |
| | | | | GTCGTAACGGCCTGGCCTCACCTCCAGTCGAGCAGAACATCAGCCAAAG | TTTTTGCT | TTATTTG | PEPARVPQHPEIVAL |
| | | | | CGCGGCTCCTCCGGAACCCGCAAGGGTGCCACAACATCCGGAGATAGT | GCACCTGA | TCCTGTC | GESADDEVFRSPVNS |
| | | | | TGCGCTGGGAGAGTCAGCGGATGACGAAGTATTTCGATCTCCGGTGAA | (SEQ ID | GAGCTG | PPRDWRAAAPQQA |
| | | | | CTCTCCCCCAAGAGACTGGAGGGCTGCGGCGCCCCAACAGGCGGCTTC | NO: 1187) | TTTAATC | ASSSPXAVPGITAATP |
| | | | | CTCCTCTCCTCSGGCGGTGCCCGGTATCACTGCTGCAACCCCGTCCAACA | | TATTCAT | SNTTRTGNGSAXSILA |
| | | | | CCACCAGGACAGGGAATGGCTCGGCANACTCCATCCTAGCCGAGCACC | | ATGTAT | EHPIPAPPPTNTTEA |
| | | | | CGATACCTGCACCTCCGCCAACCAACACCACGGAGGCGAATGGTCGTGC | | GTGTTG | NGRADIPRSGRAPPP |
| | | | | CGACATACCCCGTTCTGGGCGGGCTCCGCCGCCCGGTCNACAAGCCGCC | | TGTGTG | GXQAARRRAPTTEQ |
| | | | | CGTAGAAGGGCTCCCACGACAGAACAACGTCGCATTGTGGGACTCCTC | | TCGTCCC | RRIVGLLEAATGREQL |
| | | | | GAGGCGGCCACTGGTCGGGAGCAGCTTGAGGAGGCAACGACTCAAGC | | TCGTAG | EEATTQAMLFLARLT |
| | | | | TATGCTATTCCTGGCCAGATTGACCGGGCGGCGGCCTGAACCCCGGAAC | | CAGTTTT | GRRPEPRNAIRPGXR |
| | | | | GCCATTCGGCCGGGAMCGCGGCAACGTCATCCAGCTCAGGGGGATGTC | | ATTCCGT | QRHPAQGDVQAQA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAAGCGCAGGCGCCTGATCGGATTCASGAGGCCAAGAAACTCCAGCGT | | CCAACC | PDRIXEAKKLQRLYRT |
| | | | | CTCTACCGAACATCCAAGAAGCGGGCAGTMCAGAAGATTTTGGCAGGT | | AGAGGT | SKKRAVQKILAGPXM |
| | | | | CCTNATATGAACTGCCAAATCGACAAGAATACCATCACAGCCCACTTTGT | | CGACCA | NCQIDKNTITAHFVEL |
| | | | | GGAGCTGGCTGCCCGCAGAGACGGTGGAGAGGATTGGCCCGATGTCTT | | ATATTAA | AARRDGGEDWPDVF |
| | | | | CGATCGGGAAGAGCCCACGGCGGCGAGCGGCGAGGCCCTTTGTACCCC | | AATAAG | DREEPTAASGEALCT |
| | | | | TATCACAAGGGAGGAAGTGTTTCGACGGCTCAAGGGGAGGAACAACAC | | CATGGC | PITREEVFRRLKGRNN |
| | | | | CTCACCTGGGCCGGACGGAATCACCTACAGGGACCTCGCCAAGGCCSAT | | TTGAAG | TSPGPDGITYRDLAK |
| | | | | CCAGGGGCCCATGTGCTCGCCGCCCTCTATAACASCATCTGGCGCATTG | | CAGGCC | AXPGAHVLAALYNXI |
| | | | | AGGCGACGCCTGCCTTGTGGGGGGTGTCCAACACMACCCTKATATACA | | AAGCGC | WRIEATPALWGVSN |
| | | | | AGAAAGGCGACGCCATGGACATCTCCAACTGGAGACCGATCTCCTTGG | | CGTGTT | TTLIYKKGDAMDISN |
| | | | | GAGATACGGTCCCCAAGCTATTTGCCGCGATCCTGGCCGATAGAATCAA | | CTAACCC | WRPISLGDTVPKLFA |
| | | | | AAGGTGGGCCGTGGCCAACGGGCGCTACAGTGCCTCCCAGAAGGGCTT | | CGTTTTA | AILADRIKRWAVANG |
| | | | | CTTGGAGTTCGAGGGATGCTATGAACATAACTTCGTGCTCCAGGAGGCC | | GGGGAA | RYSASQKGFLEFEGC |
| | | | | ATTCGGGAGGCAAAAGGCGGGAGAAAGGAGTTGGTGGTGGCCTGGCT | | GTTACTT | YEHNFVLQEAIREAK |
| | | | | GGACTTAGCCAGTGCCTTTACATCCGTGCCCCACTCCTCTATCCTGCAGG | | AACCTA | GGRKELVVAWLDLA |
| | | | | CGCTCGAGGGACATGGCCTACCAAGCAAAGCGAGAAACATTATCTCCTC | | AAAATA | SAFTSVPHSSILQALE |
| | | | | GCTCTACACAGGCATGACCACCCGCTTCCACACGGCGGAGGGACCCACC | | CAACTTT | GHGLPSKARNIISSLY |
| | | | | GACCCTATTCTCATCCAGTCGGGGGTCAGACAGGGTTGCCCATTAAGCC | | TCC (SEQ | TGMTTRFHTAEGPT |
| | | | | CCGACGTGTTCAACCTTACCCTGGAAGTTGTCCTACGGGAAATACAACG | | ID NO: | DPILIQSGVRQGCPLS |
| | | | | GACGGGGGAGGGCTACACGATCGAGGGCAGGCGTATTTCCCATCTCGC | | 1310) | PDVFNLTLEVVLREIQ |
| | | | | CTACGCCGATGATGTCGCGATCCTGGCTGACTCCCCGGCTGGAATGAGG | | | RTGEGYTIEGRRISHL |
| | | | | AGGCTGCTTTTTGCAGCAGAACGGGGAGCTCGGGCGGTCGGCCTCACC | | | AYADDVAILADSPAG |
| | | | | TTCAACCCAGCGAAGTGCGCTACACTGCACATAGCGGGACGAGGKGAG | | | MRRLLFAAERGARA |
| | | | | GAGGCAGTTAGACCGACTGAGTTCTCCGTTCAAGGGACACCTGTCCGTG | | | VGLTFNPAKCATLHI |
| | | | | CCCTTGCTTCCGGGGAGGCCTACGAACATCTTGGCATCCCCACAGGCTA | | | AGRGEEAVRPTEFSV |
| | | | | CCAAGTCAGGCAGACCCCAATCAACACCTTGCGGGATCTCCTTGCTGAC | | | QGTPVRALASGEAYE |
| | | | | ATCGGCTCCATCGACCGGTCCTTACTGGCGSCCTGGCAGAAGCTGGATG | | | HLGIPTGYQVRQTPI |
| | | | | CAGTGGGAACCTTCCTACTGCCCCGGCTTGATTTCACCATGCAGGGCGC | | | NTLRDLLADIGSIDRS |
| | | | | CCATATCGACAAGGGCTTCTTGACCGAGGCGGACAAGATCATCAAAAAA | | | LLAXWQKLDAVGTFL |
| | | | | GCTGCAAAATCTTGGCTAAGCCTTCCTCAGCGAGCGAGCGCGGAGCTCG | | | LPRLDFTMQGAHIDK |
| | | | | TGTTTCTACCTCCCTCGCAAGGGGGAGGGGGTTTGCTCACGGTCGCTCA | | | GFLTEADKIIKKAAKS |
| | | | | CAGCTATAAAATGCTGTACTCGAGCGATGTCACCGTGAGCACCATAGCG | | | WLSLPQRASAELVFL |
| | | | | GGATCCACACTGAGGAGGACCGTTTCGGAGAGGCTTAAAAAGCGGGCG | | | PPSQGGGGLLTVAHS |
| | | | | TCTAACATCGATATCGCCCGCTTCCTCTCCGGAGATCTTGATCTGCCCCG | | | YKMLYSSDVTVSTIA |
| | | | | GTCGACGAGCCCGTCGACATTCTGGACCAAGGTTCGGAGCGCGGCCCT | | | GSTLRRTVSERLKKRA |
| | | | | GAGAATTAAGACCAAACTCGGGCTGCGCTGGAGCTGGTGTCAGGGGG | | | SNIDIARFLSGDLDLP |
| | | | | GGGAAGTACTCCTGATGGCCTGTGGGGATCCACGTGCCCCCGGAACAA | | | RSTSPSTFWTKVRSA |
| | | | | GAGTCTCGCCGCAGACAAAACATCTTGTCACCACGAGTCTGCGGCGCTG | | | ALRIKTKLGLRWSWC |
| | | | | CCTGAATCGGCACTATGCGGAGAGTCTCCTTGCCAAAAAAGATCAAGGC | | | QGGEVLLMACGDPR |
| | | | | AAGGTCTTTGAGGTTACCCGGAGGAGCGGACAATCCAACCACTTCCTCC | | | APGTRVSPQTKHLVT |
| | | | | GGAGTGGCAGCTTCACTCGCTTCTGCGACTGGCGCTTTATCCACCGCGC | | | TSLRRCLNRHYAESLL |
| | | | | CCGTCTCGACGTTCTCCCCCTCAATGCTGCCAAACGGTGGCAACGAGGG | | | AKKDQGKVFEVTRRS |
| | | | | ATGGACAAGAGATGTCGCAGATGCGGGTCAGACCTGGAGACTCTCCCG | | | GQSNHFLRSGSFTRF |
| | | | | CATGTGCTGAGTCACTGCGGCCCGCACTCGGCGGCGAGACAAAAGAGG | | | CDWRFIHRARLDVLP |
| | | | | CACAACAACATCCAGGACAGGTTGGTGAAGGCAGCCTCGAGATGTCCG | | | LNAAKRWQRGMDK |
| | | | | GGGACCATTAGTGTCAACCAGACCGTTGTGGGCGTCCGCGGCCCCGAC | | | RCRRCGSDLETLPHV |
| | | | | GCGGCATTAAGACCKGACATTGTCGTTCGCGACGATGTCAACCGCCGCG | | | LSHCGPHSAARQKR |
| | | | | TCACCATCGTCGATGTGGCCGTGCCGTTCGAAAACCGCCTCGAGGCGTT | | | HNNIQDRLVKAASRC |
| | | | | CGACGGCGTTCGKGAGGCCAAGATTGCCAAATATACACCTTTGGCCAGG | | | PGTISVNQTVVGVRG |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAACTCACGGACAGCGGTTACACCGTAACGGTGGAGGCCTTTGTAGTG | | | PDAALRPDIVVRDDV |
| | | | | GGCGCCCTCGGCGCGTGGGACCCGCGAAATGAACGGGTCCTGAGCCTC | | | NRRVTIVDVAVPFEN |
| | | | | CTCAGCATTAGTCGTTATTATGCGATACTGATGAGGAGGCTCATGGTTA | | | RLEAFDGVREAKIAKY |
| | | | | GTGACACAATTCGCTGGTCCCGGGACATCTACGTGGAACATGTGTCGGG | | | TPLARQLTDSGYTVT |
| | | | | CATTCGGCAGTACCGGGAATAGTGGGGCCATAACACCTAGGCCCCACA | | | VEAFVVGALGAWDP |
| | | | | GTGTGGCGATGTCCATGTGTGTCGTCCTTACTTATTTATTTATTTGTCCTG | | | RNERVLSLLSISRYYAI |
| | | | | TCGAGCTGTTTAATCTATTCATATGTATGTGTTGTGTGTGTCGTCCCTCGT | | | LMRRLMVSDTIRWS |
| | | | | AGCAGTTTTATTCCGTCCAACCAGAGGTCGACCAATATTAAAATAAGCAT | | | RDIYVEHVSGIRQYRE |
| | | | | GGCTTGAAGCAGGCCAAGCGCCGTGTTCTAACCCCGTTTTAGGGGAAGT | | | (SEQ ID NO: 1432) |
| | | | | TACTTAACCTAAAAATACAACTTTTCC (SEQ ID NO: 1064) | | | |
| NeSL | Utopia-1_PCa | — | *Phytophthora capsici* | GCCCGCCGGTGGAGTAGCCATGTTGGCCACCACCGCCCAAGTCTCCGCC | GCCCGCCG | TAGACG | MVVSRITARLEATPA |
| | | | | GCAGCTGCGACTGCTGCTGCTCATCGAGTCGCAGTAGTCGCAGCTGCAC | GTGGAGTA | GCACAG | PRWDPPLPRRVIASRI |
| | | | | AAGCACCACCTCCTGCCGGACGCGCCGCCGTGGAGCACCACGCGCGCG | GCCATGTT | TTCTGG | ADRLVPATAPCRSAL |
| | | | | CTGAGCCGTACCAAGACCAAGGNTTCCAGGCTCGCGCGCGCGTGGMG | GGCCACCA | CCCACG | NAAFPSPSRDTVTES |
| | | | | CTCCCAGCCAGCGACGCGTTCAGCAGCAGGGTCGGCTGCGGCAGCTCG | CCGCCCAA | TAGGCC | FTQEDRQLEPLTRHV |
| | | | | ACGCTGCACGGGGACGGCAGCGACGGCAGGCACCAAGACCACGACGA | GTCTCCGC | GAAAGG | DEETKDSELPGRAPT |
| | | | | CCAAGCCGTCGCTGCCGTCCCCATGGACGTCGACCAAGGTGCTCGGTGG | CGCAGCTG | GCCCCA | VLDEESKDNDATAGE |
| | | | | CCGACAGCGGATCAMCACCCGCTGTCGCCGCCACCGGAGCTCCGAGTC | CGACTGCT | CCCATGT | WLLRFDGACRANPG |
| | | | | GGCGGCAAGCGCCGCCGCCTGAACGACGGCGACGACGAAGACATCCGC | GCTGCTCA | AGGGAA | PGGAGAVLFNPSGA |
| | | | | GAGCTGGCCGAGCTTCTGCTGCCCGACGAGGAGGAGGCCGACGACCAC | TCGAGTCG | CCGCCCT | ASWTCSHFMPGATE |
| | | | | AAACCAGCGCCCAGGTTACCCGCGACCAGCGCTCATCCGGCCTCCGTCC | CAGTAGTC | CGGGAA | TNNTAEYTAFLLGAR |
| | | | | TCGCTGTGTACGCGCACAACGCGCAGCGCTTCAACTGCACGTTGTGCGT | GCAGCTGC | ATCCATT | AAADHGATLLRVQG |
| | | | | GTACACGGCTGCCAGCTTCGCTGCTCTTACGCGACACAGGGACTCTCGG | ACAAGCAC | CCGGTG | DSQLVLRQVKGIYGA |
| | | | | CACCGGCGCGTGACCTTCCTGGACAGGTTCTCGGCGGGTTGCGCGTGC | CACCTCCT | TTCGACT | KSTRLRRLRDAVRAEL |
| | | | | GGCAAACCTTTTGCCTCGAGGCTGGCCGCAGCAAGACACGCACAAACG | GCCGGAC | GAAGAG | ARVGQFSLHHIDRQD |
| | | | | TGCGCCAGCCTCAGCACCACACTGGTCGCGGTTTCGACGACAGGAGGA | GCGCCGCC | ATGCTCC | NAHADRLANRALDM |
| | | | | GCATCAAGCCACACTGTCGTCGGAGCCAACACCACCGTCGCCACGGCG | GTGGAGC | TTCGCCT | KSTLVECATHPGRNA |
| | | | | GTCACCGCCGAACCCCCCCTGCTCCACCATCAAGCCTCGGAACTCACTGT | ACCACGCG | TGACGG | CTTTLTTSAAAESPAS |
| | | | | GCCCCCCCCCACGTGTGAGTTCCCCCGACGTCGATGTGCAGCTGCACAG | CGCGCTGA | AGGTAC | PPPVGARDTPMADA |
| | | | | TCCGCCACAGGAAGATCAGCACGAGGACGCCACCCANCACCCGGAGAG | GCCGTACC | ATCTCG | GEERLADVDDGEVY |
| | | | | CACGCAACACCAACCTCCTGAGGCAACCCGCTGGGGTTCGCCGCTCGCG | AAGACCAA | ACAGTC | AAMRLGPGEVPERR |
| | | | | CCCACGCTCGTTGCCTCCAGGATTGCTCAGCGACTCGGCGAGCTGGAAC | GGNTTCCA | GAACTT | PRLRLRQLSDEELEAA |
| | | | | CTCCACGCTGGGGCCCACCATTACCCCGCGCGATGGTTGTTTCGCGAAT | GGCTCGCG | CAACTC | SEMVERLGAALSAKI |
| | | | | TACAGCACGGCTTGAAGCTACACCTGCTCCTCGATGGGATCCGCCACTC | CGCGCGTG | GCAACA | TDAEDWASAEGYITA |
| | | | | CCACGCCGCGTCATCGCCTCCCGCATTGCCGACCGGCTTGTACCTGCGA | GMGCTCC | TATCCG | LPYMLYDKLQSYSQA |
| | | | | CGGCACCGTGTCGCTCGGCCCTGAACGCTGCATTCCCTTCTCCATCGCGA | CAGCCAGC | ATACAG | PRGPQQPVLTRSPRG |
| | | | | GACACGGTGACGGAATCGTTCACCCAGGAGGACAGGCAACTGGAACCC | GACGCGTT | TTACAA | DDRPASSEPNASSTT |
| | | | | CTGACGCGGCACGTGGACGAAGAGACGAAGGACAGCGAGCTGCCGGG | CAGCAGCA | ACCACA | GGVASEHQPRRRRR |
| | | | | CAGGGCGCCGACTGTACTCGACGAGGAGTCCAAGGACAATGACGCCAC | GGGTCGG | GTTAGA | RGRRKGRRQRRNPR |
| | | | | TGCCGGTGAGTGGCTCCTCCGGTTCGACGGAGCTTGTCGAGCGAACCCA | CTGCGGCA | TATCAG | RSGREGATGGHQQH |
| | | | | GGCCCAGGCGGAGCAGGTGCCGTGCTATTCAACCCTAGCGGTGCAGCG | GCTCGACG | ATAGGA | KKHKPRPPRETQHHR |
| | | | | TCATGGACCTGCTCGCACTTTATGCCGGGCGCCACGGAGACAAACAACA | CTGCACGG | ACCTTCC | EHRLDEALDELHALE |
| | | | | CCGCCGAGTACACGGCATTCCTCCTAGGCGCCAGAGCTGCTGCAGATCA | GGACGGC | TTTAGG | RTDPHNRPAIAKARR |
| | | | | CGGTGCGACGCTACTTCGCGTCCAGGGGGACAGCCAGCTCGTACTCAG | AGCGACG | AAGCTA | RVGRIRSAINQQLLR |
| | | | | GCAGGTCAAGGGCATTTACGGTGCGAAGAGCACCCGTCTACGGAGACT | GCAGGCAC | ACGGGT | HKFDTDEKACVDGIL |
| | | | | ACGCGACGCTGTTCGTGCCGAACTGGCTCGGGTGGGGCAATTCTCCCTC | CAAGACCA | ACACTG | STARAERAARAATPS |
| | | | | CACCACATCGACAGGCAGGACAATGCGCACGCAGACCGCCTTGCGAAC | CGACGACC | GATGGT | PPASGAPTTTVSAPG |
| | | | | AGAGCGCTCGACATGAAGAGCACACTAGTGGAATGCGCAACGCACCCC | AAGCCGTC | AAATAC | AIVTNDDGTCPIPSDK |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCCGGAACGCCTGCACCACGACACTGACCACCAGTGCTGCCGCTGAAT CACCGGCATCACCCCCGCCGGTGGGAGCTCGAGACACGCCGATGGCCG ATGCCGGCGAAGAGCGCCTCGCAGACGTTGACGATGGTGAAGTTTACG CGGCGATGCGGCTTGGCCCAGGCGAAGTTCCTGAACGACGGCCACGAC TCCGCCTCCGCCAGCTGAGCGACGAGGAACTGGAAGCAGCGAGCGAGA TGGTGGAGCGACTGGGCGCCGCCTTATCGGCCAAGATCACAGACGCGG AAGACTGGGCGAGTGCGGAGGGCTACATCACGGCCCTACCGTACATGC TGTACGACAAGCTTCAGTCGTACTCACAGGCACCGCGTGGACCCCAACA ACCGGTCTTGACCCGGTCCCCGCGCGGCGACGATCGCCCAGCTTCCTCG GAGCCCAACGCATCATCCACGACTGGAGGGGTGGCATCGGAGCACCAA CCGCGGCGCCGCCGACGACGAGGACGACGCAAGGGCCGACGACAGCG CCGCAACCCGCGCCGATCGGGACGCGAGGGAGCTACAGGTGGGCATCA ACAACACAAGAAACACAAACCACGCCCACCCCGCGAGACGCAGCATCAT CGGGAACACCGTCTCGACGAGGCTCTCGATGAGCTCCACGCCCTCGAGC GTACCGATCCTCACAACCGGCCAGCAATTGCCAAGGCCCGCCGCCGCGT CGGTCGCATCCGGTCTGCCATCAACCAGCAGCTACTCCGCCACAAGTTC GACACGGACGAGAAGGCCTGTGTCGACGGCATCCTGTCTACAGCCCGC GCCGAACGCGCTGCACGAGCAGCAACGCCGTCGCCACCAGCATCAGGA GCGCCCACCACGACAGTCTCGGCGCCCGGTGCCATCGTGACCAACGATG ATGGCACGTGCCCCATCCCGAGTGACAAGCTTTGGCGACACTTCGACGC CGTGAACACACCGCGCCTTGACTTCGATGCGGAGGCACCCGGGAGTGC GGCCTTCCGAGCGGCGATGGACCACCTGCCCGCGGCGACACGGTTGCT GGACCTGCTCAAAGAGGCGCCGAGCACGGACGAGATCGAGACGCAACT CCAGCACGTGAAGGCCTCCTCCAGCCCCGGCCTCGACGGCGTCGGCTAC GACGTGTACAAGCGCTTCACGATACAGTTGCTGCCTGTGCTGCGGGCGG CGTTCCGGTGCTGCTGGCTGTATAAGAAGGTTCCTCAGAGCTGGAAGCT CGGCGTGGTGCGCTTGCTGCACAAGAAGGGCCCGCGTGAGGACCCTGC GAACTGGAGACCCATCTGTCTCCAGCAAGCCATCTACAAACTATACACG GGCATCCTCGCGCGGCGACTAACCCGGTGGATGGACGCGAATGACCGC CACGCACCCGGTCAGAAGGGATTCCGAGCGGTGAACGGCTGCGGGGA ACACAACTTCCTCGCAGCTACGCTCATCGACAACGCCCGCCGCAAGCAT CGGCCACTGTACGAAGTCTGGTACGACTTCCGTAACGCGTTCGGCAGCG TGCCGTTCGCGTTGCTGTGGGATTCGCTACAGCGCCTCGGTGTCCCGCC CGACTACGTGGACATGTGCAAGGGACTCTACAACCAAGCCTCGTTCGTC GTCGGGAACGCAGTGGATGGCAGCACAGCGCCGGTAGAGCAGCGCGT CGGCGTTTTTCAAGGCTGTCCGCTCAGCCCCCAGCTCTTTAACGCCGCCA TCAGCCCACTGCTCTATGCGCTGCGCCGGCTACCAGATACCGGCGTGCA GCTCTCCAGTGTTGACCGCCCTGGTGCCTCAGCGTACGCCGACGACCTT AAGATTTTCAGCGGCACCAAGGCGGGCATCACGCAGCAACACGAGCTG GTGGCGACGTTCCTGCGGTGGACCGGGATGCAGGCCAACCCTGCCAAG TGCAGGTCCATGGGCGTGCGGCGCAACACCAACGGMGCCGTCGAGGC AGACAACGTCCACCTCGAGCTCGACGATACGCCGATCCCCTCCATGACA CACATGCAATCCTACACGTACCTGGGGATCGGCGACGGCTTCGATCACG TGCGCCGCCGCGTCGAGCTCGCTCCCAAGCTGAAGACTCTCAAGCACGA CGTGACGGCGCTCGTGGAGTCCGGCCTTGCGCCATGGCAGGTGGTGAA GGCCGTGAAGGTGTACCTCTACCCTCGGGTAGAGTACGCCCTCCGGCAC CTCCGACCCGATGATCAGCACCTGGAGAGCTTCGACCTCCACCTTCGCC GCGGCCTCCGCCACCTGCTTCGCCTTCCCAAGAACGCCACGAACGAATT CTTCTACGCGCCGGTGTCGCGCGGTGGTTTGGGGCTGCTGCCGCTGGTG | GCTGCCGT CCCCATGG ACGTCGAC CAAGGTGC TCGGTGGC CGACAGCG GATCAMC ACCCGCTG TCGCCGCC ACCGGAGC TCCGAGTC GGCGGCA AGCGCCGC CGCCTGAA CGACGGC GACGACG AAGACATC CGCGAGCT GGCCGAG CTTCTGCT GCCCGACG AGGAGGA GGCCGAC GACCACAA ACCAGCGC CCAGGTTA CCCGCGAC CAGCGCTC ATCCGGCC TCCGTCCT CGCTGTGT ACGCGCAC AACGCGCA GCGCTTCA ACTGCACG TTGTGCGT GTACACGG CTGCCAGC TTCGCTGC TCTTACGC GACACAG GGACTCTC GGCACCG GCGCGTGA CCTTCCTG GACAGGTT CTCGGCGG GTTGCGCG TGCGGCAA | ACATAC ATTTC (SEQ ID NO: 1311) | LWRHFDAVNTPRLD FDAEAPGSAAFRAA MDHLPAATRLLDLLK EAPSTDEIETQLQHV KASSSPGLDGVGYDV YKRFTIQLLPVLRAAF RCCWLYKKVPQSWK LGVVRLLHKKGPRED PANWRPICLQQAIYK LYTGILARRLTRWMD ANDRHAPGQKGFRA VNGCGEHNFLAATLI DNARRKHRPLYEVW YDFRNAFGSVPFALL WDSLQRLGVPPDYV DMCKGLYNQASFVV GNAVDGSTAPVEQR VGVFQGCPLSPQLFN AAISPLLYALRRLPDT GVQLSSVDRPGASAY ADDLKIFSGTKAGITQ QHELVATFLRWTGM QANPAKCRSMGVRR NTNGAVEADNVHLE LDDTPIPSMTHMQS YTYLGIGDGFDHVRR RVELAPKLKTLKHDVT ALVESGLAPWQVVK AVKVYLYPRVEYALR HLRPDDQHLESFDLH LRRGLRHLLRLPKNAT NEFFYAPVSRGGLGL LPLVELHAALQIAHG WQTLHSPDPAIRRVA REQLYQIADARHRLD KDHWPHRREELCELL LNGELGTSAHAPPKR RNGDIGSLWVDVRK NLKTFGLKVATAPAN QETGVPAQPLQLRVP HHAEWLDHGNVLRH VKLHIKNLHWQTWC ALSDQGKTARVHGG VGSAFLTRPRGMWE SDYRFAVAARLNVVD TVNTLSRRRLRAHDR CRYPACRWKETLAH VLNHCPGTMDAVRG RHDDALKEIEHTLRAS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAACTGCACGCAGCACTGCAAATCGCGCACGGATGGCAGACGCTCCAC<br>TCACCCGACCCAGCCATCCGTCGCGTCGCGCGCGAGCAGCTCTACCAGA<br>TTGCCGACGCGCGGCACCGGCTCGACAAGGACCACTGGCCACACCGGA<br>GAGAGGAACTTTGCGAGCTCCTCCTCAACGGGGAGCTCGGGACGTCGG<br>CCCACGCACCGCCCAAGCGACGCAACGGTGACATCGGCTCTCTGTGGGT<br>CGACGTCCGCAAGAACCTCAAGACGTTTGGACTGAAGGTGGCCACAGC<br>GCCGGCCAACCAGGAGACCGGTGTACCAGCCCAGCCGCTGCAGCTCCG<br>CGTGCCTCACCACGCCGAGTGGCTGGACCACGGCAACGTGCTGAGGCA<br>CGTGAAGCTACACATCAAGAACCTCCACTGGCAAACCTGGTGCGCCCTA<br>AGTGACCAAGGGAAGACCGCACGGGTGCACGGCGGTGTTGGCAGCGC<br>ATTCCTGACCCGACCTCGCGGCATGTGGGAAAGCGACTACCGCTTCGCG<br>GTGGCCGCTCGCCTCAACGTGGTCGACACCGTCAACACACTGTCGCGCC<br>GGCGACTCCGCGCCCACGACCGGTGTCGGTACCCGGCCTGCAGGTGGA<br>AGGAGACTCTGGCACACGTCCTCAACCACTGCCCGGGTACCATGGACGC<br>GGTACGTGGCCGGCACGATGACGCGCTCAAGGAAATCGAACACACGCT<br>CCGCGCGTCGTCGGGCGACCGCCGCGAGCTGCGTGTTAACCAAACGGT<br>GCCTGGCCTGCCCGGGCCACCCCTGCGCCCCGACATCCAGGTCTACAAC<br>CATGACAAACGCACGGTCGCAGTTGTAGACCTGGCTGTGGCGTTCGATG<br>AGCAGCCGAGTGAGGACCCAGAGAGCTCGGGGTTGGCCAAGGCAGTC<br>CAGATCAAGAAAGCCAAGTACGCGGGCATCAAGGAGCATCTCGAGAAC<br>CAGGGGTGGAAGGTTCATCTCTCGGCCATCGTGTACGGCTCGCTTGGCT<br>CGGTGGCGGCCAGCAACCACAAGGTGTACACTGAACACCTTGGGTTGC<br>TCAAGCGCGATGCAAAGCGGCTGGACCGGCAGCTCTCGTCGGCATGCA<br>TCCAGTCCAGCCGCCGCATCTGGAATTTCCACTGCGCCAAGCACCGAGC<br>ACGCCAGCACGAGCACCAAGCACCACCAAGCCAAGCGACACGGGGCAG<br>GAGGGTGACGGAAACCGGGGGGAATCCGTCGCGCACCGACCGCCGCT<br>AGACGGCACAGTTCTGGCCCACGTAGGCCGAAAGGGCCCCACCCATGT<br>AGGGAACCGCCCTCGGGAAATCCATTCCGGTGTTCGACTGAAGAGATG<br>CTCCTTCGCCTTGACGGAGGTACATCTCGACAGTCGAACTTCAACTCGCA<br>ACATATCCGATACAGTTACAAACCACAGTTAGATATCAGATAGGAACCT<br>TCCTTTAGGAAGCTAACGGGTACACTGGATGGTAAATACACATACATTT<br>C (SEQ ID NO: 1065) | ACCTTTTG<br>CCTCGAGG<br>CTGGCCGC<br>AGCAAGAC<br>ACGCACAA<br>ACGTGCGC<br>CAGCCTCA<br>GCACCACA<br>CTGGTCGC<br>GGTTTCGA<br>CGACAGG<br>AGGAGCAT<br>CAAGCCAC<br>ACTGTCGT<br>CGGAGCCA<br>ACACCACC<br>GTCGCCAC<br>GGCGGTCA<br>CCGCCGAA<br>CCCCCCCT<br>GCTCCACC<br>ATCAAGCC<br>TCGGAACT<br>CACTGTGC<br>CCCCCCCC<br>ACGTGTGA<br>GTTCCCCC<br>GACGTCGA<br>TGTGCAGC<br>TGCACAGT<br>CCGCCACA<br>GGAAGATC<br>AGCACGA<br>GGACGCCA<br>CCCANCAC<br>CCGGAGA<br>GCACGCAA<br>CACCAACC<br>TCCTGAGG<br>CAACCCGC<br>TGGGGTTC<br>GCCGCTCG<br>CGCCCACG<br>CTCGTTGC<br>CTCCAGGA<br>TTGCTCAG<br>CGACTCGG<br>CGAGCTGG<br>AACCTCCA | | SGDRRELRVNQTVP<br>GLPGPPLRPDIQVYN<br>HDKRTVAVVDLAVAF<br>DEQPSEDPESSGLAK<br>AVQIKKAKYAGIKEHL<br>ENQGWKVHLSAIVY<br>GSLGSVAASNHKVYT<br>EHLGLLKRDAKRLDR<br>QLSSACIQSSRRIWN<br>FHCAKHRARQHEHQ<br>APPSQATRGRRVTET<br>GGNPSRTDRR (SEQ<br>ID NO: 1433) |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | CGCTGGG | | |
| | | | | | GCCCACCA | | |
| | | | | | TTACCCCG | | |
| | | | | | CGCG (SEQ | | |
| | | | | | ID NO: | | |
| | | | | | 1188) | | |
| NeSL | Utopia- | — | *Phytophthora* | AGCTCGGCCTCGCGGCTGCCTTCCCAGGCGCCGCCGACTTCGCGCTCTG | AGCTCGGC | TAAGCT | MLADPAALAAGLAR |
| | 1_PI | | *infestans* | GCGCGGCCCACACGCCGCCGCCGAGCCTCCAAGCGCGCCCGTTGGCTTT | CTCGCGGC | GGTCAT | APPPPSAPQDPSPAF |
| | | | | CGCAGACGCAGGGCTCGCGGCGACGGCCCTCGCCAGCCCCCAAGACCC | TGCCTTCC | CATGAC | PAGPAGQNPRAAAP |
| | | | | CCCCTACGATGTGGCACCACCCGGCAGGGCGGCCGGCAGGCTGCCCGA | CAGGCGCC | CGACAG | ARVEVHTVVAPPGR |
| | | | | CTCGGTATCGCCGGGTGCTACACTCTCAGCCGCCACAGCTCGGGCCTTG | GCCGACTT | GGCACT | AGGMLPDPGLVEEPI |
| | | | | GCGGTCCGCCATTGGCCCTTGGAGCTCGACAGCGACAGCAGCGACGAC | CGCGCTCT | ACCCAG | QATYAHDAAQFECA |
| | | | | GAGGACGCTCAAGACCCCCACGCCGCCGCCCCAGAACCCCCAGAAGAC | GGCGCGG | GTAGGG | LCPYVAESMAVLVQ |
| | | | | GTCGCGAGTGTGCTTGCCCCACCCGGCAGGGCAGGCAGCATGCTCGCC | CCCACACG | AACCGC | HRRSAHRGTRFKDIF |
| | | | | GACCCAGCAGCGCTGGCAGCCGGTCTGGCTCGCGCTCCGCCGCCCCCAT | CCGCCGCC | CCTTAAA | TSGCQCSLVFYARIVA |
| | | | | CGGCACCCCAGGACCCAAGCCCCGCCTTCCCTGCTGGCCCCGCCGGCCA | GAGCCTCC | AAACCC | ASHAVACARRNQRA |
| | | | | GAACCCTCGCGCCGCCGCCCCAGCCCGTGTTGAAGTCCACACAGTCGTG | AAGCGCGC | AGGAAG | VPPAPTPVAPTRPEA |
| | | | | GCACCACCCGGCAGGGCGGGCGGCATGCTGCCCGACCCGGGGTTGGTT | CCGTTGGC | ACACAA | TPQPTGYLAAAMTA |
| | | | | GAAGAACCTATCCAAGCGACGTACGCGCACGACGCTGCCCAGTTCGAG | TTTCGCAG | ACACCCT | AAAAASSDTVVAAAT |
| | | | | TGTGCGTTGTGCCCGTACGTCGCTGAGAGCATGGCAGTGCTCGTTCAGC | ACGCAGG | CCACTTA | NMQSAVPAAAKTTG |
| | | | | ACCGACGGTCGGCTCACCGCGGCACCCGCTTCAAGGACATCTTCACCAG | GCTCGCGG | GTGACA | LQLVPPELEPALPQR |
| | | | | CGGGTGCCAGTGCAGCCTAGTGTTTTACGCGCGCATTGTTGCCGCCAGC | CGACGGCC | TACATAT | ASCHAGKRRRLNAD |
| | | | | CATGCAGTGGCCTGTGCCAGGCGCAACCAGCGAGCCGTGCCACCAGCT | CTCGCCAG | TTTAGCC | EAVTPCTPTARVSPQ |
| | | | | CCGACCCCTGTTGCCCCCACGCGGCCCGAGGCTACCCCACAACCTACTG | CCCCCAAG | TAGATTT | TEVAMAPHDAPQD |
| | | | | GGTACCTCGCCGCGGCGATGACTGCCGCTGCGGCAGCCGCATCAAGCG | ACCCCCCC | CAGTTA | DTVLQREAAEPQPDP |
| | | | | ACACCGTAGTGGCAGCCGCCACCAACATGCAGAGCGCCGTGCCAGCCG | TACGATGT | CGGAGA | AATPGAQVQRVEDT |
| | | | | CCGCCAAGACCACTGGGCTTCAGCTCGTCCCCCCCGAGCTGGAGCCTGC | GGCACCAC | GGTTAC | TAAQDDTVQQDHD |
| | | | | CCTTCCGCAGCGTGCTTCTTGCCATGCAGGCAAACGCCGTCGGCTCAAT | CCGGCAG | TAACTG | ADTAQVSPPRRTPTR |
| | | | | GCCGACGAGGCGGTGACACCGTGTACGCCTACGGCGCGGGTGTCGCCG | GGCGGCC | GTAAAT | WGPRPSSTQEPSPM |
| | | | | CAAACAGAAGTGGCGATGGCGCCTCACGACGCACCCCAGGACGACACC | GGCAGGCT | ACGAAC | TGEPAATLAARRPLT |
| | | | | GTCTTACAGCGTGAGGCCGCCGAGCCACAGCCAGACCCAGCAGCAACG | GCCCGACT | ACATATT | PAATGTRATRWGPC |
| | | | | CCGGGTGCCCAAGTGCAGCGAGTCGAAGACACAACTGCGGCGCAGGAT | CGGTATCG | CTGTTCT | HRAIGAAAIARLVTGL |
| | | | | GACACTGTGCAGCAGGACCACGACGCCGACACTGCCCAGGTCTCGCCG | CCGGGTGC | AATCAG | STEPAQPQRRQPPPP |
| | | | | CCCCGGCGCACACCCACACGCTGGGGACCAAGACCAAGCTCAACTCAA | TACACTCT | TGTGAA | QEPPSQPEPLAAAAT |
| | | | | GAGCCTAGCCCCATGACAGGCGAGCCGGCTGCCACCCTGGCAGCGCGA | CAGCCGCC | AACTGG | AAADIAATVAADIAA |
| | | | | AGACCACTGACTCCTGCCGCAACGGGCACTCGTGCCACGCGGTGGGGG | ACAGCTCG | TTTTCGC | AAANAAMDVDGGP |
| | | | | CCATGTCACCGCGCGATCGGGGCCGCAGCCATCGCACGACTTGTCACGG | GGCCTTGG | CTTTTGG | AADETWLLRFDGAC |
| | | | | GCCTTTCAACGGAGCCAGCGCAGCCTCAGCGACGGCAGCCACCGCCAC | CGGTCCGC | CGGACT | RRNPGPGGAGAALF |
| | | | | CACAAGAACCTCCATCGCAACCAGAGCCGCTAGCAGCAGCAGCAACAG | CATTGGCC | TTTTCAC | APSGAVVWTCSHYM |
| | | | | CCGCAGCAGACATAGCAGCAACAGTTGCAGCAGACATTGCGGCAGCGG | CTTGGAGC | TCGCATT | PSRSETNNTAEYTALL |
| | | | | CAGCGAACGCAGCAATGGACGTGGATGGTGGACCGGCAGCCGACGAG | TCGACAGC | TTTGGG | LGVQSAVHHGASHL |
| | | | | ACATGGCTGTTGCGCTTTGACGGCGCATGCCGACGGAACCCAGGACCT | GACAGCA | CAATCG | EVEGDSSLVIAQVKG |
| | | | | GGTGGAGCAGGTGCCGCACTCTTTGCGCCCAGCGGTGCCGTGGTGTGG | GCGACGAC | TCTGCG | TFACRNARLRQLRNR |
| | | | | ACGTGCTCGCACTACATGCCAAGCCGCTCCGAAACGAACAACACCGCCG | GAGGACG | GCTAGC | VRHALRSVDTHKLRH |
| | | | | AGTACACGGCGTTACTGCTCGGCGTACAGAGCGCAGTCCACCACGGTG | CTCAAGAC | TTGCTA | IDRQANAHADRLAN |
| | | | | CCTCGCACCTGGAAGTCGAGGGCGACAGCAGCCTGGTAATCGCTCAGG | CCCCACGC | GCGGCG | RALDQRRTSSECGTH |
| | | | | TAAAGGGCACCTTCGCATGCAGGAATGCGCGGCTCCGCCAACTCCGCAA | CGCCGCCC | GACGAG | GSCMDSCLAVPTALA |
| | | | | CCGAGTGCGTCACGCGCTCCGCTCCGTGGACACGCACAAACTCCGGCAC | CAGAACCC | CGGTCT | AQETPPAAPPSTSAT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATCGACCGCCAGGCCAACGCGCATGCAGATCGCCTTGCCAACCGCGCGC | CCAGAAGA | CCGGGG | PAEGNAMDDIAAEIA |
| | | | | TAGACCAGCGGAGGACCAGCAGCGAGTGCGGGACGCATGGCTCGTGC | CGTCGCGA | GCGTTC | ARDEGETFPVLPIGP |
| | | | | ATGGACTCCTGCCTCGCCGTACCCACGGCCCTGGCGGCGCAAGAAACGC | GTGTGCTT | ACCTTTC | GSAPERQPRLRLRQL |
| | | | | CACCGGCAGCACCACCCAGCACCAGTGCCACTCCAGCCGAAGGTAATGC | GCCCCACC | CCCCGC | SDEERDAAADALQEL |
| | | | | CATGGACGACATCGCAGCCGAGATTGCTGCGCGTGACGAGGGCGAGAC | CGGCAGG | GAGGCC | ADTMASKIEDADSW |
| | | | | CTTCCCAGTCCTGCCAATTGGCCCAGGCTCAGCCCCAGAACGGCAACCC | GCAGGCA | AACTAC | TSGEGYISSIPERIREV |
| | | | | CGACTCCGTCTGCGCCAACTTAGCGATGAAGAGCGCGACGCAGCGGCA | GC (SEQ ID | ACCGAT | LQPYATAPPQPGRSR |
| | | | | GATGCCCTGCAGGAGCTCGCCGATACCATGGCGAGTAAGATCGAGGAT | NO: 1189) | CTTCTCT | RQQRRRPPRVTRNQ |
| | | | | GCTGACAGCTGGACCTCCGGCGAAGGATACATCAGCTCCATCCCCGAGC | | ACACTTT | REHRLDEALDDMAA |
| | | | | GTATCCGAGAGGTACTGCAGCCATACGCTACGGCCCCGCCGCAGCCGG | | TCTAATT | TQQATPRDQRAVRR |
| | | | | GACGCTCTCGCCGGCAACAACGCCGTCGACCACCACGGGTGACGCGCA | | CGCCTCC | ARRRVGRVRASMAQ |
| | | | | ACCAGCGCGAACATCGACTCGACGAAGCTTTGGACGACATGGCAGCCA | | GTCTTC | QELRHEFAKDESKCV |
| | | | | CACAGCAAGCGACCCCGCGAGACCAGCGGGCTGTGCGCCGTGCGCGGC | | GGTCTT | AKILKTASTETAAEDE |
| | | | | GACGTGTGGGCCGGGTGCGAGCCTCAATGGCACAACAGGAGCTGCGCC | | CGGTTG | HPETCPIDAATLHAH |
| | | | | ACGAGTTTGCCAAGGACGAGTCTAAGTGTGTGGCCAAGATCCTGAAGA | | TCGGGC | FTGVNAPRTDFDYDA |
| | | | | CAGCGTCGACAGAGACGGCAGCGGAGGACGAGCACCCGGAGACGTGC | | TTTTTTC | TSGREFRAAMSDLPP |
| | | | | CCCATTGATGCAGCTACGCTCCACGCCCATTTCACGGGAGTCAACGCGC | | TTTTTGA | ATVEIDAFDAELTIDE |
| | | | | CAAGGACGGACTTCGACTACGATGCCACCAGCGGCCGGGAGTTTCGAG | | CCAATC | VEDQLTRAAKTSSPG |
| | | | | CGGCGATGAGCGACCTTCCGCCAGCCACCGTGGAGATTGATGCGTTCG | | AGAGCG | HDGIDYGIYSRFAAQ |
| | | | | ACGCGGAGCTGACGATCGACGAGGTGGAGGACCAGCTCACACGCGCG | | CGCCAT | LVPLLHAVFQFCWRH |
| | | | | GCCAAGACCTCAAGCCCCGGCCACGACGGCATCGACTACGGCATCTACA | | GCGCCT | RRVPRLWKVGIVRLI |
| | | | | GCCGCTTCGCCGCGCAGCTCGTTCCGCTCCTCCACGCGGTGTTCCAGTTT | | CTTCTG | HKKGDPRQPTNWRP |
| | | | | TGCTGGAGACACCGTCGTGTGCCAAGACTGTGGAAGGTGGGCATCGTA | | GCCAAT | ICLQPTIYKLYSGLLAH |
| | | | | CGCCTCATCCACAAGAAGGGCGACCCAAGGCAGCCGACTAACTGGAGG | | CAGAGA | RLSRWLEGNDRLPM |
| | | | | CCGATCTGCCTTCAGCCCACGATCTACAAGCTCTACAGCGGGCTGCTGG | | CCGGGC | AQKGFRAFNGCHEH |
| | | | | CGCATCGGCTCTCACGCTGGCTGGAAGGTAACGACCGCCTGCCGATGG | | CCTGTCC | NFMATTLLDQTRRQ |
| | | | | CCCAGAAGGGGTTCAGGGCCTTCAACGGGTGCCACGAGCACAATTTCAT | | TCGGAC | HRKLYQVWYDLRNA |
| | | | | GGCTACCACGTTGCTGGACCAGACCCGCCGGCAGCACCGAAAGCTGTA | | AGCGAG | FGSLPQQLMWRVLR |
| | | | | CCAAGTGTGGTACGACCTTCGCAACGCCTTCGGCTCGCTTCCTCAGCAG | | GCCTCC | HLGVDSGFIDRCRDIY |
| | | | | CTCATGTGGCGCGTGCTTCGCCACCTTGGCGTCGACTCAGGCTTCATCG | | ACGGCC | RDSAFVVANAADGA |
| | | | | ACCGCTGCAGGGATATCTACAGGGACTCGGCCTTCGTGGTGGCGAACG | | AGCCAA | TDPVRQEVGVYQGC |
| | | | | CGGCGGACGGTGCGACGGACCCGGTGCGCCAAGAGGTGGGCGTATAC | | TCGAGT | PLSPLLFVAALVPLVR |
| | | | | CAAGGCTGCCCACTCAGCCCGCTCCTGTTCGTCGCGGCGCTGGTGCCTC | | CTCGGC | RLEKLDGVGVPLADG |
| | | | | TCGTGCGCCGTCTCGAGAAACTCGACGGCGTTGGTGTGCCACTGGCGG | | AGCGAC | VRPCTTAYADDLKVF |
| | | | | ACGGTGTGCGGCCCTGCACCACGGCCTACGCCGATGACCTCAAGGTGTT | | GCGTCT | SDSAAGIRKCHDTVA |
| | | | | CAGCGACAGCGCCGCCGGCATCCGCAAGTGCCACGACACAGTGGCTGG | | TTCTATA | GFLAWTGLRANPGK |
| | | | | CTTCCTCGCGTGGACAGGGCTGCGCGCTAACCCTGGCAAGTGTGCCAGC | | GCGCAG | CASLAVTTNARGNPT |
| | | | | CTCGCAGTGACGACGAACGCCCGGGGCAACCCGACTAGAGACAGCAGC | | CTGACG | RDSSMRLEVHDAAIT |
| | | | | ATGCGTCTCGAGGTCCACGACGCCGCCATCACCACGCTCAGCCTCCACG | | AGGCCG | TLSLHESYRYLGVGD |
| | | | | AAAGCTACCGCTACCTGGGCGTGGGTGATGGATATGACCACGTGCGCC | | ATCTGG | GYDHVRHRLQLEPKL |
| | | | | ATCGTCTCCAGCTCGAGCCAAAACTCAAGCAGCTCAAGCGGGAGGCGG | | CGGCCC | KQLKREAVALLTSGL |
| | | | | TGGCGCTGCTGACGTCGGGTTTGGCACCGTGGCAGGTGGTGCGCGCGC | | CCGATT | APWQVVRALKVYVY |
| | | | | TCAAGGTGTACGTCTACCCCAAGGTGGAGTACGCGCTGCGCCACCTGCG | | GGTCCG | PKVEYALRHLRPLQS |
| | | | | CCCGCTGCAGTCGCAACTGCAGGCGTTCGACCGTGTCGTCTCCAAGGGC | | ACTTTCG | QLQAFDRVVSKGLRH |
| | | | | TTGCGACACCTGCTGAGCCTGCCTCGCTCAGCCACCAGCGAGGTGCTGT | | GCCAAT | LLSLPRSATSEVLYAP |
| | | | | ACGCCCCGACGTCCAGCGGAGGCCTGGGCCTGCAGCCGCTCGTGGAGC | | CAGCGA | TSSGGLGLQPLVELH |
| | | | | TGCACCGCGCCCTACAGCTCGCCCACGCGTGGCAGATGCTGCATTCCAA | | CGACGA | RALQLAHAWQMLH |
| | | | | GGACCCAGCCATCCAAGCAGTGGCAAGAGCGCAGGCTTGCCAGGTGGT | | GGGGGC | SKDPAIQAVARAQAC |
| | | | | GCGCAAGCGCTACCGCCTGCAAGAAGACCATTGGCGCGGGCGCGATGA | | AGGGGT | QVVRKRYRLQEDHW |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGAGCTCGTGCGCAGCTTCCTGAACTCCGAGCTCGCCGCCTCGCCACAC<br>GCTGAGGTCCTCCGTCGCAACGGTGACATTGCCTCGCTGTGGTCCGACG<br>TGCAGCGGTGGCTGCGCATCTACCACCTGCGGTTCGAGCACTGCGACGA<br>GACAGAGGCCCATGGCCCGCTCAGCTTCCGCGTGCCGCACCACAACAA<br>GTGGCTTACGCACAAGACTGTGCTGCGGCACGTGAAGCTACACCTGAA<br>GATCCGACACCAGACCCGATGGAAGGGCATGGTGGACCAGGGCAAGA<br>CGGTGCGCGTGCACGGTGGGGTGGGCGCCAAGTTCATGACGACCGGA<br>GCGGGCCTGTCGGACGACGACTACCGCTTCGGGGTGAAGGGCCGCCTC<br>AACCAAGTCGACACGAACTCGGTGCTCAAGCGCAAACGACTGCGGGCA<br>CACACGACCTGCAGGGACCCAACCTGCTCCTCGGCTGAGACGCTGGCAC<br>ATGTACTCAACCACTGCGAGTCCAACATGGACGCCATTCGCCAGCGTCA<br>CGACGACGCCCTGGAGCAGATTGGGTCTAAGATCCGCGGAGCGCTCGA<br>CCGCGCCAAGTCTCCCACAGAGCTGCGCCTGAACCAGACTGTACCCGAG<br>TACACAGGCGCAGCTCTACGCCCAGACATTGTGCTTAGAAACGTGGCCG<br>CCAAGACGATGGTGATCGCCGACTTGGCGGTCACGTTCGAAGACCAAG<br>CGGCTCGCGCTCGTCACTCCTCGCTGCAGCTCAGCCACGACCACAAGAC<br>TCTCAAGTACCAACCAATCGTGGCGGAGCTGCAGCACAAGGGATGGCG<br>AGTGCAGACTGCTGCCATAGTGTACGGCACGCTGGGCTCGGTGCAGCC<br>CAGCAACTTCAAGGCCTACACTGAGAAGTTCAAGCTTCACAAGCGCGAG<br>GCTAGGCAGCTGGATCTCCAGCTGTCTAGCCACTGCATTCGCGCCAGCC<br>ACCGCATCTGGGGCTGGCACTGCCGACAGCACCGCGATCGGCAACGAA<br>GCGGCACTGCCTCGCGAGCGTCGCGTGGGTCTGGGGGGGCCCCGCGGC<br>GCACATCGCAGGCACCGGCACGGCGATAAGCTGGTCATCATGACCGAC<br>AGGGCACTACCCAGGTAGGGAACCGCCCTTAAAAAACCCAGGAAGACA<br>CAAACACCCTCCACTTAGTGACATACATATTTTAGCCTAGATTTCAGTTA<br>CGGAGAGGTTACTAACTGGTAAATACGAACACATATTCTGTTCTAATCA<br>GTGTGAAAACTGGTTTTCGCCTTTTGGCGGACTTTTTCACTCGCATTTTT<br>GGGCAATCGTCTGCGGCTAGCTTGCTAGCGGCGGACGAGCGGTCTCCG<br>GGGGCGTTCACCTTTCCCCCGCGAGGCCAACTACACCGATCTTCTCTACA<br>CTTTTCTAATTCGCCTCCGTCTTCGGTCTTCGGTTGTCGGGCTTTTTTCTTT<br>TTGACCAATCAGAGCGCGCCATGCGCCTCTTCTGGCCAATCAGAGACCG<br>GGCCCTGTCCTCGGACAGCGAGGCCTCCACGGCCAGCCAATCGAGTCTC<br>GGCAGCGACGCGTCTTTCTATAGCGCAGCTGACGAGGCCGATCTGGCG<br>GCCCCCGATTGGTCCGACTTTCGGCCAATCAGCGACGACGAGGGGGCA<br>GGGGTTTACACTTTTGCCCCCGTTTCGACTTCAACTTCAGGCCAAAATGG<br>CGATTTGGACCCTCCACGCGCCGTGCCACTGCTCGGCACCGGCGGCGAT<br>TCAGCGGGTGCAACTTCGGGCACGTGTGCAACACATGCAGCGCCCATTG<br>CACGCCAAGCGGCATCGCGGGACGACGCCTCGGCCGCCCAAGCGCAGC<br>CCCGCCCTTCCAGCACGACCTCGCGCCGTTTGGCGGATCGCCATCAAGA<br>CGTGCGAGAGCCAGGCGGGGTCGGGCAAAATATACTTACTCTAAGTAT<br>GCCCGAATCCCTGCCCTCTCAGGCTGAACGCGGCCCCATACTTGATCTAA<br>GTATGGGAGGATCCCTGGCCTCTCAGGCTGTACGCGAGACCC (SEQ ID<br>NO: 1066) | | TTACACT<br>TTTGCCC<br>CCGTTTC<br>GACTTC<br>AACTTCA<br>GGCCAA<br>AATGGC<br>GATTTG<br>GACCCT<br>CCACGC<br>GCCGTG<br>CCACTG<br>CTCGGC<br>ACCGGC<br>GGCGAT<br>TCAGCG<br>GGTGCA<br>ACTTCG<br>GGCACG<br>TGTGCA<br>ACACAT<br>GCAGCG<br>CCCATTG<br>CACGCC<br>AAGCGG<br>CATCGC<br>GGGACG<br>ACGCCT<br>CGGCCG<br>CCCAAG<br>CGCAGC<br>CCCGCC<br>CTTCCAG<br>CACGAC<br>CTCGCG<br>CCGTTT<br>GGCGGA<br>TCGCCAT<br>CAAGAC<br>GTGCGA<br>GAGCCA<br>GGCGGG<br>GTCGGG<br>CAAAAT<br>ATACTTA<br>CTCTAA<br>GTATGC<br>CCGAAT<br>CCCTGCC | RGRDDELVRSFLNSE<br>LAASPHAEVLRRNGD<br>IASLWSDVQRWLRIY<br>HLRFEHCDETEAHGP<br>LSFRVPHHNKWLTH<br>KTVLRHVKLHLKIRH<br>QTRWKGMVDQGKT<br>VRVHGGVGAKFMTT<br>GAGLSDDDYRFGVK<br>GRLNQVDTNSVLKRK<br>RLRAHTTCRDPTCSS<br>AETLAHVLNHCESN<br>MDAIRQRHDDALEQ<br>IGSKIRGALDRAKSPT<br>ELRLNQTVPEYTGAA<br>LRPDIVLRNVAAKTM<br>VIADLAVTFEDQAAR<br>ARHSSLQLSHDHKTL<br>KYQPIVAELQHKGW<br>RVQTAAIVYGTLGSV<br>QPSNFKAYTEKFKLH<br>KREARQLDLQLSSHCI<br>RASHRIWGWHCRQ<br>HRDRQRSGTASRASR<br>GSGGAPRRTSQAPA<br>RR (SEQ ID NO:<br>1434) |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | CTCTCAG<br>GCTGAA<br>CGCGGC<br>CCCATAC<br>TTGATCT<br>AAGTAT<br>GGGAGG<br>ATCCCTG<br>GCCTCTC<br>AGGCTG<br>TACGCG<br>AGACCC<br>(SEQ ID<br>NO:<br>1312) | |
| NeSL | Utopia-<br>1_PMi | — | *Patiria*<br>*miniata* | CTGATGTGGATACCTTGGAATTACTCAACCGTGTCGGAGTCTTTTGTCTT<br>TTGCGCCCAACACCTCATGGATACCATGCTTGTCGCTGGAGCGACGTTA<br>CAAGCGTGAGGGCGCCCTCCATGCCGGACAGCTGGTCTGTGCCATGTG<br>CTTGAAGTCGTTCTCCTCGACTTCGGGCTTGCGGCGGCACATGGCCCGG<br>CTGCACCGGCAGCCTTCTCCCGACGCCTCCACGCCCTCGACTATGACGG<br>AAGTGTTCCCGTACCCCCTTCCGAAGGTGTGGCCGTGCGTGGTGTGCCG<br>CGAGAACTTCTATCACAATCAAACCTTGAAGCGTCACCAGAAGAATTTTC<br>ACCCCAATGTTGACCTCACCACCGTCTACCAGTGCTCAGTGTGCGGGCA<br>GGAGTTTGTCACCGGCAGGAAAGCATCCTTCCATTTCAAAGTTCATCGG<br>CGGATGTCAGCCAGCGCCATCCCTACCCCGTCTGCAATGCCCTCCTCACC<br>GATGGATTTGATCCGAGGCCTCGTCGGGGAACCCCTGCCTCCTAGCCCT<br>GCCCGTACACCGCCACCACTTGCCCGATACATCTCCCCAGCGCCCCGGTC<br>TTCTTTTTCACCACCCTGGAATCCCTCCCCACCGCCCCGGTCGCCCACCCC<br>ACTGCCACGGCCACTCACTCCACCGCCACGATCACCGAGCCCGCCGCCC<br>CGGTCGCCAACACCACCTCCCCCGGTCACCCTCACCACCGCCCCGGTCAC<br>CGAGCCCGCCGTCCCGGTCGCCCTCACCACCGCCCAGGTCACCGAGCCC<br>TCCGCCCCGGCCGTCCACACCGCCGCCCCGGTCACCCTCTCCAACGCCCC<br>GGTCACCGAGCCCGCCACCCCGGCCACCGATCCTGCCACCCCGGTCACC<br>AGACTCCACTCACCGGTCACTCACATCTCATGCTCGATCTCCTTCACGGC<br>CAGCCACGCCCCCTATTCCTGTGCAGCCCCGACATCTCCGTCCGTCTACG<br>CCTGCTCACCCAGGCGTAGACAATGCAGTTCCACCATCGCAGCAGTCTG<br>CAATTGACGTGTGGCTGGCCGAGCTGTCACGCTCGGCTGACTTCGAGTC<br>TTTTGAGGATGTGTGTGATCGGTTTGTGGAGTTTGCCGCCGCTGAGGGT<br>CGAAACAACGGACGCCCAGCCCGCCCAGCGCACCAACCGCCCCGTGAC<br>CGCGGGAACCAGGGACCTCGCCCCCAACGTCCCCCTCGTCCCCACCGCC<br>CCGGGCTTGGCCCGGAGTTTGATGCACAGGAGGCCAGTCGTCTGCAAA<br>AGCTGTATCGGACCAGCAAGAAGCGCGCCATCAGGACTATCTTGACCG<br>GCTCTGATGTCCGATACAGCGGCTACCGAGGTCCTCACTAGTGGATTTC<br>TTTCACTTGAAGTATTTTCCGCTCGTGAGGTCGACACCGACACCATTGCC<br>ACGGATACCAGCCTCCTGTTTCCGAACTCCGCCCAAGCCCGTGAGTCCG<br>GCCAAGACCTGCTTCGCCCAGTCACCCAGCGTGAAGTCTCCCTCCGTCTT<br>GGCCGGATGTCCAACTCCGCACCAGGGAAGGACCGGTTGGAGTACCGT<br>CACATCCGCCAGGTTGATGGCGCATTCCGCGTCACCCTGGAAATCTTCA | CTGATGTG<br>GATACCTT<br>GGAATTAC<br>TCAACCGT<br>GTCGGAGT<br>CTTTTGTCT<br>TTTGCGCC<br>CAACACCT<br>CATGGATA<br>CCATGCTT<br>GTCGCTGG<br>AGCGACGT<br>TACAAGCG<br>TGAGGGC<br>GCCCTCCA<br>TGCCGGAC<br>AGCTGGTC<br>TGTGCC<br>(SEQ ID<br>NO: 1190) | GATTAG<br>CGAACA<br>CTAATAT<br>CCTGCC<br>MTAGAC<br>GTGATT<br>GCTAAT<br>CCGCAA<br>ACCAAC<br>CGGATC<br>TACAGC<br>CTGAAC<br>ACTGAA<br>CTTTAAT<br>CTTCACC<br>CATGTC<br>ACATCT<br>GGACAC<br>TAGGTTT<br>TTGCTCT<br>GTTTGT<br>GTTTTCC<br>TGCCTTT<br>WCMTT<br>GGAWCT<br>TTCGCM<br>CTGGAA<br>TTTATTT<br>GTCGCT<br>TGGATT<br>ATTTTTT<br>TTCTCAC<br>AATTTG | MCLKSFSSTSGLRRH<br>MARLHRQPSPDAST<br>PSTMTEVFPYPLPKV<br>WPCVVCRENFYHNQ<br>TLKRHQKNFHPNVDL<br>TTVYQCSVCGQEFVT<br>GRKASFHFKVHRRM<br>SASAIPTPSAMPSSP<br>MDLIRGLVGEPLPPS<br>PARTPPPLARYISPAP<br>RSSFSPPWNPSPPPR<br>SPTPLPRPLTPPPRSP<br>SPPPRSPTPPPPVTLT<br>TAPVTEPAVPVALTT<br>AQVTEPSAPAVHTAA<br>PVTLSNAPVTEPATP<br>ATDPATPVTRLHSPV<br>THISCSISFTASHAPYS<br>CAAPTSPSVYACSPR<br>RRQCSSTIAAVCNSE<br>ASSGNPCLLALPVHR<br>HHLPDTSPQRPGLLF<br>HHPGIPPHRPGRPPH<br>CHGHSLHRHDHRAR<br>RPGRQHHLPRSPSPP<br>PRSPSPPSRSPSPPPR<br>SPSPPPRPSTPPPRSP<br>SPTPRSPSPPPRPPILP<br>PRSPDSTHRSLTSHA<br>RSPSRPATPPIPVQPR<br>HLRPSTPAHPGVDN<br>AVPPSQQSAIDVWL<br>AELSRSADFESFEDVC |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACCGGTGCCTGCGTGAAAGCCGGGTCCCATCCTCCTGGAAGACAGCGA | | GATCTAT | DRFVEFAAAEGRNN |
| | | | | CCACCGTGCTGATCCACAAGAAGGGGGATGCCACCGACCCGGCCAACT | | TTTCGTT | GRPARPAHQPPRDR |
| | | | | TCCGCCCCATCGCCCTCCAGTCCTGCCTCTACAAGCTGTTGATGGCGATC | | TGTTCAC | GNQGPRPQRPPRPH |
| | | | | TTGTCCGACCGTGTCACCACATGGGCCCTGGACAACGATCTCATCAGCA | | TTCGAA | RPGLGPEFDAQEASR |
| | | | | GCTCGCAGAAGAGCGCCCGCCCCGGTGAAGGTTGCTACGAACACACAT | | CTCTAGC | LQKLYRTSKKRAIRTIL |
| | | | | TTCTTCTCTCCACCGTCGTGAAGGATGCCCGGCGTAACCAGAAAAACAT | | TGCCCTT | TGSDVRYSGYRGPHP |
| | | | | GTACGCCGCCTGGCTGGATTTACAAAATGCATTCGGCAGCATCCCCCAC | | TCTTCG | ALMSDTAATEVLTSG |
| | | | | GACGCAATGTTCACCGTGTTAACCTCCATCGGGGCCCCGGAGGGCCTGG | | GACACT | FLSLEVFSAREVDTDT |
| | | | | TCTCCCTGGTGCGCGATGTGTACACTGACGCCTCCACCGACTTCGTCACA | | GAACTTT | IATDTSLLFPNSAQAR |
| | | | | CCCACCGGCCGCACTGCTGCAGTCCCGATTCACTCAGGCGTGAAGCAGG | | AATCTTC | ESGQDLLRPVTQREV |
| | | | | GCTGCCCGATCTCTCCAGTGCTTTTCAACCTGACGCTGGAACTTATTATC | | GCCATG | SLRLGRMSNSAPGK |
| | | | | CGAGCAGTGAATGCTTCAGCGACTCGGGACCGCAGTGCGCCGGTGGTC | | GCTGTC | DRLEYRHIRQVDGAF |
| | | | | CATGGCCAGGCCGTCCCCATACTTGCGTATGCTGACGACCTGGTCATAC | | AGTCGC | RVTLEIFNRCLRESRV |
| | | | | TCAGCCGATCCAGTGACGGCCTGCAGAGCCTCCTGACAACAGCATCCAT | | CGGTTC | PSSWKTATTVLIHKK |
| | | | | CATGGCCACCAAGATCCAGCTGAAGTTCAAGCCCGCCAAGTGCGCTTCC | | ACTTGCT | GDATDPANFRPIALQ |
| | | | | CTCTCCCTCGAGTGCCGACGGGGGACCAAGGTACGCCCTCTTGAGTTCA | | GCGGTG | SCLYKLLMAILSDRVT |
| | | | | ACGTGCAGGACAAGATCATCCCCGCCCTTACAGAGGAGCAGCACTACCG | | GGATCC | TWALDNDLISSSQKS |
| | | | | GTACCTTGGTGTCCCCATCGGCCTCTACCGCACCGACGACAGCCTGGAG | | TGTTGT | ARPGEGCYEHTFLLST |
| | | | | ACCTTGGTGGCCAAGATGACTGATGACATCCAGCGGATTGACTCCTCAC | | GATAAT | VVKDARRNQKNMY |
| | | | | TCCTCGCTCCCTGGCAGAAACTGGATGCCATCCGGACCTTCGTACAGCC | | CCCCGT | AAWLDLQNAFGSIP |
| | | | | CTGCCTAGCCTACACCCTGCGGGCAGGGGACTGTGCGAAGAAACACCT | | GCATTG | HDAMFTVLTSIGAPE |
| | | | | CAAGAGACTGCGGGGACAGCTGGTGAAGACAGCCCGCAAAGTATGCAA | | CCCATG | GLVSLVRDVYTDAST |
| | | | | CCTGCCGACTCGGGCCACCACAAACTACATCTTTGCTGATCGTAGGGCG | | GATTTAT | DFVTPTGRTAAVPIH |
| | | | | GGTGGCTTGGGTTTCATCGACCCAAACGTCGATGCCGATATTCAAATCA | | TTCCGCC | SGVKQGCPISPVLFNL |
| | | | | TCACGCAGGCCGTACGCATGCTGTCTTCACCCGACGACATCACCAGAGC | | TTAGTTG | TLELIIRAVNASATRD |
| | | | | CATCGCCACCGGCCAGCTGTCTTCCGTGGTCCACCGCACCATCCACCGA | | TTCCTAA | RSAPVVHGQAVPILA |
| | | | | GCACCGACACAGGAGGAGACGGACGAGTTCTTGTCAGCATCAATGGAG | | CCTTGG | YADDLVILSRSSDGLQ |
| | | | | GGGGACTTTGCCAACAGTGGGAACAGCGGCCAGGCCTCTTCATTGTGG | | ATTTATT | SLLTTASIMATKIQLK |
| | | | | TCCAGAGCACGTGCGGCGGCCCGGCGACTGAAAGTTACCATCAGCGGC | | GCTGTG | FKPAKCASLSLECRRG |
| | | | | AGCCTTTCCGGCTCAGTGATCACCAAGTCAACAGAGAACCGGGAAATG | | GGTGAT | TKVRPLEFNVQDKIIP |
| | | | | GCTGCCAAGTCCATCACTACCGCCCTGCGTGCTCAGTCCCGCGCCCACTA | | GCCCGG | ALTEEQHYRYLGVPIG |
| | | | | CACCCACCGGCTGCTGTCCCTGCCCGACCAGGGGAAAGTTGGCCAGTCC | | GTTTTGT | LYRTDDSLETLVAKM |
| | | | | CTCAACCAAGACCAATACATGAACTCGTCCTCGTGGATGTCCTCCGGTA | | TTACATC | TDDIQRIDSSLLAPW |
| | | | | GCTACATCCTGTTCTGTGACTGGAGATTCATCCATCGGGCCCGTCTCAAC | | GGGATC | QKLDAIRTFVQPCLA |
| | | | | ACCCTTCCGACCAACGCAACGGCGCAGCGATGGAAACCCAACACCAGTC | | CCGCTG | YTLRAGDCAKKHLKR |
| | | | | CCGCCTGTCGCCGTTGCCAGCACCCGCAAGAGACCCTGCCCCACATCCT | | CGGCTC | LRGQLVKTARKVCNL |
| | | | | CAACCACTGCCCGCCCAACATGGTACCCATCCGCCGCAGACACAACCTC | | GGTGTT | PTRATTNYIFADRRA |
| | | | | GTCCAGCAACGCATCGTGTCTGCGGTACGCCACGGGGGGTGTTCGTC | | CCATGC | GGLGFIDPNVDADIQ |
| | | | | GACCAGCACGTCCCTGAGGATCCCAACCCCCGGGAGCGCCCGGACATC | | GACTGG | IITQAVRMLSSPDDIT |
| | | | | ACGGTCGTTGAGGGCGACAAAGTCACCATCATCGATGTATGTTGCCCCT | | CAGCCC | RAIATGQLSSVVHRTI |
| | | | | TCGACAACGGCCGTGATGCCCTGATGACCGCCGCAGCCGCCAAGGAGA | | CTTTGTT | HRAPTQEETDEFLSA |
| | | | | CCAAGTATGCCGACCTGAAGCAGGCGCTGGTGGCTGCGGGGAAAGAC | | TACTCTS | SMEGDFANSGNSGQ |
| | | | | GTCGAGGTGTTCGGATTCGCCGTTGGATCGCTAGGCTCCTGGTTACCTA | | GACTCT | ASSLWSRARAAARRL |
| | | | | GCAACGAGCGGGCACTTCGACGTCTCGGCATCGCCAAGCGCTTCCGGA | | ATTCATT | KVTISGSLSGSVITKST |
| | | | | CTCTGATGCGCAAACTCCTGCGCATCGACGCCATCAAGGGATCCCGGGA | | GTTGTAT | ENREMAAKSITTALR |
| | | | | CGTGTACATCGAGCACATGTGTGGCCATCGCCAATACACCGATTAGCGA | | TTCTTCC | AQSRAHYTHRLLSLP |
| | | | | ACACTAATATCCTGCCMTAGACGTGATTGCTAATCCGCAAACCAACCGG | | ACACTG | DQGKVGQSLNQDQY |
| | | | | ATCTACAGCCTGAACACTGAACTTTAATCTTCACCCATGTCACATCTGGA | | GCCAGT | MNSSSWMSSGSYILF |
| | | | | CACTAGGTTTTTGCTCTGTTTGTGTTTTCCTGCCTTTWCMTTGGAWCTTT | | GATCAC | CDWRFIHRARLNTLP |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGCMCTGGAATTTATTTGTCGCTTGGATTATTTTTTTTCTCACAATTTGG<br>ATCTATTTTCGTTTGTTCACTTCGAACTCTAGCTGCCCTTTCTTCGGACAC<br>TGAACTTTAATCTTCGCCATGGCTGTCAGTCGCCGGTTCACTTGCTGCGG<br>TGGGATCCTGTTGTGATAATCCCCGTGCATTGCCCATGGATTTATTTCCG<br>CCTTAGTTGTTCCTAACCTTGGATTTATTGCTGTGGGTGATGCCCGGGTT<br>TTGTTTACATCGGGATCCCGCTGCGGCTCGGTGTTCCATGCGACTGGCA<br>GCCCCTTTGTTTACTCTSGACTCTATTCATTGTTGTATTTCTTCCACACTGG<br>CCAGTGATCACACTGCTGTGTTTCCCGGGAAGATATCCTCTGCGGTTTTC<br>ACGCTCTGGGTGTCTCCCCGGGCAACGCACTGGTTGCTTGCTGCGCCAT<br>CACCCTTTTCGTTTATATTCATTTTCAGTCTGCCGTTATCTTGGCCAGCGC<br>TCATTCTTTTGTGATGGCCGTGGACTGACCCTCTGCGGTTTTCTGCGGTC<br>ASCACTCTCGGTGAATGCTGTGCCACCATTTTTCATTTGTTTACTTTTTCA<br>GCTACAATTATCCTGGCCAGCTTTCACTCTTTTGTGATGGCCGTGGACGG<br>ACCCTCTGCTGGTTTTCACGCTCCGGGTTTGTCTGCGGTCAGCACCCTTG<br>GTGAGTGCTGGTCGTTTGTTTGCTCATTTTGCTTAGTTCACCATTATCTTT<br>MTTCTCTTTTGTWTGGTTTTCCTAGCGGTTGTCTGGGAGTTGAGCTGCA<br>GTTGTCTGGTCTTGGTTTTACCCCCATTTGTTTTCTTTTAACGCGGGGCGT<br>ATTGCCTTGACCGGCCGTCTCAGCTTTTCTCCTAGAGCAACCTTCCGTTC<br>ATCCAACTTTTAGTTTTCTCAGTTCTTGGCCATTCCGGTTGGTTAATTTTT<br>ATTTATACTTAATTTTATGTTTACATTTTCTGGTTGGAGACCATTTTAGCT<br>TGTTTTAATAGCTTTTCTTCTTTAATTAATACCCTCTGCCATTGAGGGTTT<br>TTATTACTATTAATTTTGTTTACTCTTTGTAACTTGTTTGATTGAATATTTT<br>AATAAACCAC (SEQ ID NO: 1067) | | ACTGCT<br>GTGTTTC<br>CCGGGA<br>AGATAT<br>CCTCTGC<br>GGTTTTC<br>ACGCTCT<br>GGGTGT<br>CTCCCCG<br>GGCAAC<br>GCACTG<br>GTTGCTT<br>GCTGCG<br>CCATCAC<br>CCTTTTC<br>GTTTATA<br>TTCATTT<br>TCAGTCT<br>GCCGTT<br>ATCTTG<br>GCCAGC<br>GCTCATT<br>CTTTTGT<br>GATGGC<br>CGTGGA<br>CTGACC<br>CTCTGC<br>GGTTTTC<br>TGCGGT<br>CASCACT<br>CTCGGT<br>GAATGC<br>TGTGCC<br>ACCATTT<br>TTCATTT<br>GTTTACT<br>TTTTCAG<br>CTACAAT<br>TATCCTG<br>GCCAGC<br>TTTCACT<br>CTTTTGT<br>GATGGC<br>CGTGGA<br>CGGACC<br>CTCTGCT<br>GGTTTTC<br>ACGCTC<br>CGGGTT | TNATAQRWKPNTSP<br>ACRRCQHPQETLPHI<br>LNHCPPNMVPIRRR<br>HNLVQQRIVSAVRH<br>GRVFVDQHVPEDPN<br>PRERPDITVVEGDKV<br>TIIDVCCPFDNGRDAL<br>MTAAAAKETKYADLK<br>QALVAAGKDVEVFG<br>FAVGSLGSWLPSNER<br>ALRRLGIAKRFRTLM<br>RKLLRIDAIKGSRDVYI<br>EHMCGHRQYT (SEQ<br>ID NO: 1435) |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | TGTCTG<br>CGGTCA<br>GCACCC<br>TTGGTG<br>AGTGCT<br>GGTCGT<br>TTGTTTG<br>CTCATTT<br>TGCTTA<br>GTTCACC<br>ATTATCT<br>TTMTTC<br>TCTTTTG<br>TWTGGT<br>TTTCCTA<br>GCGGTT<br>GTCTGG<br>GAGTTG<br>AGCTGC<br>AGTTGT<br>CTGGTC<br>TTGGTTT<br>TACCCCC<br>ATTTGTT<br>TTCTTTT<br>AACGCG<br>GGGCGT<br>ATTGCCT<br>TGACCG<br>GCCGTC<br>TCAGCTT<br>TTCTCCT<br>AGAGCA<br>ACCTTCC<br>GTTCATC<br>CAACTTT<br>TAGTTTT<br>CTCAGTT<br>CTTGGC<br>CATTCCG<br>GTTGGT<br>TAATTTT<br>TATTTAT<br>ACTTAAT<br>TTTATGT<br>TTACATT<br>TTCTGGT<br>TGGAGA<br>CCATTTT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | AGCTTG | |
| | | | | | | TTTTAAT | |
| | | | | | | AGCTTTT | |
| | | | | | | CTTCTTT | |
| | | | | | | AATTAAT | |
| | | | | | | ACCCTCT | |
| | | | | | | GCCATT | |
| | | | | | | GAGGGT | |
| | | | | | | TTTTATT | |
| | | | | | | ACTATTA | |
| | | | | | | ATTTTGT | |
| | | | | | | TTACTCT | |
| | | | | | | TTGTAAC | |
| | | | | | | TTGTTTG | |
| | | | | | | ATTGAA | |
| | | | | | | TATTTTA | |
| | | | | | | ATAAAC | |
| | | | | | | CAC | |
| | | | | | | (SEQ ID | |
| | | | | | | NO: | |
| | | | | | | 1313) | |
| NeSL | Utopia- | — | *Phytophthora* | AGACGAGCAACGCGCTGGGGCCCAAGACCTGGCACGAACGACACTGCC | AGACGAG | TGAAGC | MDVDGGPAMPEPW |
| | 1_PS | | *sojae* | CAGGCTGTGAACGACGAGCACGCTGCTAACCCGGCAGCGCACCGGCCT | CAACGCGC | TGCACA | VLRFDGACRRNPGP |
| | | | | CTGGGCTCCGCTGCACCGGTTACCGGTGCAACACGGTGGGGTCCACGTC | TGGGGCCC | AGCGCG | GGAGAALFKPCGTV |
| | | | | ACGGCGCGATCGGGGCAGCGGCTGTAGCTCGCCTGCTCACAGGCCTAC | AAGACCTG | AGGCTC | AWTCSHYMPNSSET |
| | | | | CCACGGCACCAGCACCAGCTACGCGCCGGCCTGCTTCGGCTCGGCGCTG | GCACGAAC | GACAGC | NNTAEYTALLLGVQS |
| | | | | CCCAGACCCGCCCGCTCCCCCCGCGGCCACGACGACAGCCCCCGATGCG | GACACTGC | TGGACC | AVHHGASHLEIEGDS |
| | | | | ATGGACGTCGACGGAGGGCCGGCTATGCCCGAGCCGTGGGTGCTCCGC | CCAGGCTG | TTCAGCT | HLVVAQVKGTFACR |
| | | | | TTCGACGGCGCCTGCCGCCGGAACCCGGGACCTGGTGGAGCTGGTGCC | TGAACGAC | GTCGAG | NPRLRQLRNRVRHAL |
| | | | | GCCTTGTTCAAGCCGTGCGGGACCGTGGCGTGGACGTGCTCGCACTACA | GAGCACGC | CCACTG | RAVTSLTLKHIDRKAN |
| | | | | TGCCAAACAGCAGCGAGACCAACAACACCGCTGAATACACGGCGCTGC | TGCTAACC | CATCCG | AHADRLANRALDLKR |
| | | | | TGCTTGGCGTGCAGAGTGCCGTCCACCACGGCGCCTCGCACCTGGAGAT | CGGCAGC | CGCCAG | SLAECGEHQGAMES |
| | | | | CGAAGGTGACAGCCACCTCGTCGTAGCGCAGGTCAAGGGCACCTTCGC | GCACCGGC | CCACCG | CLHMNPAAQRQRE |
| | | | | CTGCAGGAACCCGCGCCTCCGCCAGCTGCGCAACCGCGTCCGCCACGCC | CTCTGGGC | CACCTG | QPAPPARPACAPTRA |
| | | | | CTCCGCGCCGTGACGTCCTTAACGCTCAAGCACATCGACCGGAAGGCGA | TCCGCTGC | GGGCTG | ESASDHDEDIDAEIAA |
| | | | | ACGCGCACGCGGACAGACTGGCAAACCGGGCGCTGGACCTGAAGCGTT | ACCGGTTA | GTACTG | RDGGEAFPTLPIGPG |
| | | | | CGCTGGCTGAGTGCGGCGAGCACCAAGGGGCGATGGAGAGCTGCCTCC | CCGGTGCA | CCGGCG | TAPARQPRLRLRQLT |
| | | | | ACATGAATCCTGCTGCACAACGCCAGCGCGAGCAACCCGCACCTCCTGC | ACACGGTG | CCACCG | EDEQEAAASALQAM |
| | | | | CCGCCCCGCGTGCGCACCCACGCGCGCCGAGTCTGCCAGCGATCATGAC | GGGTCCAC | CGAAGG | AEELACKIEDADSWT |
| | | | | GAGGACATCGACGCAGAGATTGCCGCGCGCGACGGCGGCGAGGCGTT | GTCACGGC | ACAACG | SGDGYISAIPSRIRQLL |
| | | | | CCCCACGCTGCCTATCGGGCCCGGGACGGCTCCAGCGCGGCAGCCGCG | GCGATCGG | GAGCGG | QPFTAAQPHPRPPLQ |
| | | | | CCTTCGACTGCGGCAGCTGACCGAAGACGAGCAGGAAGCGGCGGCGTC | GGCAGCG | CAACGC | QQRQRPPRVTRTQR |
| | | | | GGCCCTGCAGGCCATGGCGGAGGAGCTAGCGTGCAAGATCGAAGACG | GCTGTAGC | CTCGCG | EHRLDEALDEMAAV |
| | | | | CAGACAGCTGGACCTCGGGCGATGGATACATCAGCGCCATCCCCAGTC | TCGCCTGC | AGCGCC | QQERPTSRSAVRRAR |
| | | | | GCATCCGGCAGTTGCTGCAGCCCTTCACAGCAGCCCAGCCCCACCCTCG | TCACAGGC | GCGTGG | RRVGRIRASMRQQQ |
| | | | | GCCTCCACTGCAACAGCAGCGACAGCGACCGCCCCGGGTGACGCGCAC | CTACCCAC | GTCTGG | LRHDFARNESKCVED |
| | | | | TCAGCGCGAGCATCGACTCGACGAGGCCCTCGACGAGATGGCGGCGGT | GGCACCAG | GGGGGG | ILRAASAETAAEEHPE |
| | | | | GCAGCAGGAGCGACCCACCAGCAGATCGGCCGTCCGCCGTGCGCGGCG | CACCAGCT | CCCGCG | TCPIDSGTLHEHFTAV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCGCGTCGGCCGGATCCGCGCCTCGATGCGCCAACAGCAGCTCCGCCAC | ACGCGCCG | GCGCAC | NSPRINFLPDEACGA |
| | | | | GACTTCGCTCGCAACGAGAGCAAGTGCGTCGAGGACATTCTGCGTGCT | GCCTGCTT | ATCGCA | LFREAMADVGTPQE |
| | | | | GCGTCGGCGGAGACCGCAGCGGAGGAGCACCCGGAGACGTGCCCCAT | CGGCTCGG | GGCTCG | RRSALTDELTMDEVE |
| | | | | CGACTCGGGCACGCTCCACGAGCACTTCACGGCGGTGAACTCGCCCCGC | CGCTGCCC | GGCACG | DQLMQAATNSSPGH |
| | | | | ATCAACTTCCTACCAGATGAAGCTTGCGGGGCGTTGTTCCGCGAGGCGA | AGACCCGC | GCGGTA | DGVGYDIYKKFAAQL |
| | | | | TGGCCGACGTCGGGACACCGCAGGAGCGGCGGAGCGCGCTCACGGAC | CCGCTCCC | AGCTGG | VPLLHAAFQSCWRH |
| | | | | GAGCTGACGATGGACGAGGTGGAGGACCAGCTCATGCAAGCGGCCAC | CCCGCGGC | TCATTTG | HRVPALWKVGFVRLI |
| | | | | GAACTCCAGCCCCGGCCACGACGGCGTGGGCTACGACATCTACAAGAA | CACGACGA | ACCAAC | HKKGDPNDPANWR |
| | | | | GTTCGCGGCGCAGCTGGTCCCCCTCCTCCACGCAGCCTTCCAGTCCTGTT | CAGCCCCC | AGGGCA | PICLQTAIYKLYSGLLA |
| | | | | GGCGCCACCACCGGGTGCCTGCCCTGTGGAAGGTGGGGTTCGTCCGCC | GATGCG | CTACCCA | RRLSAYLEANGLLLM |
| | | | | TCATCCACAAGAAGGGCGACCCCAACGACCCAGCGAACTGGCGGCCGA | (SEQ ID | GGTAGG | AQKGFRAYNGCHEH |
| | | | | TCTGCCTGCAGACCGCGATCTACAAGCTCTACAGCGGTCTGCTGGCGCG | NO: 1191) | GAACCG | NFVATTLLDQTRRM |
| | | | | TCGGCTGTCGGCGTACCTGGAGGCGAACGGGCTGCTGCTCATGGCGCA | | CCCTTCA | RRRLYQVWYDLRNA |
| | | | | GAAGGGGTTCAGGGCGTACAATGGTTGCCACGAGCACAACTTCGTGGC | | AAAACC | FGSVHQDMLWYVLR |
| | | | | AACCACGCTCCTGGACCAAACCCGACGCATGCGCCGCAGGCTGTACCAG | | CAGGAA | LLGVERAFVERCDDIY |
| | | | | GTCTGGTACGACCTGCGGAACGCGTTCGGGTCCGTTCACCAGGACATGC | | GACACA | EDSYFVVGNAADGA |
| | | | | TGTGGTATGTGCTCCGCCTGCTCGGCGTCGAGCGTGCGTTCGTCGAGCG | | AACACC | TEPVRQEVGVYQGC |
| | | | | CTGCGACGACATCTACGAGGACTCCTACTTCGTCGTCGGCAACGCGGCC | | CTCCCTT | PLSPLLFIAALVPLLRA |
| | | | | GACGGAGCGACGGAACCAGTGCGGCAGGAGGTGGGCGTGTACCAAGG | | TAGTGA | LEKLDGVGVALADGV |
| | | | | CTGTCCGCTCAGCCCCCTCCTGTTCATCGCCGCGCTGGTGCCGTTGCTCC | | CATGCA | RPCTTAYADDLKVFS |
| | | | | GAGCATTGGAGAAGCTCGACGGAGTGGGCGTCGCGTTGGCGGACGGG | | TATTTTA | DSAAGITRCHAVVEK |
| | | | | GTGCGGCCATGCACCACCGCCTACGCCGACGACCTCAAGGTGTTCAGCG | | GCCTAC | FLEWTVLQANPGKC |
| | | | | ACAGCGCGGCCGGCATCACGCGCTGCCACGCTGTCGTTGAGAAGTTCCT | | ATTTCAG | AFLAVTRNARGNPA |
| | | | | GGAGTGGACGGTGCTGCAGGCCAATCCAGGCAAGTGCGCCTTCCTGGC | | TTACGG | HDKDMKLSLHDEEVS |
| | | | | CGTGACACGCAACGCGCGCGGCAACCCCGCCCACGACAAGGACATGAA | | AGAGGT | SIKLHDSYRYLGVGD |
| | | | | GCTGTCGCTCCACGACGAGGAGGTCTCAAGCATCAAGCTGCACGACAG | | TACTAAC | GFDHVRHRLQLEPKL |
| | | | | CTACCGCTACCTCGGCGTGGGCGACGGCTTCGATCACGTGCGCCACCGT | | TGGTAA | QQIKREAVALMQSG |
| | | | | CTCCAGCTAGAGCCCAAGCTACAGCAGATCAAGCGGGAGGCGGTGGCG | | ACACGA | LAPWQVVKALKTYVY |
| | | | | CTGATGCAGTCGGGGTTGGCGCCGTGGCAGGTGGTGAAGGCGCTCAAG | | ACACAC | PKVEYALRHLRPLQS |
| | | | | ACCTACGTCTACCCCAAGGTCGAGTACGCGCTCCGCCACCTCCGACCGC | | AT (SEQ | QLQGFDRVVAKGLR |
| | | | | TCCAGTCCCAACTGCAGGGCTTCGACCGTGTGGTAGCCAAGGGCCTGCG | | ID NO: | HLLRLPRSATNEVLYA |
| | | | | GCACCTGCTACGCCTGCCCCGCTCGGCAACCAACGAGGTGCTCTACGCA | | 1314) | PTSSGGLGLQPLVEM |
| | | | | CCAACGTCGAGCGGGGGCTTGGGGCTCCAGCCGCTGGTGGAAATGCAC | | | HRALQIAHAWQML |
| | | | | CGCGCGCTGCAGATCGCCCATGCGTGGCAGATGCTGCACTCGAAGGAC | | | HSKDPAIREVARAQV |
| | | | | CCAGCGATCCGGGAAGTGGCGCGCGCACAGGTGTGGCAGGTGGCCCG | | | WQVARKRHRLREEH |
| | | | | CAAGCGTCACCGCCTCCGCGAAGAACACTGGCGGGAGCGTGACGACGA | | | WRERDDELVRCFLNS |
| | | | | GCTCGTGCGGTGCTTCCTCAACTCCGAGCTCGCCGCCTCGCCCCACGCG | | | ELAASPHAEALRRHG |
| | | | | GAGGCGCTGCGCCGCCACGGCGACATCGGGTCACTGTGGTCCGACGTA | | | DIGSLWSDVQRWLRI |
| | | | | CAGCGGTGGCTGCGCATCTACCACCTCAGCCTGGTGGTGCAGGACGAC | | | YHLSLVVQDDRNGL |
| | | | | CGCAACGGCCTGGACCCGCTCGGCCTCCGCGTGCCGCACCACGCCAAGT | | | DPLGLRVPHHAKWL |
| | | | | GGCTCGACCACAAGAGCGTGCTGCGGCACGTCAAGTTGCACCTCAAGA | | | DHKSVLRHVKLHLKIR |
| | | | | TCCGCCACCAGACCCGATGGAAGGGTCTGGCGGACCAGGGCAAGACG | | | HQTRWKGLADQGKT |
| | | | | GTGCGGGCCCACGGCGGTGTCGGTGCCAAGTTCATGTCGACATGGGCG | | | VRAHGGVGAKFMST |
| | | | | GGCCTGTCGGACGACGACTACCGCTTCGGCGTGAAGGCCCGCCTCAACC | | | WAGLSDDDYRFGVK |
| | | | | AGATCGACACGAACGCCGTGCTCAAGCGCAAGCGGCTGCGGTCGCACA | | | ARLNQIDTNAVLKRK |
| | | | | AGACCTGCAGGGACCCGACCTGCTCCTCGGCCGAGACGCTGGCCCATGT | | | RLRSHKTCRDPTCSS |
| | | | | CCTCAACCATTGCGAGTCCAACATGGACGCAATCCGCCAGCGTCATGAC | | | AETLAHVLNHCESN |
| | | | | GACGCCTTGGAGCAGATCGGGTCCAAGATCCGCAACGCGCTCAAGCGC | | | MDAIRQRHDDALEQ |
| | | | | GGCAAGTCGACCGCGGAGCTGCGCCTGAACCAGACGGTACCCGAGTAC | | | IGSKIRNALKRGKSTA |

TABLE 3-continued

| 1. Fam- ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACGGGCGCAGCTCTGCGGCCAGACATCGTACTGCGGATCGTGGCCGCC<br>AAGAAGATGGTGATCGCCGACTTGGCGGTCACGTTCGAAGAGCACGCG<br>GCCGGCGCCCGCCACTCCTCGCTGCAGCTCAGCCACGACCACAAGACAC<br>TCAAGTACCAACCGATCGTGGCGGAGCTGCAGCTCAAGGGGTGGCAGG<br>TGCAGACCGCGGCGATCGTGTACGGGTCGCTGGGCTCGGTGCAGCCCA<br>GCAACTCAACACCTACACGGAAAAGTTGAAGCTGCACAAGCGCGAGGC<br>TCGACAGCTGGACCTTCAGCTGTCGAGCCACTGCATCCGCGCCAGCCAC<br>CGCACCTGGGGCTGGTACTGCCGGCGCCACCGCGAAGGACAACGGAGC<br>GGCAACGCCTCGCGAGCGCCGCGTGGGTCTGGGGGGGGCCCGCGGCG<br>CACATCGCAGGCTCGGGCACGGCGGTAAGCTGGTCATTTGACCAACAG<br>GGCACTACCCAGGTAGGGAACCGCCCTTCAAAAACCCAGGAAGACACA<br>AACACCCTCCCTTTAGTGACATGCATATTTTAGCCTACATTTCAGTTACG<br>GAGAGGTTACTAACTGGTAAACACGAACACACAT (SEQ ID NO: 1068) | | | ELRLNQTVPEYTGAA<br>LRPDIVLRIVAAKKM<br>VIADLAVTFEEHAAG<br>ARHSSLQLSHDHKTL<br>KYQPIVAELQLKGW<br>QVQTAAIVYGSLGSV<br>QPSNSTPTRKS (SEQ<br>ID NO: 1436) |
| NeSL | Utopia-<br>1_PU | ADOS01001321 | *Pythium*<br>*ultimum* | GCGGTGTACGCGCACAACGCCGCGCTCTTCGAGTGCACGTTGTGCGCGC<br>ACACCGCGCGGGATCTCGCCGCGCTCCAGCAGCATCGGCGCTCCGCGC<br>ACCGCAGCGTCCGCTTTGTGGATCACTTCCACAGCGGATGCGCGTGCGG<br>CGTGAGCTTCCACTCGCGTGCGGCGGCAACCAAGCACGCGCGCGAATG<br>TCCAGAGAGCGCGTTCTCGGTCGCCGCCGCCGCGCGCACTGCAGCGGC<br>CAACACCGCAGGTATGTCTCTCGGCGCCGACGAACGCGACCACCTCGCG<br>TCCGTCGGCGCCTTGCATGATGTTGCATCCCCCGCTTTTGGCAACATTTT<br>GCCGGTTGCGTTTGCGACCGCGGCAGACGCATCAAGCGCCACCGTGAT<br>CGCAGACGCAGCCATGCAGCACAGTGCTGTGCCCTCTGCTGCCGCCCAA<br>TCCCCTCGGCGTGCGCACGTCCCCCCCGTGCCGCGCGCCACCACGACAC<br>CATCCGCGCTGCGGATTGGTGGCAAACGCCGCCGCCTGAACGACGACG<br>GCGACAACGAAAACAGCGACGGCCGCGACGCCGACATCGAGATGCGC<br>GCCGACGACACCGACGCACCAGCGCCGACCAACCCCGCGACCAGTGCG<br>GCTGCAACGCCCGCGCGCACAGCACCAGCACCAACGGATGCCGCGACC<br>GCGCGCCGCCGCCACACGCGATGGGGACCCAGAGTGCTCGTGAACGTG<br>GCGCGCCTTCCGCGCCGCACTCACACACGCTGGGGCCCCGCACTCCGCC<br>GCGACCACCAGCATGCAGCAAACATGGAGAACTCGAATCAGCTGCTGG<br>TGGCCGCGACGGACAATGCAGCGATGGCGCGGAACGCGAGCGCGACG<br>CCGAGCGCGACATCCGCGCCAACGAGCGCGACTGCAACGGCGACGGCG<br>ACGGCGACGACGCCGACAGCGACAGCGACGACCGCAACGACGCGCGA<br>CGACGCAGCAGACGACCGCGAGCGACGGCGACAACAACGACGAGCGC<br>GCCGACCACGACCACGACCACGACAACGAGCGCAACGACGAGCGCGAC<br>GACGCCGGCGACAGACAGCTCCCCCTGGGTCTTGCGCTTTGACGGCGCA<br>TGTCGCCGCAACCCAGGCCCCGGCGGCGCCGGTGCTGCGCTCTTCGAGC<br>CAGGTGGCGCCGTGGTGTGGACGGTGTCTCACTACCTCCCGGGCAGTG<br>AGACCAACAACACCGCCGAGTACTCGGCGATGCTGCTCGGGGTGCGCA<br>GCGCCATCCACCACGGCGCGACCCGACTCCGCGTCGAGGGCGACAGCC<br>ACCTCGCGCTCTCGCAGGTGCGCGGCACCTTCGCGTGCACGAACCGGCG<br>TCTGCGCAAGCTGCGCAACCGAGTGCAAGCGGCACTGCGCGAGCTCGG<br>CGACTACCGGCTCGTGCACATCGACCGGCAAGCGAACGCGCATGCCGA<br>CCGCCTCGCGAACCGCGCCCTCGACCTCCGCAAGACCAAGGTCGACTGC<br>GGGCCCCACGCAACGACCACCGACGCGTGCGTGCAGCCGGCGGAAATC<br>CTGGCGCCAACAGCCCGCCTGTCCAGCTCCAGCTCCAGCTCCAGCTCCA<br>GCTCCAGCGACGAGCCGATGCCGGGACTCGAGGAGCCAGCTGCGGAC<br>GACGAGACCGACGCTGACGCCGAAGCCGACATCGCAATGCGCGATGGA | GCGGTGTA<br>CGCGCACA<br>ACGCCGCG<br>CTCTTCGA<br>GTGCACGT<br>TGTGCGCG<br>CACACCGC<br>GCGGGATC<br>TCGCCGCG<br>CTCCAGCA<br>GCATCGGC<br>GCTCCGCG<br>CACCGCAG<br>CGTCCGCT<br>TTGTGGAT<br>CACTTCCA<br>CAGCGGAT<br>GCGCGTGC<br>GGCGTGA<br>GCTTCCAC<br>TCGCGTGC<br>GGCGGCA<br>ACCAAGCA<br>CGCGCGCG<br>AATGTCCA<br>GAGAGCG<br>CGTTCTCG<br>GTCGCCGC<br>CGCCGCGC<br>GCACTGCA<br>GCGGCCAA<br>CACCGCAG<br>GTATGTCT<br>CTCGGCGC<br>CGACGAAC | TGATGC<br>GGGTCA<br>TATTGAC<br>CGAAAG<br>GGCACC<br>ATCCAC<br>GTAGGA<br>CACCGC<br>CCTCAA<br>AAACCC<br>AGTTCA<br>GTTTATT<br>GACACC<br>CTCCACT<br>TAGTGA<br>CATGCA<br>TATTCAA<br>ACCGAT<br>ACATATT<br>CGTTAG<br>GAGAGG<br>TTACTAA<br>CTGGTA<br>ATATATC<br>ACCATTT<br>C (SEQ ID<br>NO:<br>1315) | MGTQSARERGAPSA<br>PHSHTLGPRTPPRPP<br>ACSKHGELESAAGGR<br>DGQCSDGAERERDA<br>ERDIRANERDCNGD<br>GDGDDADSDSDDRN<br>DARRRSRRPRATATT<br>TTSAPTTTTTTTSAT<br>TSATTPATDSSPWVL<br>RFDGACRRNPGPGG<br>AGAALFEPGGAVVW<br>TVSHYLPGSETNNTA<br>EYSAMLLGVRSAIHH<br>GATRLRVEGDSHLAL<br>SQVRGTFACTNRRLR<br>KLRNRVQAALRELGD<br>YRLVHIDRQANAHA<br>DRLANRALDLRKTKV<br>DCGPHATTTDACVQ<br>PAEILAPTARLSSSSSS<br>SSSSSSDEPMPGLEEP<br>AADDETDADAEADIA<br>MRDGGEIFPTLQIGP<br>GSAPAQQPRLRLRQL<br>SDDESEAAARTLEHF<br>ANDMASKIADADD<br>WRSGEGYISAIPVRLR<br>ELLAPYAVPIRSPPRN<br>ASSRPPRPQSRPPRP<br>PRVTRHQREHRLDEA<br>LDDLAAAQRSTSTDQ<br>RSIRNARRRVGRIRTA<br>QAQSDLRSQFATNE<br>RACVESILRAAKPDG<br>TEPQASAGTCPIDRA |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCGAGATTTTTCCGACGCTCCAGATCGGCCCCGGCTCGGCGCCAGCAC | GCGACCAC | | TLHAHFAGVNTPRER |
| | | | | AACAACCGCGGCTCCGCCTCCGCCAGCTCTCGGACGACGAGTCCGAGG | CTCGCGTC | | FDFDDALGADFRAAL |
| | | | | CAGCCGCGCGCACGCTCGAGCACTTCGCCAACGACATGGCGAGCAAGA | CGTCGGCG | | DVLPPPDQAADAFA |
| | | | | TTGCGGACGCTGACGACTGGCGTTCCGGGGAGGGCTACATCAGTGCCA | CCTTGCAT | | DELSLGEVEDQLDRV |
| | | | | TCCCTGTGCGCCTCCGTGAACTCCTCGCACCATATGCGGTGCCAATCAG | GATGTTGC | | VASSSPGLDGVGYDV |
| | | | | GAGCCCTCCACGGAACGCCAGCTCCCGTCCCCCGCGCCCGCAATCTCGT | ATCCCCCG | | FKRFRLQLLPLLHAAY |
| | | | | CCGCCTCGCCCGCCGCGAGTGACTCGACACCAGCGCGAACACCGACTG | CTTTTGGC | | QCCWRHRRVPATW |
| | | | | GATGAGGCGCTCGACGACCTGGCCGCTGCGCAGCGCTCGACATCGACC | AACATTTT | | KVGLVRLLHKKGDRA |
| | | | | GACCAGCGCTCCATCCGCAACGCCCGGCGTCGAGTCGGCCGCATCCGCA | GCCGGTTG | | EPNNWRPICLQQAIY |
| | | | | CGGCACAAGCCCAATCCGACCTCCGCAGCCAGTTCGCCACGAACGAGCG | CGTTTGCG | | KVYSGLLARRLSRWL |
| | | | | CGCCTGCGTCGAGAGCATCCTCCGCGCCGCCAAACCCGACGGCACCGA | ACCGCGGC | | EANERFTTAQKGFRE |
| | | | | GCCTCAAGCAAGCGCGGGCACGTGCCCCATCGACCGTGCGACGCTCCA | AGACGCAT | | FNGCHEHNFVASSLL |
| | | | | CGCGCATTTCGCGGGCGTCAACACGCCGCGCGAGCGCTTCGACTTTGAC | CAAGCGCC | | DQTRRLHRKLYAVW |
| | | | | GACGCGCTGGGAGCCGACTTTCGCGCCGCGCTCGACGTTCTGCCACCGC | ACCGTGAT | | YDLRNAFGSMPQPL |
| | | | | CGGACCAAGCCGCCGATGCGTTCGCCGACGAGCTCTCGCTGGGCGAGG | CGCAGACG | | MWRVLARLGVDTAF |
| | | | | TCGAGGACCAGCTCGACCGCGTCGTCGCCTCCTCCAGTCCCGGCCTGGA | CAGCCATG | | LQRCEDIYADSFFVV |
| | | | | CGGAGTGGGCTACGACGTGTTCAAGCGCTTTCGGCTGCAGCTCCTGCCG | CAGCACAG | | GNAADGATDPVRQE |
| | | | | CTCCTCCACGCTGCATACCAGTGCTGCTGGCGCCACCGCCGCGTGCCTG | TGCTGTGC | | VGVYQGCPLSPLLFIS |
| | | | | CAACGTGGAAGGTGGGATTGGTGCGCCTGCTGCACAAGAAAGGCGATC | CCTCTGCT | | ALIPLLRALQRLPGVG |
| | | | | GCGCTGAGCCAAACAACTGGCGGCCGATCTGCTTGCAGCAGGCCATCTA | GCCGCCCA | | VPLADGVRPCTTAYA |
| | | | | CAAGGTCTACTCTGGGCTGCTGGCGCGCCGACTGTCGCGGTGGCTCGA | ATCCCCTC | | DDLKVFSDSAAGIQQ |
| | | | | GGCGAACGAACGCTTCACCACCGCCCAGAAAGGTTTCCGGGAGTTCAA | GGCGTGC | | CHGTVARFLRWTGL |
| | | | | CGGGTGCCACGAGCACAATTTCGTGGCATCCTCGCTCCTCGACCAGACG | GCACGTCC | | RANASKCALLPVTTT |
| | | | | CGTCGGCTCCATCGGAAGCTGTACGCTGTCTGGTACGACTTGCGGAACG | CCCCCGTG | | ARGNPAIDDTLQLEL |
| | | | | CCTTCGGTTCAATGCCGCAGCCCCTGATGTGGCGCGTCCTCGCTCGCCTC | CCGCGCGC | | HGDAIARLTLQSSYAY |
| | | | | GGAGTCGACACTGCGTTCCTCCAGCGGTGCGAGGACATCTACGCGGAC | CACCACGA | | LGVGDGFDHVQHRV |
| | | | | TCGTTTTTCGTCGTCGGCAACGCAGCCGACGGTGCCACGGACCCCGTCC | CACCATCC | | QLAPKLAELKRDAVA |
| | | | | GACAGGAGGTCGGCGTCTACCAAGGATGCCCGCTGAGCCCGCTGCTGT | GCGCTGCG | | LLRSGLAPWQVLKAI |
| | | | | TCATCTCAGCATTGATTCCTCTCCTGCGGGCTCTGCAGCGGCTACCAGGC | GATTGGTG | | KVYLYPRIEYALRHLR |
| | | | | GTCGGCGTTCCCCTGGCGGACGGAGTCCGTCCGTGTACGACCGCGTAC | GCAAACGC | | PLQSQLEGFDRAVAK |
| | | | | GCGGACGACCTCAAGGTGTTCAGCGACAGTGCCGCCGGCATCCAGCAA | CGCCGCCT | | GFRHLLRLPANATNE |
| | | | | TGCCACGGCACTGTCGCTCGATTCCTCCGATGGACGGGGCTGCGCGCGA | GAACGAC | | LLYAPVSSGGLGLLPL |
| | | | | ACGCGAGCAAGTGTGCGCTGCTGCCAGTGACAACCACTGCGCGCGGCA | GACGGCG | | VELHKALQIAHGWQ |
| | | | | ACCCCGCCATCGACGACACGCTGCAGCTCGAGCTGCACGGCGACGCCAT | ACAACGAA | | MLHSKDAAVQAIAR |
| | | | | CGCCCGCCTCACCCTCCAATCGAGCTATGCCTACCTTGGGGTGGGTGAT | AACAGCGA | | AQVRQVVQKRYTLD |
| | | | | GGCTTCGACCACGTGCAGCACCGCGTGCAGCTCGCGCCCAAGCTCGCA | CGGCCGCG | | ADHWQGRDDELVQ |
| | | | | GAGCTGAAGCGCGACGCTGTGGCACTGCTGCGGTCGGGGTTGGCGCCT | ACGCCGAC | | LFLNSELAASPHATIK |
| | | | | TGGCAGGTACTGAAGGCCATCAAGGTCTATCTGTACCCGCGCATCGAGT | ATCGAGAT | | RRNGDIGSLWSDVQ |
| | | | | ACGCGCTGCGCCACCTCCGACCGCTGCAGTCGCAGCTCGAGGGGTTTGA | GCGCGCCG | | RHLKTLQLRLETREPT |
| | | | | TCGCGCGGTAGCGAAGGGGTTCCGACACCTCCTCCGTCTACCCGCGAAC | ACGACACC | | ADAPDSPNGLLHLRV |
| | | | | GCCACCAACGAGCTGCTCTACGCGCCTGTGTCGAGCGGCGGCCTGGGG | GACGCACC | | PHHRKWLSHKTVLR |
| | | | | CTTCTGCCACTCGTGGAGCTCCACAAAGCTCTGCAGATTGCCCACGGGT | AGCGCCGA | | HMKLHIRLCHKHKW |
| | | | | GGCAGATGCTCCACTCGAAAGACGCCGCCGTGCAGGCGATCGCGCGCG | CCAACCCC | | QSMSDQGRTVRAH |
| | | | | CACAGGTCCGCCAAGTGGTCCAAAAGCGCTACACGCTGGACGCGGACC | GCGACCAG | | GQAGSHFVSRGVGL |
| | | | | ACTGGCAGGGACGAGACGACGAGCTCGTGCAGCTCTTTCTCAACAGTG | TGCGGCTG | | WDADYRFALQARLN |
| | | | | AGCTCGCCGCCTCGCCCCACGCGACCATCAAGCGGCGCAACGGAGACA | CAACGCCC | | QLDTNSTLKRRRQRT |
| | | | | TTGGTTCGCTCTGGAGCGATGTCCAGCGCCACCTGAAGACGCTGCAGCT | GCGCGCAC | | NATCRAPNCSRTETL |
| | | | | CCGGCTCGAGACGCGCGAGCCGACTGCCGACGCGCCTGACTCCCCCAA | AGCACCAG | | AHVLNHCETNMDVI |
| | | | | CGGCCTCCTCCACCTCCGTGTGCCGCACCACCGCAAATGGCTCAGCCAC | CACCAACG | | RQRHDGALEQIGAAI |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AAAACGGTGTTGCGGCACATGAAGCTCCACATCCGCTTGTGCCACAAGC | GATGCCGC | | NAAIKGRRTDTEVRL |
| | | | | ACAAGTGGCAGAGCATGAGCGACCAGGGGCGCACGGTGCGAGCGCAC | GACCGCGC | | NQTVPEFNGPAWRP |
| | | | | GGACAGGCTGGCAGCCACTTTGTGTCGCGCGGGGTGGGCCTATGGGAC | GCCGCCGC | | DIQVRDARSKTMVIA |
| | | | | GCGGACTACCGCTTCGCGCTCCAGGCCCGCCTCAACCAACTCGACACCA | CACACGCG | | DLAITFEDQPNDQSA |
| | | | | ACTCGACACTCAAGCGTCGCCGCCAGCGCACCAATGCCACCTGCCGCGC | (SEQ ID | | SSSLQHSREHKIAKYQ |
| | | | | GCCGAACTGCTCGCGCACCGAGACACTGGCGCACGTCCTCAATCATTGC | NO: 1192) | | PIAAALERQGWRVH |
| | | | | GAAACCAACATGGACGTGATCCGCCAGCGTCACGACGGCGCGCTCGAG | | | TSAIVYGSLRSVHPSN |
| | | | | CAGATTGGTGCGGCGATCAACGCTGCCATCAAGGGCCGCCGCACCGAC | | | FTVYTELLGLLKRDAR |
| | | | | ACCGAGGTCCGACTCAACCAGACAGTTCCAGAGTTCAACGGACCGGCG | | | RLNTTLSCHCIRSSRR |
| | | | | TGGCGGCCCGACATCCAGGTGCGCGACGCGCGCTCCAAGACCATGGTG | | | VWNWHCGQHRAR |
| | | | | ATCGCGGACCTCGCGATCACCTTCGAGGACCAGCCAAACGACCAGTCCG | | | QHQRCQEGRAHGS |
| | | | | CCAGCTCGTCGCTCCAACACAGCCGCGAACACAAGATCGCGAAATACCA | | | GGNQRAEGGTATT |
| | | | | GCCAATCGCGGCGGCACTGGAGCGGCAAGGGTGGCGGGTACACACAA | | | (SEQ ID NO: 1437) |
| | | | | GTGCCATTGTGTACGGGTCGCTACGCTCGGTCCACCCCAGCAACTTCAC | | | |
| | | | | CGTGTACACGGAGTTGCTGGGACTGCTCAAGCGCGACGCCCGTCGCCT | | | |
| | | | | GAACACAACGCTGTCGTGCCACTGCATCCGCAGCAGCCGACGCGTGTG | | | |
| | | | | GAACTGGCACTGCGGCCAGCACAGAGCACGACAGCATCAGCGATGCCA | | | |
| | | | | AGAAGGCCGCGCGCACGGGTCCGGGGGGAACCAGCGCGCGGAAGGG | | | |
| | | | | GGCACGGCAACAACATGATGCGGGTCATATTGACCGAAAGGGCACCAT | | | |
| | | | | CCACGTAGGACACCGCCCTCAAAAACCCAGTTCAGTTTATTGACACCCTC | | | |
| | | | | CACTTAGTGACATGCATATTCAAACCGATACATATTCGTTAGGAGAGGT | | | |
| | | | | TACTAACTGGTAATATATCACCATTTC (SEQ ID NO: 1069) | | | |
| NeSL | Utopia-1_SM | — | *Strigamia maritima* | GGAGTGTTCTTTTCGGAGACGCCGCCTACTTTAGAGGAGAGAATCCCCA | GGAGTGTT | TGATGG | MATVRLKYPYPPEGIL |
| | | | | CGGGCATCCTCATTTGATCTGATCCATCGAGTATCTGCGAATAGTCGGC | CTTTTCGG | GAGAGT | CGPCAANTNAPQTR |
| | | | | GCACTCCTTTTGCCATGATCCCGGGGGTCTCATGGTAAAAAGGTTTGTG | AGACGCCG | GAGGAA | PYSDKSGLAKHLKLY |
| | | | | GCACGGCTTAGTTGACGCCCCTCTTCCACGTCACTCGGCCTGCATCGATC | CCTACTTT | TCTTCTC | HKATLVVECRHCGHE |
| | | | | GACTGCTCTCTCCTCTTCCTCCCTCCCTCCTCTTCACGCTCTCTTCACGTGA | AGAGGAG | CACTGT | ESDLRKMKKHISTNH |
| | | | | CCCCTTCCCATCCCGCCCCTCGGCTTTTGGCAAAGATCTGTGTGTCCTCC | AGAATCCC | GCAAAA | PVAAAAAPTVPPRLG |
| | | | | AAAGCACCCATCTACCATTTGCTCGAGTTGCGATTGGTCGAAGCTGCCA | CACGGGCA | CCATAC | PTAPPPPRVILRPRFIP |
| | | | | CGCCACTCGTCTACTCTGCCTCTCTGACCCCTTCCCCCCTCTCTCCCTCTGC | TCCTCATTT | AGTCAG | RPRTPSPSSSSSSASS |
| | | | | CGCCCTCGCCTCTCGGGTCCCTTCCCATCTCCCTCCTCCCATCCACGTGCT | GATCTGAT | AAGATG | PASSRRSVSLPPASPP |
| | | | | CCCTCCTCTCGTCACGTGATCGTTGCGGCTCGACATGGCCACGGTCAGA | CCATCGAG | CTAACTA | VSSASSPAARSGRNS |
| | | | | CTCAAGTACCCCTATCCTCCCGAGGGTATCTTGTGTGGACCGTGTGCCGC | TATCTGCG | CTAGTTT | PDSQGTAPVTPIGTV |
| | | | | CAACACGAACGCCCCTCAGACGCGGCATACTCCGATAAGTCGGGGTTG | AATAGTCG | GATACC | RNSPAGSPALSYSTAS |
| | | | | GCCAAGCATCTAAAGCTCTATCACAAAGCCACTCTAGTGGTGGAGTGTC | GCGCACTC | CTGTGC | PIASTITTPRHLSPASP |
| | | | | GTCACTGTGGTCACGAGGAGTCTGATCTGAGGAAGATGAAGAAGCACA | CTTTTGCC | CCCCTGC | ALSAGPGSLGASPPV |
| | | | | TCTCGACGAACCACCCCGTCGCTGCGGCCGCCGCGCCTACCGTACCCCC | ATGATCCC | AATGTC | SPTAATVPPAPPATV |
| | | | | TCGCCTGGGTCCCACCGCCCCTCCTCCGCCCCGGGTTATCCTCCGCCCTC | GGGGGTC | CCGCGT | PAVMAATVPFVAAT |
| | | | | GCTTCATCCCACGGCCTCGGACTCCCTCTCCTTCCTCCTCCTCGTCATCGG | TCATGGTA | GTCGTA | TVPSVGSSTVPQRPA |
| | | | | CGTCGTCTCCGGCCTCTTCCAGAAGGTCTGTATCCCTTCCCCCTGCGAGT | AAAAGGTT | CCCAAG | GPRRPPPFPIDDWIG |
| | | | | CCCCCGTCTCCTCCGCTTCCTCCCCGGCCGCTCGCTCGGGTCGGAATTC | TGTGGCAC | CCCGGC | RIARVSSLPELDAVSR |
| | | | | GCCGGACTCGCAGGGGACGGCTCCGGTCACTCCGATCGGTACCGTACG | GGCTTAGT | TGGCAT | LLEDEVVKRRPPDPN |
| | | | | GAACTCGCCGGCCGGTAGCCCTGCCCTCAGCTACTCGACGGCCTCCCCG | TGACGCCC | TGAGAC | ARPASLHPTRRPPPP |
| | | | | ATCGCCTCTACCATCACGACGCCACGCCATCTCTCGCCTGCGTCCCCCGC | CTCTTCCA | ACATTA | STRPRPCHGTGGTSV |
| | | | | TCTCTCTGCCGGGCCTGGCTCTCTCGGCGCGTCTCCGCCCGTCTCTCCCA | CGTCACTC | GGCTCT | SLAALTSSCIREDHRG |
| | | | | CGGCCGCTACAGTACCCCCCGCTCCTCCAGCTACCGTACCCGCAGTGAT | GGCCTGCA | CGCTCCC | SLPLLCTSGWDSPWP |
| | | | | GGCGGCTACCGTACCCTTCGTCGCCGCGACTACCGTACCCTCCGTCGGC | TCGATCGA | CCGTAT | LSPSPSSHCPSSNPCP |
| | | | | TCTAGCACGGTACCCCAGCGTCCCGCCGGCCCTCGACGACCCCCTCCCTT | CTGCTCTC | ACTCTCA | SSSTPPSSLLGPPRHS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCCTATCGACGATTGGATCGGAAGGATCGCCCGAGTGTCATCTCTGCCG | TCCTCTTCC | TAATTTC | HLTWRGSGSTTPSHR |
| | | | | GAATTGGACGCCGTCTCAAGGTTGCTCGAGGATGAAGTGGTCAAGAGA | TCCCTCCC | GTGTAC | HCSRARYHHLLWRLP |
| | | | | CGCCCCCCTGACCCCAACGCCAGACCCGCCTCACTCCATCCGACACGCC | TCCTCTTC | GCTAAT | YPSSPRLPYPPSALAR |
| | | | | GCCCTCCCCCTCCATCTACTCGCCCTCGTCCCTGCCATGGACCGGCGGA | ACGCTCTC | CCTACCC | YPSVPPALDDPLPSLS |
| | | | | ACTTCAGTCTCTCTGGCGGCGCTCACGTCCTCGTGCATTCGCGAAGATCA | TTCACGTG | TACCCCT | TIGSEGSPECHLCRN |
| | | | | CCGAGGGAGCCTCCCCCTTTTGTGCACTTCCGGTTGGGACAGTCCATGG | ACCCCTTC | CCCTTTG | WTPSQGCSRMKWS |
| | | | | CCACTTTCTCCAAGTCCATCAAGCCACTGCCCATCTTCCAACCCCTGTCCC | CCATCCCG | ACCACTC | RDAPLTPTPDPPHSIR |
| | | | | TCTTCCTCCACTCCGCCCTCCTCGCTCCTCGGACCCCCTCGTCACTCCCAT | CCCCTCGG | ACCCAA | HAALPLHLLALVPAM |
| | | | | CTCACCTGGAGAGGTTCTGGATCGACTACGCCGAGCCACCGACACTGCT | CTTTTGGC | CCATGT | GPAELQSLWRRSRPR |
| | | | | CCCGGGCCAGATACCATCATCTACTCTGAGTGGAGGGCCATCGACCCGA | AAAGATCT | GTATAG | AFAKITEGASPFCALP |
| | | | | CTGGACGACTCCTCTCCTCTCTCTTCCAGAAGGTCCAGACCTTCGGGGCG | GTGTGTCC | CTGTGC | VGTVHGHFLQVHQA |
| | | | | CCAACCCGATGGAAGGAGAGTACGACCACACTCATCCACAAGGGTGGT | TCCAAAGC | TGGTGA | TAHLPTPVPLPPLRPP |
| | | | | GACCACACAGCGATGTCCTCTTGGCGTCCAATCGCCCTCCTCTCCACAGT | ACCCATCT | TCCCGG | RSSDPLVTPISPGEVL |
| | | | | GGCCAAGATCTATGGGAGCATCCTGTCTCATCGGCTGACGACCTGGGCC | ACCATTTG | GGCGGT | DRLRRATDTAPGPDT |
| | | | | GTCCAGAATGGTCGTCTCTCGCTCTCGCAGAAGGGATTCCTGCCATTTCG | CTCGAGTT | TATTCAC | IIYSEWRAIDPTGRLL |
| | | | | AGGATGCCTCGACCAGAACTACCTTGTTCAGTCGTGCCTCCAAGACGCC | GCGATTGG | TGGTTAT | SSLFQKVQTFGAPTR |
| | | | | CGCCGCAACAAGAAGACACTCTCACTCGCCTTCCTCGATCTGAAGAATG | TCGAAGCT | CATATCA | WKESTTTLIHKGGDH |
| | | | | CCTTTGGGAGCATCCCCCACCTGACCATTCGTCACTCCCTCGAGTGGCTC | GCCACGCC | TTCTAAA | TAMSSWRPIALLSTV |
| | | | | GGACTGGCCCCTTCATCGATCGACATTCTTGAAGCGTCATTCCTGGGATC | ACTCGTCT | ATGATCT | AKIYGSILSHRLTTWA |
| | | | | GTCGACTCGCGTTCGAACCGAGACTGGACTCACTCCCCCCATCAGCCTC | ACTCTGCC | TTGATCT | VQNGRLSLSQKGFLP |
| | | | | GACACTGGAGTGGTCCAAGGAGCTCCCCTCTCCCCCATCCTCTTCAATCT | TCTCTGAC | CTCAATT | FRGCLDQNYLVQSCL |
| | | | | AGCCATCGAACCCCTCCTCCGCACGGTCCCCTCTGCCCATTCTGGATTTT | CCCTTCCC | AACAAC | QDARRNKKTLSLAFL |
| | | | | CTCTCCATGGCCATGTCGTCTCTGTGGTCGCCTACGCGGATGACCTCGCC | CCCTCTCT | TAACTTA | DLKNAFGSIPHLTIRH |
| | | | | ATCCTCGCCCCATCTACTCCCGCTCTACAATCCCAATTGGATGCTATCTCT | CCCTCTGC | TTTCTGT | SLEWLGLAPSSIDILE |
| | | | | GGCATGGCAGATTGGGCGGGCCTCTCATTCAATCCGGCCAAGTGCGCG | CGCCCTCG | TTGTTTC | ASFLGSSTRVRTETGL |
| | | | | ACCGTCACTCTCACTGGGAAGGATAACTCTCGTGATACGCTGTCCCTGC | CCTCTCGG | ATTGTTT | TPPISLDTGVVQGAP |
| | | | | AAGGCTCCCCCGTCCCTTCCATCTCTGACGGCGATGCATACAAGCACCTT | GTCCCTTC | CACCTC | LSPILFNLAIEPLLRTV |
| | | | | GGAGTCCCCACTGGCACTACTACCTTCCCCAGTGGCACCGATGCAATCA | CCATCTCC | GTAAGA | PSAHSGFSLHGHVVS |
| | | | | AGAAGATGACGACGGATCTACAGGCCATAGACCACTCCGACCTCGCACC | CTCCTCCC | GGAAGT | VVAYADDLAILAPSTP |
| | | | | GGCCCAGAAGCTAGATGCCCTCCGCACTTTCATCATGCCCCAGCTCTCCT | ATCCACGT | TCATTGT | ALQSQLDAISGMAD |
| | | | | TCCATCTCTCTCACGGCTCAGTCCCCAAAGCCCCCCTCACTCAACTGGAC | GCTCCCTC | GCGATA | WAGLSFNPAKCATV |
| | | | | AAGAAGATCAAGCGGGCTGCCAAGCACTGGCTGTTCCTTCCTCAACGAG | CTCTCGTC | AATCAA | TLTGKDNSRDTLSLQ |
| | | | | CCTCGAACGAAATACTGTACATGTCCCACTTGCACGGAGGGCAATCCCT | ACGTGATC | (SEQ ID | GSPVPSISDGDAYKH |
| | | | | ACTCCCCCTCTCGGTGCTAGCGGACATCGGACAAGTGACTCACGCCGTC | GTTGCGGC | NO: | LGVPTGTTTFPSGTD |
| | | | | GCTCTTCTTCAATCAAGGGATCCAGCCGTGGCTGACCTCGCTCTCCGGAC | TCGAC | 1316) | AIKKMTTDLQAIDHS |
| | | | | TTGCCGAGAAGTCGCATCGAAACGGGCAAAGAAGACGGTCAACGGCCC | (SEQ ID | | DLAPAQKLDALRTFI |
| | | | | CGAGTTGGCCCAGTACCTCTCCGGGTCCACTGACGGAATCTACTGCACC | NO: 1193) | | MPQLSFHLSHGSVPK |
| | | | | CCGACTTCTGACATCCCGAGTCTCTGGACGACTGCCCGAGCTGCAACAC | | | APLTQLDKKIKRAAK |
| | | | | GCCGACTCTCCTCCACTCTGCCACTCACGTGGACATCCCCCCTTCCCTCTG | | | HWLFLPQRASNEILY |
| | | | | GCGTCCCCTTCCTTTCTATCAATGGGTCCCCCCTCTCCCCATTCCGAGTAC | | | MSHLHGGQSLLPLSV |
| | | | | AGTCCACCCTCACCAATGCCATTAGACATAACCACCTCTCCACTCTCATT | | | LADIGQVTHAVALLQ |
| | | | | GCCAAACGGGACCAGGGAAATTCCTACCGTACCTCACACGACCCCGACC | | | SRDPAVADLALRTCR |
| | | | | CCTCTAACTACTGGGTCAAGGGAGGAGACTTCCTCCGATTCTGTGACTG | | | EVASKRAKKTVNGPE |
| | | | | GCGATTCATACACAGAGCCCGACTGAACCTCCTCCCAGTGAACGGGGCG | | | LAQYLSGSTDGIYCTP |
| | | | | CGCCGATGGGACGCAAACAGCATCAAGACGTGCCGGCGCTGTGGTGCG | | | TSDIPSLWTTARAAT |
| | | | | CCCAATGAGACACTCGCCCACGTGCTCAACGTCTGCCCTGTCGGACTGC | | | RRLSSTLPLTWTSPLP |
| | | | | CGGAGATGAAGAAGAGGCACGATGCAATTCATGCCCGCATCAAGAAAG | | | SGVPFLSINGSPLSPF |
| | | | | CCCTCCGACCCTCTCCCCATACGGTAGTACACCACGACCGGACAGTTCCC | | | RVQSTLTNAIRHNHL |
| | | | | GGATGCGGCCCCCTGAGACCGGACATTCTGAGAATCAGCGAGAGAGAC | | | STLIAKRDQGNSYRTS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AAATCTGTTGCCATTGTAGATATCCACGTTCCCTTCGACAATGGCACTGA | | | HDPDPSNYWVKGG |
| | | | | TGCGGTTGAGCGAGCTCACGAGACAAAGCGGGCGAAGTACGAACTGAT | | | DFLRFCDWRFIHRAR |
| | | | | CCGGCGGCACTACGAACACCAAGGGTATCGAGTCACGTTTGACTCACTA | | | LNLLPVNGARRWDA |
| | | | | GTAGTCACAGCGCTTGGTAGACTGTGGCGGGGAGTGAGGCAGCGCTA | | | NSIKTCRRCGAPNETL |
| | | | | CAAGCGCTCCAGATCTCGTCACAGTATAGTAAGCTCCTCCGTAAGTTACT | | | AHVLNVCPVGLPEM |
| | | | | CGTGGCTGATGCCATCCACGGCTCGAGAAACGTGTACGCCCATCATATG | | | KKRHDAIHARIKKALR |
| | | | | ACCGGTATGGTTATGTGATGGGAGAGTGAGGAATCTTCTCCACTGTGCA | | | PSPHTVVHHDRTVP |
| | | | | AAACCATACAGTCAGAAGATGCTAACTACTAGTTTGATACCCTGTGCCCC | | | GCGPLRPDILRISERD |
| | | | | CTGCAATGTCCCGCGTGTCGTACCCAAGCCCGGCTGGCATTGAGACACA | | | KSVAIVDIHVPFDNG |
| | | | | TTAGGCTCTCGCTCCCCCGTATACTCTCATAATTTCGTGTACGCTAATCCT | | | TDAVERAHETKRAKY |
| | | | | ACCCTACCCCTCCCTTTGACCACTCACCCAACCATGTGTATAGCTGTGCT | | | ELIRRHYEHQGYRVT |
| | | | | GGTGATCCCGGGGCGGTTATTCACTGGTTATCATATCATTCTAAAATGAT | | | FDSLVVTALGRLWRG |
| | | | | CTTTGATCTCTCAATTAACAACTAACTTATTTCTGTTTGTTTCATTGTTTCA | | | SEAALQALQISSQYSK |
| | | | | CCTCGTAAGAGGAAGTTCATTGTGCGATAAATCAA (SEQ ID NO: 1070) | | | LLRKLLVADAIHGSRN |
| | | | | | | | VYAHHMTGMVM |
| | | | | | | | (SEQ ID NO: 1438) |
| NeSL | Utopia-1_SP | AAGJ02140537 | *Strongylo-centrotus purpuratus* | AAGGCTCAAACCAGGCTGCCAACCAAGCTGCCAGCTTAGGCACCAACCA | AAGGCTCA | TGACGA | MSHSITEVFDYPLPSR |
| | | | | AGCTGCCAGTCCAGGCTCCAACCAGGCTGCCCACCAATCTGCCAGCTTA | AACCAGGC | AATGTTC | WKCTVCLENFFNQQ |
| | | | | GGCTCCAACCAAGCTGCCCACCTAGCTGCCAGCTTAGGCACCAACCAAG | TGCCAACC | AATATAT | TLKRHQARHHQTTSF |
| | | | | CTGCCAGCCGAGGATCCAACCAGGCTGCCCACCTAGCTGCCAGCTTAGG | AAGCTGCC | GACATT | LYVFRCSACQAEFDS |
| | | | | CTCCAACCAAGCCGCCAGCCCAGGCTCCAACCAGGTTGCCACCCGAAAG | AGCTTAGG | CTAATGT | ARKASNHWQSHKRK |
| | | | | TCTGCCAGTTTAGGCACCAACCAAGCTGCCAGCCGAGGCTCCAACCAGG | CACCAACC | TCATGTA | PILSQPAVNEIPSSGL |
| | | | | CTGCCACTCGAGGCTCCAACCAGGCTTTCACCCGAAGCATTACCCAGGC | AAGCTGCC | TTTTTTG | DPSPPRSRPPVEVIGS |
| | | | | TGCCCGTTTAGGCACAAACCAGGCTGCCAGCCGAGGCTCCAACCAAGCA | AGTCCAGG | TTTGCTT | SFPDDVSMLSEPSTP |
| | | | | ACCAGCCCAGGTTCCAATCAAGCTGCCAGCCGAGGCTCCAAGTAAGCTG | CTCCAACC | GACAAA | STSLQMDPEVVHPPS |
| | | | | CCAGCCGAGGCTCCAACCAGGCTGCCACTCGAGGCTCCAACCAGGCTTT | AGGCTGCC | GCTAGA | RSISFSPMHLSPTQPA |
| | | | | CACCCGAAGCATTACCCAGGCTGCCCGTTTAGGCACAAACCAAGCTGCC | CACCAATC | TGAATA | SPIQIGVEVSFNSSSSL |
| | | | | AGCCGAGGCTCCAACCAAGCAACCAGCCCAGGTTCCAATCAAGCTGCCA | TGCCAGCT | TATTCCC | QMDPEVVQPPSPSIS |
| | | | | GCCGAGGCTCCAACCAAGCTGCCAGCCGAGGCTCCAACCAGGCTGCCC | TAGGCTCC | TGTCCTA | FSPMHLSPTQPASPI |
| | | | | ACCAAGCTGCCAACTTAGGCTCCAACCAAGCTGCCAGCCCAGGCTCCAA | AACCAAGC | CTACATA | QIGVEVSFNSSGSLQ |
| | | | | CCAGGTTGCCACCCGAATCTCTGCCAGTTTAGGCACCAACCAAGCTGCC | TGCCCACC | CATCTCG | MDPEVVQPPSPSISF |
| | | | | AGCCTAGGCTCCAACCAGGCTGCCACTCGAGGCTCCAACCAGGCTTTCA | TAGCTGCC | ATGTGC | SPMHLSPTQPVSPIQI |
| | | | | CCCGAAGCATCACCCAGGCTGCCCTTTTAGGCACAAATCAAGCTGCCAG | AGCTTAGG | CCTTGCT | GIEVSFTSSSPLQMD |
| | | | | CCGAGGCTCCAACCAAGCAACCAGCCCAGGTTCCAATGAAGCTACCAGC | CACCAACC | AGACGA | PEVVQPPSPSMSYSP |
| | | | | CGAGGCTCCAACCAAGCTGTCAGCCGAGGCTCCAACCAGGCTGCCCACC | AAGCTGCC | TCCATTG | MHLSLTQPDSPIPVDI |
| | | | | AAGCTGCCAGCTTAGGTACCAACCAAGCTGCCAGCCCAGGCTCCAACCA | AGCCGAG | GTAACC | DVIPAAEVPLPDIEIPP |
| | | | | GGTTGCCACCCGAAACTCTGCCAGTTTAGGCACCAACCAAGCTGCCAGC | GATCCAAC | ATGATA | SPDRHPAAEVPLPDI |
| | | | | CGAGGCTCCAACCAGGCTGCCACTCGAGGCTCCAACCAGGCTTTCACCC | CAGGCTGC | TCAATG | EIPPSPDRHPVAEVPL |
| | | | | CAAGCATCAACCAGGCTGCCCGTTTAGGCACAAACCAAGCTGCCAGCCG | CCACCTAG | GATTAA | PDIEIPPSPDRHPQSP |
| | | | | AGGCTCCAACCAGGCCTCCAACCAAGCTACCAGCCGAAGCTCTGCCAGA | CTGCCAGC | CACATG | PRPVMMEQPVHTPP |
| | | | | TTAGGCACCAACCAAGCTGCCACCGTTAGAGGCCCAGAGCCCACCAATC | TTAGGCTC | ATCTGTA | PADTQQANGPQHW |
| | | | | CCATAACGTGTGAGATATGTGAAGCTTCCTTCCACACCTCCGCCGGTCTC | CAACCAAG | AACAAT | VTVLANATNWEDFG |
| | | | | CGTCGCCACACGGCCAGGCTTCATCGCACCACTGCTGAACACACTGACG | CCGCCAGC | ATATGA | RVCVEFANHAVEAA |
| | | | | ACAGCATGAGCCATTCCATCACCGAGGTATTCGACTATCCGTTGCCCTCC | CCAGGCTC | TTTACAC | RSRQDAPQVRPAAQ |
| | | | | CGTTGGAAGTGCACAGTGTGCTTAGAGAACTTTTTCAATCAGCAGACCC | CAACCAGG | AATGTA | RQPRRPTRPRQPTFD |
| | | | | TCAAGCGCCACCAGGCCCGGCACCACCAAACGACCTCCTTCCTCTACGTC | TTGCCACC | TTTATTG | VREASRLQKLYKRSKK |
| | | | | TTTCGATGCTCAGCCTGCCAGGCTGAGTTTGATTCTGCTCGTAAGGCTTC | CGAAAGTC | TTTCAAT | RAVRHILRDDAPSFS |
| | | | | TAATCACTGGCAGAGCCACAAGAGGAAACCAATCCTCTCACAACCAGCA | TGCCAGTT | AAATCT | GSNEQLLDYFKEIYAP |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTGAATGAAATCCCTTCTTCGGGTCTAGATCCATCCCCTCCAAGGTCTCG | TAGGCACC | GTTCTTT | PEIDENRAQQLAESL |
| | | | | TCCACCGGTCGAGGTGATTGGTTCTTCTTTTCCAGATGATGTGTCTATGC | AACCAAGC | TCACTTT | FTDLEEAKESAAALM |
| | | | | TGTCAGAACCATCTACCCCCTCTACATCACTACAAATGGACCCAGAGGTG | TGCCAGCC | AATACA | SPISQQEISTRLSRMS |
| | | | | GTGCATCCTCCGTCACGATCCATATCCTTTTCGCCCATGCATCTTAGCCCC | GAGGCTCC | TGAAAC | NSAPGKDRLEYRHIR |
| | | | | ACTCAGCCAGCCAGCCCGATTCAAATAGGCGTTGAGGTTTCCTTTAACTC | AACCAGGC | ATGACT | QADGACRVTHIMFN |
| | | | | TTCCAGCTCACTTCAGATGGACCCAGAGGTCGTGCAGCCCCCGTCACCG | TGCCACTC | GTGCCT | RCLQEHRIPSAWKEA |
| | | | | TCCATTTCCTTCTCACCCATGCATCTTAGCCCCACTCAGCCCGCCAGCCCG | GAGGCTCC | TCTCCAA | TTILIHKSGTTDDPAN |
| | | | | ATTCAAATAGGCGTTGAGGTTTCCTTTAACTCTTCCGGCTCACTTCAGAT | AACCAGGC | CTGGAG | FRPIALQSCLYKLFMG |
| | | | | GGACCCAGAGGTGGTACAGCCCCCGTCACCGTCCATCTCCTTCTCACCCA | TTTCACCC | ACCTAC | ILSDRMTQWACNHN |
| | | | | TGCATCTTAGCCCCACCCAACCAGTCAGCCCGATTCAAATAGGCATTGA | GAAGCATT | ATAATTT | LLSPEQKSARPCEGC |
| | | | | GGTTTCCTTTACCTCTTCCAGCCCACTTCAGATGGACCCCGAGGTAGTGC | ACCCAGGC | GTTAAA | HEHTFLLSSVIKDTKR |
| | | | | AGCCCCCGTCACCCTCCATGTCCTACTCACCCATGCATCTTAGCCTCACTC | TGCCCGTT | ATGATA | NQKTANIAWLDLRN |
| | | | | AGCCAGACAGCCCCATCCCAGTAGACATTGATGTCATACCAGCGGCTGA | TAGGCACA | TAAATAT | AFGSIPHQAIHAVLTT |
| | | | | GGTCCCCTTGCCTGATATTGAGATTCCTCCTTCTCCGGATAGACATCCAG | AACCAGGC | TTCGAA | IGAPVSLVMLLKDTYT |
| | | | | CGGCTGAGGTCCCCTTGCCTGATATTGAGATTCCTCCTTCTCCGGATAGA | TGCCAGCC | GATGAA | GASTSFLSTSGETDPI |
| | | | | CATCCAGTGGCTGAGGTCCCCTTGCCTGATATTGAGATTCCTCCTTCTCC | GAGGCTCC | ATTATTA | QIQSGVKQGCPMSAI |
| | | | | GGATAGACATCCACAATCGCCTCCACGACCAGTGATGATGGAGCAGCCA | AACCAAGC | TTAATAA | LFNLTIELIIRAVKKKA |
| | | | | GTCCATACACCACCGCCGGCCGATACACAGCAGGCTAATGGTCCACAGC | AACCAGCC | (SEQ ID | TDDGLGLVVHGQRL |
| | | | | ATTGGGTGACTGTTCTAGCCAACGCCACCAATTGGGAAGACTTCGGGAG | CAGGTTCC | NO: | SIMAYADDLVLMSKT |
| | | | | AGTCTGTGTAGAGTTTGCTAATCATGCTGTAGAAGCAGCCCGGTCTCGG | AATCAAGC | 1317) | PEGLDAILSVASEQAE |
| | | | | CAAGATGCACCTCAAGTAAGGCCTGCTGCACAGAGACAGCCTCGCAGA | TGCCAGCC | | TLRLAFKPTKCASLSLS |
| | | | | CCGACTAGACCTCGTCAACCCACGTTTGATGTCAGGGAGGCAAGCCGTT | GAGGCTCC | | CRHGTSVLPREYTVQ |
| | | | | TGCAGAAGCTCTACAAACGCAGCAAGAAAAGAGCGGTTCGGCACATTC | AAGTAAGC | | GHLMPALDEEEQYR |
| | | | | TAAGAGATGACGCCCCCTCCTTCTCTGGCAGCAATGAGCAACTGCTTGA | TGCCAGCC | | YLGVPFGLPRFTNLK |
| | | | | CTACTTCAAAGAAATCTATGCTCCTCCCGAGATTGATGAAAATAGAGCA | GAGGCTCC | | DLIGKLKGNIETIASSL |
| | | | | CAACAGTTGGCAGAGTCTCTCTTTACCGATCTTGAGGAAGCGAAGGAGT | AACCAGGC | | LAPWQKLDAIKTFVQ |
| | | | | CTGCGGCCGCCCTAATGTCTCCTATATCTCAGCAAGAGATCAGTACACG | TGCCACTC | | PGLSFVLRAADYLKSD |
| | | | | CCTTTCTCGAATGAGCAATTCTGCCCCTGGAAAGGACCGCCTCGAGTAT | GAGGCTCC | | LRSLKSAITTNVKKIC |
| | | | | AGACATATTCGACAAGCTGATGGTGCATGCCGTGTTACCCACATCATGT | AACCAGGC | | QLPLRAANAYIFAAK |
| | | | | TCAACAGGTGCCTACAGGAACACCGTATACCATCAGCATGGAAGGAAG | TTTCACCC | | ESGGLAFIDPNVDAD |
| | | | | CTACAACCATCCTCATTCACAAGTCCGGTACAACCGATGACCCAGCAAAC | GAAGCATT | | IQVITQAVRVLSSDDE |
| | | | | TTCCGCCCGATCGCACTCCAGTCATGCTTGTACAAACTCTTCATGGGCAT | ACCCAGGC | | VVQTIATSQLKSVVH |
| | | | | CCTCTCAGACAGAATGACACAGTGGGCGTGCAATCACAACCTTCTCAGC | TGCCCGTT | | RTIHAVPTEEDIDNYL |
| | | | | CCAGAGCAGAAGAGCGCTCGCCCATGTGAGGGATGTCATGAACACACC | TAGGCACA | | SGSNEGLLANSGNSG |
| | | | | TTTCTTCTGTCGTCTGTCATCAAAGATACCAAGCGAAACCAGAAGACTGC | AACCAAGC | | QASSLWSRTRSAARR |
| | | | | CAACATCGCCTGGCTAGATCTTAGGAACGCCTTCGGAAGCATCCCCCAC | TGCCAGCC | | LHLTLRATTSGTVVV |
| | | | | CAGGCTATCCATGCAGTCCTGACAACGATAGGAGCACCTGTCAGCCTGG | GAGGCTCC | | NQQADIDHTRDILPA |
| | | | | TTATGCTCCTGAAGGACACATACACGGGAGCATCCACATCCTTTCTTAGC | AACCAAGC | | SITRGLRLIQRTTNAE |
| | | | | ACGAGTGGAGAGACTGACCCAATACAGATCCAGTCCGGTGTTAAACAA | AACCAGCC | | KLKSLPDQGKVARSL |
| | | | | GGATGCCCGATGTCTGCCATCCTCTTCAACCTAACCATTGAACTTATCAT | CAGGTTCC | | SNDPFANGSSWHAT |
| | | | | CAGAGCCGTCAAGAAGAAGGCAACGGATGATGGCCTCGGGCTTGTGGT | AATCAAGC | | GKFIRFCDWRFIHRA |
| | | | | GCATGGACAACGCCTATCCATCATGGCCTACGCTGACGACCTCGTCCTG | TGCCAGCC | | RLNCLPTNVATKRW |
| | | | | ATGAGCAAGACACCAGAAGGCCTGGATGCCATTTTGTCTGTGGCATCCG | GAGGCTCC | | KANANGKNGHQQE |
| | | | | AGCAGGCAGAAACCCTACGTCTGGCATTCAAGCCTACCAAGTGTGCCTC | AACCAAGC | | TLPHVLNHCLPNMV |
| | | | | CCTCTCACTCTCATGTAGACACGGTACATCTGTCCTTCCACGCGAATACA | TGCCAGCC | | PIRRRHDNIQQRLVT |
| | | | | CCGTCCAAGGTCACCTGATGCCAGCTCTCGACGAGGAAGAGCAGTACC | GAGGCTCC | | AIRHGDVFVNQHVP |
| | | | | GCTACCTCGGAGTTCCCTTCGGCTTACCTCGTTTCACAAATCTCAAGGAC | AACCAGGC | | GDPNPRERPDITVIE |
| | | | | CTGATCGGCAAGCTGAAGGGAAACATCGAGACCATTGCATCATCATTGC | TGCCCACC | | GNKVTVIDISVPFDN |
| | | | | TGGCCCCATGGCAAAAGTTGGATGCAATCAAAACCTTCGTCCAACCAGG | AAGCTGCC | | GPNACTTAAQAKVE |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCTCAGTTTCGTACTGCGGGCAGCGGACTACTTGAAGTCGGACTTGCGTTCTCTGAAATCTGCCATCACCACCAACGTCAAAAAGATATGCCAGCTTCCCCTTCGGGCGGCCAACGCATACATCTTCGCGGCTAAGGAATCGGGTGGTCTAGCCTTCATAGACCCCAACGTAGATGCGGACATCCAAGTCATCACTCAAGCCGTTCGTGTCCTGTCGTCTGACGATGAAGTCGTTCAGACAATAGCAACATCCCAACTCAAGTCGGTTGTTCATCGCACAATCCACGCAGTCCCTACTGAAGAGGACATCGACAACTACTTGTCTGGCAGCAACGAGGGCCTGCTTGCCAATTCGGGTAATAGCGGCCAAGCTTCTTCTCTGTGGTCTCGAACCAGGTCAGCCGCAAGAAGACTTCATCTTACCCTCAGAGCCACCACCAGTGGTACAGTTGTTGTCAACCAGCAGGCAGACATCGACCACACAAGGGACATTCTACCAGCATCAATAACAAGAGGACTGAGGCTCATCCAACGAACCACAAATGCTGAGAAACTCAAGTCCCTACCAGACCAAGGGAAAGTTGCCAGATCCCTCAGCAACGATCCATTCGCTAACGGCTCTTCTTGGCATGCAACTGGAAAGTTCATCCGCTTCTGCGATTGGCGGTTCATTCACCGAGCCAGACTGAACTGCCTCCCCACGAATGTAGCCACGAAGAGGTGGAAGGCAAATGCGAATGGCAAGAATGGCCATCAACAAGAGACACTGCCTCACGTACTGAATCATTGCCTACCCAACATGGTCCCCATCAGACGCCGCCATGACAACATCCAACAACGACTGGTAACAGCCATCAGACATGGCGATGTCTTTGTCAATCAACATGTACCGGGAGACCCCAACCCAAGAGAACGCCCAGATATCACTGTTATCGAGGGAAACAAAGTCACAGTCATCGATATTTCTGTCCCCTTCGACAATGGTCCCAACGCATGCACCACAGCTGCACAAGCCAAAGTCGAAAAGTACTCTGCCCTCCGTCAAGCCTTGAGAGATATGGGAAGAGACGTCGAAGTCCATGGCTTCATAGTTGGTGCCTTAGGAACCTGGCACCAGGGCAACGAACGTGCTCTCGGACGCCTGGGTGTCAGTCGCTGGTACAGAACACTGATGAGAAAGCTGTGCTGCATTGATGCTATCCAAGCTTCCAGAGACATTTGGGTTGAACATGTCACTGGACATCGACAGTACGAGTGACGAAATGTTCAATATATGACATTCTAATGTTCATGTATTTTTTGTTTGCTTGACAAAGCTAGATGAATATATTCCCTGTCCTACTACATACATCTCGATGTGCCCTTGCTAGACGATCCATTGGTAACCATGATATCAATGGATTAACACATGATCTGTAAACAATATATGATTTACACAATGTATTTATTGTTTCAATAAATCTGTTCTTTTCACTTTAATACATGAAACATGACTGTGCCTTCTCCAACTGGAGACCTACATAATTTGTTAAAATGATATAAATATTTCGAAGATGAAATTATTATTAATAA (SEQ ID NO: 1071) | AACTTAGGCTCCAACCAAGCTGCCAGCCCAGGCTCCAACCAGGTTGCCACCCGAATCTCTGCCAGTTTAGGCACCAACCAAGCTGCCAGCCTAGGCTCCAACCAGGCTGCCACTCGAGGCTCCAACCAGGCTTTCACCCGAAGCATCACCCAGGCTGCCCTTTTAGGCACAAATCAAGCTGCCAGCCGAGGCTCCAACCAAGCAACCAGCCCAGGTTCCAATGAAGCTACCAGCCGAGGCTCCAACCAAGCTGTCAGCCGAGGCTCCAACCAGGCTGCCCACCAAGCTGCCAGCTTAGGTACCAACCAAGCTGCCAGCCCAGGCTCCAACCAGGTTGCCACCCGAAACTCTGCCAGTTTAGGCACCAACCAAGCTGCCAGCCGAGGCTCC | | KYSALRQALRDMGRDVEVHGFIVGALGTWHQGNERALGRLGVSRWYRTLMRKLCCIDAIQASRDIWVEHVTGHRQYE (SEQ ID NO: 1439) |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | AACCAGGC<br>TGCCACTC<br>GAGGCTCC<br>AACCAGGC<br>TTTCACCC<br>CAAGCATC<br>AACCAGGC<br>TGCCCGTT<br>TAGGCACA<br>AACCAAGC<br>TGCCAGCC<br>GAGGCTCC<br>AACCAGGC<br>CTCCAACC<br>AAGCTACC<br>AGCCGAA<br>GCTCTGCC<br>AGATTAGG<br>CACCAACC<br>AAGCTGCC<br>ACCGTTAG<br>AGGCCCAG<br>AGCCCACC<br>AATCCCAT<br>AACGTGTG<br>AGATATGT<br>GAAGCTTC<br>CTTCCACA<br>CCTCCGCC<br>GGTCTCCG<br>TCGCCACA<br>CGGCCAG<br>GCTTCATC<br>GCACCACT<br>GCTGAACA<br>CACTGACG<br>ACAGC<br>(SEQ ID<br>NO: 1194) | | |
| NeSL | Utopia-<br>1_TSP | — | *Trichinella spiralis* | TTTCTGGTATGAATCCCAAGCGGATTCGTTACGAAATTTGCATAAGTTTT<br>TGAAAAAATAGGCATTTGGTCGAGTGCTCGCACCACCATTTGTCGCGGG<br>TCGTCCTGATATTGCACTACATTCAGGAACGGCCTATTCCCTTCGGGGAA<br>TTGTGTTTTAGGAATTGGAATCGGTTTGGTTACGATCGGTCGAGTGGTT<br>CGTGAGATCGAGTGACAGCCGGGTGGCAGCGACAATGTGTAGTGCAAA<br>GACACCAGCCTTGAAGTCGGGTCGCCGTCGCGGAAAAGAGGTCAACTA<br>TGAAGGCCAAATTGTACGGGTAGAAAGACGGCGTGGATCTCGCAGTAG<br>TACGAGCGCAACGGACCTTGGTACGAGGATGGTTACGCGTGGGCGAAA<br>GAAGCTGATGGAGGCGTCGGTTCGTGAAGCGGGTCACCACGGAGGTG | TTTCTGGT<br>ATGAATCC<br>CAAGCGG<br>ATTCGTTA<br>CGAAATTT<br>GCATAAGT<br>TTTTGAAA<br>AAATAGGC<br>ATTTGGTC | TGATCC<br>GTCCCG<br>AACCAA<br>CGGAAC<br>CACATT<br>GCCGCA<br>TGACTTC<br>GATTTC<br>GCTTTTG | MCSAKTPALKSGRRR<br>GKEVNYEGQIVRVER<br>RRGSRSSTSATDLGT<br>RMVTRGRKKLMEAS<br>VREAGHHGGESAST<br>VDVDVVESKKITGKT<br>ARRNRRAPSGDGKR<br>RESCGAECGQAVCG<br>NAVADRSEASSPRTP |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AATCGGCGAGTACTGTGGACGTCGACGTGGTGGAATCGAAGAAAATTA | GAGTGCTC | CTCTTTT | NVSKSGRDKCGQPTI |
| | | | | CGGGTAAAACGGCGCGCCGTAATAGAAGAGCGCCAAGCGGTGATGGA | GCACCACC | TGTATTT | KASTPSPPKRKPTTSS |
| | | | | AAAAGACGAGAGAGCTGTGGTGCGGAATGTGGCCAAGCCGTATGCGG | ATTTGTCG | AATTTTG | SPRTPCLSKRGARSKI |
| | | | | TAACGCTGTTGCGGACCGTAGTGAGGCCAGTTCGCCCCGCACTCCCAAC | CGGGTCGT | CTATTAA | PSTPDTPSTSGGSGK |
| | | | | GTTAGTAAATCTGGTCGTGACAAGTGTGGTCAACCCACTATAAAAGCCT | CCTGATAT | CAATTCA | QRVLVSPLLRTEKLPD |
| | | | | CCACACCATCACCACCGAAAAGAAAACCGACCACTTCGAGTAGCCCACG | TGCACTAC | GTTTGTT | LEVLQRTEEQVTVRA |
| | | | | TACGCCATGCCTCTCCAAGCGCGGAGCGAGATCCAAAATTCCGTCCACG | ATTCAGGA | AACTGTT | TFPIAQAVVCPLGCE |
| | | | | CCAGATACACCATCGACTTCTGGCGGTTCAGGTAAGCAACGTGTTTTGG | ACGGCCTA | TTGTATT | KPYTAVRPDGQFAH |
| | | | | TGTCGCCGTTGCTTAGGACGGAAAAATTGCCCGACCTCGAAGTTCTACA | TTCCCTTC | CATTTGA | QTLTRHFMRVHNCH |
| | | | | AAGAACCGAGGAACAGGTGACTGTACGGGCAACTTTCCCAATCGCCCA | GGGGAATT | AGATCC | SVQWHYRCRNCNTD |
| | | | | GGCGGTGGTCTGCCCACTGGGATGCGAGAAACCGTACACGGCCGTGAG | GTGTTTTA | AAATAA | FLPADHRYPLRVVNT |
| | | | | ACCAGACGGTCAATTTGCGCACCAAACGCTGACTCGTCATTTCATGCGA | GGAATTGG | AAC | HVRSCVSRWEITRKL |
| | | | | GTCCACAATTGTCACAGCGTCCAGTGGCATTACCGGTGTCGCAATTGTA | AATCGGTT | (SEQ ID | GESEDLHGVRCDLCD |
| | | | | ATACGGATTTCTTGCCGGCAGATCACCGGTATCCCCTCCGAGTTGTGAA | TGGTTACG | NO: | YVGVSKRAVGLHRRR |
| | | | | CACCCACGTTCGCAGCTGTGTTAGCCGGTGGGAGATAACCCGGAAGTT | ATCGGTCG | 1318) | HANENIMQNTGTAA |
| | | | | GGGAGAGAGCGAAGATTTGCATGGAGTTCGTTGCGATCTTTGCGATTAC | AGTGGTTC | | QIEALSKQVGEIRVA |
| | | | | GTAGGCGTGTCGAAAAGAGCCGTCGGATTGCATCGCCGCCGGCACGCC | GTGAGATC | | GDYSQFKFGKRVRQY |
| | | | | AACGAGAACATTATGCAAAATACGGGTACGGCCGCTCAAATCGAGGCC | GAGTGACA | | VAPTQRRDGLDEEEV |
| | | | | TTGAGCAAACAAGTCGGCGAAATACGTGTAGCAGGCGACTATAGTCAG | GCCGGGT | | HEAEEEEVPAESRTIL |
| | | | | TTTAAGTTTGGTAAACGGGTTCGGCAATACGTGGCACCAACGCAGAGG | GGCAGCG | | GEPSTATAIGAEEISA |
| | | | | CGAGACGGGTTGGACGAAGAGGAGGTTCATGAAGCCGAAGAAGAGGA | ACA (SEQ | | TGPVRADTAAQQMI |
| | | | | GGTGCCAGCCGAATCACGTACCATCCTAGGTGAACCCAGCACCGCAACT | ID NO: | | CRIGQWCVWPQDY |
| | | | | GCTATAGGAGCTGAGGAGATCTCTGCAACGGGTCCAGTTCGAGCAGAC | 1195) | | HSIPAPQCWTDTLM |
| | | | | ACAGCTGCTCAGCAGATGATCTGCCGGATCGGGCAATGGTGTGTCTGG | | | DLMIEQIVLQRYPDG |
| | | | | CCGCAGGACTACCATTCGATCCCGGCACCTCAGTGCTGGACGGACACGT | | | AGVSVMSCSAVSAAI |
| | | | | TGATGGACCTCATGATTGAACAAATCGTTCTGCAGCGCTATCCCGATGG | | | HHEISAEFAAQVMSS |
| | | | | TGCGGGTGTGAGCGTGATGAGCTGCTCAGCAGTAAGCGCAGCCATACA | | | HDASLYCIIPVNVRN |
| | | | | CCACGAGATATCTGCAGAGTTTGCCGCTCAGGTCATGTCTTCACATGAT | | | HWQMIVLDVAERVV |
| | | | | GCCAGTTTGTATTGCATCATTCCTGTGAATGTACGTAATCATTGGCAGAT | | | HYYCSLREHNTVVLSS |
| | | | | GATTGTGCTGGATGTGGCTGAACGAGTAGTCCATTACTACTGTTCTCTCC | | | LLSLVELSGKHTGCTS |
| | | | | GCGAGCATAACACTGTTGTTTTATCGTCTCTGTTATCGCTAGTGGAGCTG | | | WKIETHDGAPVQTN |
| | | | | AGTGGTAAGCACACTGGCTGCACCTCGTGGAAGATCGAGACTCACGAT | | | AFDCGPFSCLFLKHLL |
| | | | | GGCGCGCCGGTGCAAACGAATGCGTTCGATTGTGGTCCGTTTTCGTGCT | | | HGIDMNFGDRESAA |
| | | | | TGTTTTTGAAGCACCTGCTGCACGGCATCGACATGAATTTCGGTGATCG | | | LRTDLKFMIDAVSTP |
| | | | | GGAGTCGGCGGCTTTGCGCACCGACCTGAAGTTTATGATCGATGCGGTA | | | VVPATDKLKKKPDGS |
| | | | | TCCACTCCCGTCGTTCCGGCGACGGATAAGCTAAAGAAAAAACCTGACG | | | ATQLTQFQQKFLSAS |
| | | | | GCTCAGCGACTCAGTTGACCCAGTTCCAGCAGAAGTTCCTGAGCGCTTC | | | DNWQSPDVDLQAV |
| | | | | TGACAACTGGCAATCTCCTGATGTCGACTTGCAAGCGGTGTATGACGAA | | | YDEVVESIVSGHNEP |
| | | | | GTGGTGGAGAGTATTGTGTCCGGACACAATGAACCGAGCTCTCGTAAC | | | SSRNTSRLQKKSPGK |
| | | | | ACCAGCCGTTTGCAAAAGAAAAGTCCGGGTAAAGGAGGTAAAGGACAG | | | GGKGQVRRRSAVTR |
| | | | | GTTCGCCGACGCAGTGCGGTAACGCGTGACCCGGCATGGTTGAAATCT | | | DPAWLKSASAVQKA |
| | | | | GCGTCAGCGGTTCAAAAGGCGTTCAATTCGGCACCGGCCCGTACTGTGA | | | FNSAPARTVNAILRR |
| | | | | ATGCAATCCTCCGGCGTCCGAATGCCTGTCCTTCGTTTACAGCCACGCAA | | | PNACPSFTATQVAD |
| | | | | GTGGCAGATCATTATTTCAATCTCAGACCGGCGGTTACCTCGCTTGCACC | | | HYFNLRPAVTSLAPE |
| | | | | CGAGGTTATTGACATCTTACCTCCGCCCGCCACTGACCACTCGATGCTTG | | | VIDILPPPATDHSMLV |
| | | | | TTGCGGAGTTGAGTGAGTCGGAGGTCTGGGAAAAGATGCAGAAAGCA | | | AELSESEVWEKMQK |
| | | | | CCCAACTCTGCGCCTGGTGCGGACAGGATCACCATTCGTATGGTGCGGA | | | APNSAPGADRITIRM |
| | | | | TGGCAGATCCAGGTGCGATGATTCTCACCAGGTTCTACCGTGCCTGTCT | | | VRMADPGAMILTRF |
| | | | | ACTAAGAAAATGGGTGCCCCTGCAATGGAAGCAATCCGTGTGCAAGCTC | | | YRACLLRKWVPLQW |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTTTATAAGGACGGGGATAAGGAGCGCCTCGCCAACTGGCGGCCTATC | | | KQSVCKLLYKDGDKE |
| | | | | GCCCTGGAGCCCGTGTTACAGCGGGTGCTCAGTGCGGTAGTCGCCAGC | | | RLANWRPIALEPVLQ |
| | | | | AGAGTGACGAACTGGGCGAGGGCAAACGGGTTGATTTCCTTGGAAGCC | | | RVLSAVVASRVTNW |
| | | | | CAGAAAGGCTTCCAGCCAGCTGATGGTACCTCCGAGCACAATTTCGTCA | | | ARANGLISLEAQKGF |
| | | | | TGGAGGTTGCAATTCAAGAGGCAAGACGCACTAATGCACAGCTTGCCAT | | | QPADGTSEHNFVME |
| | | | | CAGCTGGTTAGACATCTCCAACGCCTTTGGCACAGTGTCGCACCAATTGT | | | VAIQEARRTNAQLAI |
| | | | | TGTTTTCGTTGTTGGAGCGCTATGGGCTGGACCCGACTTTTACCAGTTTT | | | SWLDISNAFGTVSHQ |
| | | | | ATCCAGAATTTGTATAAAGACGCGACCATTGTAGTCAAAGGCGCCAATG | | | LLFSLLERYGLDPTFTS |
| | | | | GAACCCACGTTACCGCGCGCTGGTCAGTCGGAGTACGCCAAGGTGACC | | | FIQNLYKDATIVVKGA |
| | | | | CTTGCAGTGGTATCTTGTTTTGTTTGTTTGTTGAGCCACTCTTGCGGTCA | | | NGTHVTARWSVGVR |
| | | | | GTCTTACCATCTTTACCGTGTGAGGCGGAAACGACTGCGGTTAACGTGT | | | QGDPCSGILFCLFVEP |
| | | | | TAGGACAGCCGATCACAGCGCTGGCTTACGCTGATGACATCGCGCTGTT | | | LLRSVLPSLPCEAETT |
| | | | | CGCCCCATCCATCGGGGTTATGCAACAACAGCTGTGCAAAATCCAGGGC | | | AVNVLGQPITALAYA |
| | | | | ATGGCCAGCGCCATGGGCTTTCGGTTCAACCCGAAGAAGTGCGCGTCCC | | | DDIALFAPSIGVMQQ |
| | | | | TGTACTTGAATCGTGCAGTAGTGAATGCCGCAACATTCACGATAAGCGG | | | QLCKIQGMASAMGF |
| | | | | GGAGGAAATACCTGCTCTCGTACACGGGGACACTTTTCGCTATCTTGGA | | | RFNPKKCASLYLNRA |
| | | | | GTAGCCGCTGGGCTGGGTAAACCCCAGACTCCTTTCTCATTACTGCGTG | | | VVNAATFTISGEEIPA |
| | | | | AGAACCTCCGAGAAGCGGAACTTATATTCCGGTCAAAGCTGGCTCCGTG | | | LVHGDTFRYLGVAAG |
| | | | | GCAGAAGATGGATGCGTACCGGACTTACGTACTGCCACGTTTGACATTT | | | LGKPQTPFSLLRENLR |
| | | | | CAGCTTATGATTGCTAAATTTAACAACATCAAGCAATCGGCCGGGCAGT | | | EAELIFRSKLAPWQK |
| | | | | ATGACCGCGCAATATTGAGGCTCGTGAAGCGTTGCTTCCAGCTTCCGGT | | | MDAYRTYVLPRLTFQ |
| | | | | GGAGACGTCCACCGACTTCATTAGAGCCCCCAGACAGTGTGGTGGTCTG | | | LMIAKFNNIKQSAGQ |
| | | | | GGCGTGCCATCATTGCGTGAGTTGTACGCAACCGCAAAGGTTTCGCGG | | | YDRAILRLVKRCFQLP |
| | | | | GCACTCAAGATGCTCTGGTCTCCCTGTCGGGTAGTCTCGAGCCTGGCAG | | | VETSTDFIRAPRQCG |
| | | | | CCAGTCAGCTTCAGCGAGTTGCGTCCGCGTACTTTGCGAAGAGGTTGAG | | | GLGVPSLRELYATAK |
| | | | | AGATGTTGAGGCGGCTGACCTCTCTACCTTCATGAACGCCGCGCGATCT | | | VSRALKMLWSPCRV |
| | | | | ACGCCGCTAGATCGGTCAGGGTATCCGACTTGCTTGTGGATGGACGCAC | | | VSSLAASQLQRVASA |
| | | | | GCAAGCAGATGTCGTACCTGACAAAGGTAGCCGGCGTTGACTGTTACTT | | | YFAKRLRDVEAADLS |
| | | | | CCTCGTTGGCGAGGCTGGGACCTCTTTCTTCATCCGGAATGGCCTCGGT | | | TFMNAARSTPLDRSG |
| | | | | CAGACGGTCTCAGTTCTAAGCCCCTTGAGGAAGAACAAAGTTATGAGCG | | | YPTCLWMDARKQM |
| | | | | TTTTAGGGGGGGCGATCCAAACTCGCCATCTGGACGCCTGGCTCCAATG | | | SYLTKVAGVDCYFLV |
| | | | | CAAGCGCCAAGGTAAGACTGCGAGCTGCATTGTGCTCGACCGGTCATCC | | | GEAGTSFFIRNGLGQ |
| | | | | TCCCGTTTTATAACGACCGGACGGTACACCAGCTTTGCAGCTATGCGCTT | | | TVSVLSPLRKNKVMS |
| | | | | TGCGTTGCCCGCTCGCCTGGATTTGTTACCTTGCCGGGCGAGATCCTCTA | | | VLGGAIQTRHLDAW |
| | | | | TGCGTTCGTACCAGAACTGTCGGCGGTGCGGTTACGACCGAGAGACCCT | | | LQCKRQGKTASCIVL |
| | | | | GCCGCACATCCTTCAGCACTGTCGGCAGTTCAGCGCCCCCGCTTACCAG | | | DRSSSRFITTGRYTSF |
| | | | | GCCCGGCATGACGCAGTTCAGGGACGCCTGGAAACGGTCATGCGTAGG | | | AAMRFALPARLDLLP |
| | | | | CGGTTCCCCAACCTCCGCGTAAACCGGGCTCTACCGGAGATTGGGTCGA | | | CRARSSMRSYQNCR |
| | | | | ACAAGCGGCCTGATCTAGTGGTCGTTGACGAGGAAAAGCGGTTAGTGA | | | RCGYDRETLPHILQH |
| | | | | TTCTGCTTGATATCGCAATCGTGTTTGAAAACACTGCCGCTGCCTTCGTC | | | CRQFSAPAYQARHD |
| | | | | GATGCCCGGACCAGGAAGTGGGCGCACTATGAAAAGGAGATCCTCGCC | | | AVQGRLETVMRRRF |
| | | | | TACCGGCTACGAGGATACTCCGTGACGTACGACGCCATCGTCGTCGGTG | | | PNLRVNRALPEIGSN |
| | | | | CTCTGGGGACGTGGGACCCGAAGAACGATGCCATCCTGAAAAGGATCG | | | KRPDLVVVDEEKRLVI |
| | | | | GTGTCGTCTCCCAAAGGTACCTACGGCTCATGAAGGTTCTCGTGGTGTC | | | LLDIAIVFENTAAAFV |
| | | | | CGAGATGTTGGAACATTCTTCACGGATCTACAGAAAACACCTCGGCCTG | | | DARTRKWAHYEKEIL |
| | | | | CGAGACCTTCTCCCGGACACCGGCACGAAACGGCGACCGGTTGGCACG | | | AYRLRGYSVTYDAIVV |
| | | | | ACGGAGACAGACCCACCCGGTGGTGATCTCCGTCAGAAGAAGCGCAAT | | | GALGTWDPKNDAIL |
| | | | | ACCATCAGCGCTAGGGCATCAGGTGGGAAATGCCTGGAACGGCGGTTC | | | KRIGVVSQRYLRLMK |
| | | | | ACGTCACCCGTCGGGACGCCCTCGCAGCGTGGTGAGCTGCAGTGCCAA | | | VLVVSEMLEHSSRIYR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCGTGCCCTGGCCCTAGAAGACCCGCCCTCGCTGGAATAGCGCCCAACC | | | KHLGLRDLLPDTGTK |
| | | | | CGCCTAGTCTCCAGCCCAGAAAACCACCCCCGCGGCAACACCAGAAGCC | | | RRPVGTTETDPPGGD |
| | | | | GGTTACGAAGTCTACAGCGCATTGATCCGTCCCGAACCAACGGAACCAC | | | LRQKKRNTISARASG |
| | | | | ATTGCCGCATGACTTCGATTTCGCTTTTGCTCTTTTTGTATTTAATTTTGCT | | | GKCLERRFTSPVGTPS |
| | | | | ATTAACAATTCAGTTTGTTAACTGTTTTGTATTCATTTGAAGATCCAAATA | | | QRGELQCQPCPGPR |
| | | | | AAAC (SEQ ID NO: 1072) | | | RPALAGIAPNPPSLQ |
| | | | | | | | PRKPPPRQHQKPVTK |
| | | | | | | | STAH (SEQ ID NO: |
| | | | | | | | 1440) |
| NeSL | Utopia- | — | *Chelonia* | GGCAGAAACTGCACSTTCTAGAAGACTCACTGCCTATCCTGAGGAAGAC | GGCAGAA | TGAGCT | MLQLRLPTPQTLRLL |
| | 2_CMy | | *mydas* | TACCGCTTTGGAGATGGATTCTACTGCCGCTGCTTCAAAAGAAAATCTTC | ACTGCACS | GGAGTG | HPSQLPQSHSTKRW |
| | | | | ATGCTGCTTCGGAGGCTCCAGGACAGASTGAGAAGATGATCGCTCCCTC | TTCTAGAA | CCGATG | SNIYEERARAPKDTTI |
| | | | | GCCGATTCCACAGAAACCTTCAACTGCCGCTCGGACCGCTGCTGCTCCA | GACTCACT | AGAAGC | ERVSAASKIPKLDPAK |
| | | | | CGGAGCGCCCATCGGGGAACAGCCTCTAAGAGACCCTCAGCGCTTCCA | GCCTATCC | GCAGTC | RRIGAPLQLMQGNSI |
| | | | | GGACATCGCAGATGAGCAGCATCGATTGGAAAAGCAGCGCCTCCCTGA | TGAGGAA | GGGAAA | SRQLSASSQYVQHN |
| | | | | AGAAAACCCGTGGAGATGCTGCTGCAGGGAWATCTTGCACCTCGAGGA | GACTACCG | GTAACT | AVVRRVSAPPHTGNF |
| | | | | CGGCCTCCCAGGACATCGCAGCCAGGACAAACATCATCTCGCCTGCTCT | CTTTGGAG | GAAATA | TGSCRRKLALPHRPP |
| | | | | TCAGGASAAGGATGCCMSAAGAACTTMTCCCACCTCCTCMACTGCCCA | ATGGATTC | CTTTCCT | SETQPAESYLHCWTT |
| | | | | GGATCCTSATGCTGGTCGTCGTCCTGCTGTGCTGGAAGMKACCCCAACT | TACTGCCG | CATGGA | QRDPTLADQHGLQD |
| | | | | GGCGAGACCTCAGAAACCACCCAGMWGGACCKCAACATCTCACTAGAT | CTGCTTCA | TTGTATT | HPTGLPPEGSHCIKD |
| | | | | GCCTGCCCAGCCGAACCTCTCCATGCWACTCTCCCAGAGCAACSAGAAC | AAAGAAA | TTCTAAA | PRQNSSTEGQRRSG |
| | | | | CATCCAGMGAATCCGCTGATATGACTGAAGCCMATCCAACAGAGGGA | ATCTTCAT | TGGACA | NSQARRIPKRASTAA |
| | | | | GAAGGAAAGGAGAATGACTGCATCTATCTCCAGTATCCCCTCCCTACGG | GCTGCTTC | ACCTACC | SKTVLPKRTSAALKSV |
| | | | | ACACGCTCCTCTKCCCCTTCCGCTATCCGAGGGTTCCAGTACATTGGCAG | GGAGGCTC | TAATTCT | REDTALVLEDPAKWS |
| | | | | TCTCAGCAMACACCTCAAGAGAATCCATASCAAGCGGATCACCTTCCGG | CAGGACA | CAATTAC | SQHREGXRQQANPT |
| | | | | TGTGCCCTCTSCGACCTGCCTTTCGAGACGCAGATGAAATGTAAGTCTCA | GASTGAGA | TGAGGG | AVFQPEPAEIEQQPX |
| | | | | TCAAGTCACCTGCAAAGGACATCTCGAACTGGAAGAGTCCAACTTTACC | AGATGATC | ACAATCT | VRAATPWQAAWME |
| | | | | AGTCTATGTTGCCGCCACCCCATCTCTGCTCCGAAAGCAGAAACACCACA | GCTCCCTC | CCACTCA | ELARTASFXDFDLLVD |
| | | | | TGCTCCAGCTCCGGCTTCCGACTCCCCAAACACTCCGGCTACTGCATCCC | GCCGATTC | TTGATAT | RLTKDLSAEIVSGRKG |
| | | | | AGCCAACTCCCCCAGAGCCACAGCACGAAGAGGTGGTCCAACATCTATG | CACAGAAA | ATTTTGC | TQENTPTAHRQNQN |
| | | | | AGGAAAGGGCCCGGGCGCCCAAGGATACTACCATTGAAAGAGTAAGTG | CCTTCAAC | TTTCCAC | NMREARRRNISRCYD |
| | | | | CTGCCTCAAAAATCCCTAAGCTGGACCCTGCCAAGAGGAGGATCGGCG | TGCCGCTC | AACCAA | PAAASRIQKLYRSNR |
| | | | | CTCCCTTGCAGCTTATGCAAGGCAACTCCATCTCCAGACAGCTTAGTGCT | GGACCGCT | ATCTCTG | PKAMREILDGPSSYC |
| | | | | TCCTCGCAGTATGTCCAGCACAACGCCGTCGTCAGAAGGGTCAGCGCCC | GCTGCTCC | TACAACT | AIPSERLFLYFKGVFD |
| | | | | CTCCACACACGGGTAACTTCACGGGATCCTGTCGTCGGAAGCTAGCACT | ACGGAGC | TTTCATG | RVAQNDMQRPECLX |
| | | | | ACCTCACAGGCCACCCAGCGAGACCCAGCCAGCGGAGAGCTATCTCCAC | GCCCATCG | AGTGAT | PXPRVDYAEDXEQDF |
| | | | | TGCTGGACCACGCAACGGGACCCCACCCTAGCGGACCAGCACGGCCTC | GGGAACA | GTACCC | TSWEVEARLTKTKNT |
| | | | | CAAGACCACCCAACGGGATTGCCCCCAGAAGGCTCACACTGCATCAAAG | GCCTCTAA | GAGTAC | APGKDGIRYNFLKKR |
| | | | | ACCCCAGACAGAACTCATCCACAGAAGGGCAGCGTCGCTCCGGAAACTC | GAGACCCT | TTGGATT | DPGCLVLTAIFNKCK |
| | | | | CCAAGCAAGACGCATCCCTAAAAGGGCCAGTACCGCTGCCTCTAAAACT | CAGCGCTT | CTAATAT | QFRRTPSSWKKSMM |
| | | | | GTCCTTCCTAAAAGGACCAGTGCTGCCCTAAAATCCGTAAGGGAAGACA | CCAGGACA | CTAAACT | VLVYKKGKQDNPNT |
| | | | | CTGCCCTCGTTCTGGAAGATCCGGCCAAATGGAGTTCTCAACACCGGGA | TCGCAGAT | GTATTGT | RRPISLCSTMYKLYAS |
| | | | | GGGAAAWAGGCAACAGGCTAATCCCACAGCAGTTTTCCAGCCTGAGCC | GAGCAGC | TAAATCT | CLAARITDWSVNGG |
| | | | | TGCGGAGATTGAGCAGCAGCCCWCGGTGAGGGCCGCCACACCATGGC | ATCGATTG | ATTCACC | AISSIQKGFMSCKGC |
| | | | | AAGCCGCTTGGATGGAGGAGTTGGCGAGGACAGCCTCCTTCGAKGACT | GAAAAGC | TAAATTT | YEHNFVLQTAIHMAR |
| | | | | TTGACCTCCTTGTAGACAGACTCACTAAAGACCTGTCTGCAGAAATTGTA | AGCGCCTC | GGGTTA | RAWRQCAIAWLDLA |
| | | | | TCTGGGAGGAAGGGAACTCAGGAGAACACACCAACTGCKCACAGACAG | CCTGAAGA | TTGCTG | NAFGSMPHQHIFDM |
| | | | | AACCAAAACAACATGAGGGAAGCCAGGAGAAGGAACATCAGTCGCTGC | AAACCCGT | ATTATGT | LREFGMPENFLQLVR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TATGACCCAGCAGCAGCATCCAGGATCCAGAAGCTCTACCGGTCAAACC | GGAGATG | ACTCTAT | ELYEGCTTTICSMEGE |
| | | | | GCCCTAAGGCTATGAGAGAGATCCTCGATGGGCCCTCATCCTACTGCGC | CTGCTGCA | GTATCAT | TPEIPIRSGVKQGCPL |
| | | | | AATCCCGTCCGAGAGACTATTCTTGTACTTCAAGGGGGTGTTTGACCGT | GGGAWAT | ATGACTT | SPIVENLAMEPLIRAIS |
| | | | | GTAGCTCAGAACGACATGCAGCGTCCAGAGTGCCTTCAKCCTTWACCCC | CTTGCACC | TTAAAA | SGLGGFDLYDNRVNI |
| | | | | GGGTTGACTATGCAGAGGACCWGGAACAAGACTTTACATCATGGGAA | TCGAGGAC | ACAAAC | LAYADDLVLIADNPES |
| | | | | GTAGAGGCCAGACTTACAAAGACCAAAAACACAGCCCCAGGAAAAGAT | GGCCTCCC | TTTGTAT | LQQMLDITSQAANW |
| | | | | GGCATTCGCTACAACTTCCTGAAAAAACGAGACCCCGGTTGCCTGGTAC | AGGACATC | TTGTGG | MGLRFNARKCASLHI |
| | | | | TAACTGCCATTTTCAACAAATGCAAACAGTTCCGCCGTACTCCCAGCTCC | GCAGCCAG | ATAATCT | DGSRRDSVQATSFQI |
| | | | | TGGAAGAAATCTATGATGGTGCTCGTCTACAAGAAAGGCAAGCAAGAC | GACAAACA | AAGCAC | QGEPMIFLEDGQAY |
| | | | | AACCCCAACACTCGGAGACCCATCTCTCTCTGTTCCACCATGTACAAACT | TCATCTCG | TATACCC | QHLGTPTGFRVQQT |
| | | | | GTATGCCAGCTGCCTTGCGGCTAGGATCACAGACTGGTCGGTGAACGG | CCTGCTCT | AGATGT | PEDTIAEILRDVARIDS |
| | | | | AGGAGCCATCAGCTCCATCCAGAAAGGCTTCATGTCATGCAAAGGCTGC | TCAGGASA | ACAGAC | SLLAPWQKINALNTF |
| | | | | TACGAACACAACTTTGTCCTTCAGACTGCCATCCACATGGCCAGGAGGG | AGGATGCC | ACTCTTT | LIPRISFVLRGSAMVK |
| | | | | CATGGAGGCAATGTGCCATAGCATGGCTCGACCTGGCTAATGCTTTTGG | MSAAGAA | TCCCAAC | VPLNKADNTIRQLVK |
| | | | | ATCGATGCCCCACCAGCACATTTTTGACATGCTGCGAGAGTTCGGGATG | CTTMTCCC | CTATGTA | KWMFLPQRASNELV |
| | | | | CCTGAAAACTTTCTCCAACTGGTCCGGGAACTGTATGAAGGCTGCACCA | ACCTCCTC | TTATATT | YISHRQGGANVPRM |
| | | | | CCACCATCTGCTCCATGGAAGGAGAGACACCCGAAATTCCTATCCGTAG | MACTGCC | TTTTTAA | GDLCDVAVITHAFRL |
| | | | | CGGCGTGAAGCAAGGCTGCCCCCTGAGCCCCATCGTTTTCAACTTAGCC | CAGGATCC | CATTAG | LTCPDAMVRNIAESA |
| | | | | ATGGAGCCGCTCATTCGAGCGATCTCCAGCGGTCTAGGCGGTTTCGATC | TSATGCTG | CTTTAAT | LQDAVKKRIARTPSN |
| | | | | TGTATGACAACAGAGTGAATATCCTGGCCTACGCAGACGATCTGGTCCT | GTCGTCGT | AAAATTT | QDVATYLSGSLEGEF |
| | | | | GATCGCAGACAACCCCGAGAGTCTCCAACAAATGCTTGACATCACCAGC | CCTGCTGT | TTAAA | GRDGGDFASLWTRA |
| | | | | CAGGCTGCCAACTGGATGGGACTCCGCTTCAATGCCAGGAAGTGTGCAT | GCTGGAA | (SEQ ID | RNATRRLEKRIGCHW |
| | | | | CCCTGCATATCGATGGCAGTAGAAGGGATTCGGTCCAGGCGACGTCTTT | GMKACCC | NO: | TWCEERQELGVLVP |
| | | | | TCAGATCCAGGGTGAACCCATGATCTTCCTCGAGGACGGGCAAGCGTAC | CAACTGGC | 1319) | QVKNTDHTIITPRART |
| | | | | CAACATCTCGGCACGCCGACGGGTTTCCGCGTCCAGCAGACACCTGAGG | GAGACCTC | | MLERTLKDAIRCQYV |
| | | | | ATACCATCGCGGAGATCCTACGAGATGTGGCCAGGATCGACTCCTCCCT | AGAAACCA | | ENLKRKPDQGKAFEV |
| | | | | ACTGGCACCATGGCAGAAGATCAACGCCTTGAACACCTTCCTGATCCCC | CCCAGMW | | TCKWDASNHFLPGG |
| | | | | CGTATCTCATTCGTCCTGAGGGGATCTGCCATGGTGAAGGTACCTCTGA | GGACCKCA | | SFTRFADWRFIHRAR |
| | | | | ACAAGGCAGACAACACCATCCGGCAGCTGGTGAAGAAGTGGATGTTTC | ACATCTCA | | LNCVPLNGAVRHGN |
| | | | | TTCCCCAGAGGGCCAGCAATGAACTGGTGTACATCTCGCACAGGCAGG | CTAGATGC | | RDKRCRKCGYANETL |
| | | | | GCGGTGCCAACGTCCCTCGAATGGGTGATCTGTGCGACGTTGCCGTGAT | CTGCCCAG | | PHVLCSCKPHSRAW |
| | | | | CACTCATGCCTTCCGCCTTCTGACGTGCCCGGATGCCATGGTGAGGAAC | CCGAACCT | | QLRHNAIQDRLARAI |
| | | | | ATCGCGGAGAGTGCTCTGCAGGATGCCGTCAAGAAGCGAATCGCCAGG | CTCCATGC | | PPPVGKVAVNSAIPG |
| | | | | ACCCCCTCCAACCAAGATGTTGCCACCTACCTGAGCGGCTCGCTGGAAG | WACTCTCC | | TDSQLRPDIVITNEDR |
| | | | | GCGAATTTGGAAGAGACGGGGGAGACTTTGCTTCGCTCTGGACTCGTG | CAGAGCAA | | KKIIMVDVTVPFENR |
| | | | | CCCGCAATGCTACGCGACGACTGGAGAAGCGTATCGGCTGCCACTGGA | CSAGAACC | | TPAFHDARARKVEKY |
| | | | | CGTGGTGCGAGGAACGCCAGGAGCTGGGAGTCCTGGTGCCACAGGTG | ATCCAGM | | APLAETLRAKGYQVQ |
| | | | | AAGAACACAGATCACACTATCATCACTCCGAGAGCTAGAACCATGCTGG | GAATCCGC | | THALIVGALGAWDPS |
| | | | | AGAGGACCCTGAAGGATGCCATCCGCTGCCAATACGTGGAAAACCTGA | TGATATGA | | NERVLRECGIGQRYA |
| | | | | AACGGAAGCCGGACCAGGGCAAGGCATTCGAGGTGACGTGCAAGTGG | CTGAAGCC | | RLMRQLMVSDAIRW |
| | | | | GATGCCAGCAACCACTTCCTCCCCGGGGGCAGCTTCACCCGATTTGCCG | MATCCAA | | SRDIYIEHITGHRQYQ |
| | | | | ACTGGAGGTTCATCCACAGGGCCCGGCTCAACTGCGTCCCGCTGAACGG | CAGAGGG | | EG (SEQ ID NO: |
| | | | | AGCCGTCCGCCACGGGAATCGGGACAAGCGATGCAGGAAGTGCGGCT | AGAAGGA | | 1441) |
| | | | | ATGCCAACGAGACGCTACCCCACGTCCTGTGTAGCTGCAAGCCCCATTC | AAGGAGA | | |
| | | | | CAGAGCCTGGCAGCTGCGACACAACGCCATCCAAGATCGCCTGGCCAG | ATGACTGC | | |
| | | | | AGCCATCCCGCCACCCGTGGGGAAGGTTGCCGTAAACTCCGCCATCCCC | ATCTATCT | | |
| | | | | GGAACCGACAGCCAACTGCGACCGGACATCGTCATCACCAACGAGGAC | CCAGTATC | | |
| | | | | CGGAAGAAGATCATCATGGTGGACGTCACAGTGCCCTTCGAGAACAGG | CCCTCCCT | | |
| | | | | ACCCCAGCCTTCCACGATGCCCGAGCTCGAAAGGTGGAGAAATATGCCC | ACGGACAC | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTCTGGCCGAAACCTTGAGAGCTAAGGGTTACCAGGTCCAGACACACGC<br>GCTGATCGTCGGAGCCTTGGGCGCATGGACCCCAGTAACGAGCGAGT<br>GCTGAGAGAATGCGGAATCGGTCAACGCTACGCTCGGCTGATGCGGCA<br>ACTCATGGTGTCAGATGCCATCAGGTGGTCGAGGGACATCTACATAGAA<br>CACATCACCGGACATCGGCAATACCAGGAGGGATGAGCTGGAGTGCCG<br>ATGAGAAGCGCAGTCGGGAAAGTAACTGAAATACTTTCCTCATGGATTG<br>TATTTTCTAAATGGACAACCTACCTAATTCTCAATTACTGAGGGACAATC<br>TCCACTCATTGATATATTTTGCTTTCCACAACCAAATCTCTGTACAACTTT<br>TCATGAGTGATGTACCCGAGTACTTGGATTCTAATATCTAAACTGTATTG<br>TTAAATCTATTCACCTAAATTTGGGTTATTGCTGATTATGTACTCTATGTA<br>TCATATGACTTTTAAAAACAAACTTTGTATTTGTGGATAATCTAAGCACT<br>ATACCCAGATGTACAGACACTCTTTTCCCAACCTATGTATTATATTTTTTT<br>AACATTAGCTTTAATAAAATTTTTAAA (SEQ ID NO: 1073) | GCTCCTCT<br>KCCCCTTC<br>CGCTATCC<br>GAGGGTTC<br>CAGTACAT<br>TGGCAGTC<br>TCAGCAM<br>ACACCTCA<br>AGAGAATC<br>CATASCAA<br>GCGGATCA<br>CCTTCCGG<br>TGTGCCCT<br>CTSCGACC<br>TGCCTTTC<br>GAGACGC<br>AGATGAAA<br>TGTAAGTC<br>TCATCAAG<br>TCACCTGC<br>AAAGGAC<br>ATCTCGAA<br>CTGGAAGA<br>GTCCAACT<br>TTACCAGT<br>CTATGTTG<br>CCGCCACC<br>CCATCTCT<br>GCTCCGAA<br>AGCAGAA<br>ACACCAC<br>(SEQ ID<br>NO: 1196) | | |
| NeSL | Utopia-<br>2_PCa | — | *Phytophthora capsici* | ACCGCCCAAGTCTCCACCGCAGCTGCGACTGCTGCTGCTCATCGAGCCG<br>CAGTAGTCGCAGCTGTACAAGCACCACCTCCTACCGGACGCGCCGTCGT<br>GGAGCACCACGCGCGCGCTGAGCCGCNTCAAGACCAAGAATTCCAGGC<br>TCGCGCGCGCGTGGCGCTTCAAGATGGCGACGCGACCAGCAGGAGTGG<br>CCGCTCTACTGACGGCGGAGACGAGGCCAAGACCGAGGACAGCGACGC<br>GGACGCAGCCAAGCGCCAAGCCGCTCAAGCAGCACCGAGACCCCATAC<br>CCMGGACACCGCGCCGTACGACGGCCACAGGGACTCGGTGCTGGCTGT<br>GTACGCACACAACGCACCTGCATTCACCTGCGCGTTGTGTGTGTACACA<br>GCACGCAACTTCGCCGAGCTGACCAAGCATCGCCATGCAGCGCATCGTC<br>ACACCCGCTTCGTGGATCACTTCCACAGCGGGTGCACGTGTGGCATCGG<br>CTTCCAGTCGCGCGCGGCAGCTACGCGACACGCTCAAGCCTGTGCAGAC<br>AGCACACACGCCACCGTAGCTGCCTCGCGCGACCCGGCMNCCASTGCSS<br>CCSGNGCCGGMAGCGASGAGGAGGACCNCGCACCCCCCGGTCCTCTSS<br>TCGCGGCAGCATCTGCAGCTGCAGCAGCCGCATCAAGCGCCACTCCAGC<br>TGCAGATACTGCCACCACGCAGAGCGCCGTGCCCATCGCTACTCCTGGG | ACCGCCCA<br>AGTCTCCA<br>CCGCAGCT<br>GCGACTGC<br>TGCTGCTC<br>ATCGAGCC<br>GCAGTAGT<br>CGCAGCTG<br>TACAAGCA<br>CCACCTCC<br>TACCGGAC<br>GCGCCGTC<br>GTGGAGC<br>ACCACGCG<br>CGCGCTGA | TAAGCT<br>GGTCAT<br>TTGACC<br>GACAGG<br>GCACTA<br>CCCAGG<br>TAGGGA<br>ACCGCC<br>CTTCAG<br>AAACCC<br>AGGAAG<br>ACACAA<br>ACACCCT<br>CCCTTTA<br>GTGACA | MQDMEEELLLDVEM<br>ETETTEPQTSTAXDA<br>TTTTDRPTRWGPHP<br>RAVAAAAIAQLVTGE<br>XAXPALPSRQDRRPA<br>PRSHAPTRSRWGPR<br>HQAVGAAAIASLATG<br>LPASAAPVSRATKHG<br>EGRRRLQTRWGPRV<br>SIPRAARRPGSRWGP<br>PRAAGASGQLPASAS<br>GATGQLPEHVEAITT<br>TPRVASDADEGPTPP<br>DPWILRFDGACRRN<br>PGPGGAGAALFKPS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCCCAGTACGCCCCCCACGTGCTGGAGCCACCTCCAGAGCTCCGAGTTT | GCCGCNTC | TACATAT | GAVVWTCSHYMPSS |
| | | | | CCGGCAAACGCCGMCGCCTCAACACGCCGATCGACCTGCAGCCGCTGG | AAGACCAA | TTTAGG | NETNNTAEYTALLLG |
| | | | | ACGTGGACGCGCTGATGCAGGACATGGAGGAGGAGCTGCTCCTGGAC | GAATTCCA | CTACATT | VQSAVHHGATRLDIE |
| | | | | GTGGAGATGGAGACGGAGACGACGGAACCGCAGACCTCGACGGCCAM | GGCTCGCG | TCAGTTA | GDSSLVIAQVKGTFA |
| | | | | GGACGCCACCACCACCACGGACAGGCCAACACGATGGGGCCCCCACCC | CGCGCGTG | CGGAGA | CRNAKLRQLRNRVR |
| | | | | CAGAGCAGTGGCGGCTGCAGCCATMGCGCAGCTGGTGACCGGCGAGS | GCGCTTCA | GGTTAC | HALRSVEKYTLRHIDR |
| | | | | CAGCAGMTCCAGCTCTGCCTTCGAGACAGGACCGCCGCCCAGCACCAC | AGATGGC | TAACTG | KANAHADRLANRAL |
| | | | | GATCCCACGCACCCACCCGGTCTCGATGGGGACCGCGCCATCAAGCTGT | GACGCGAC | GTAAAT | DRRSSSSECEPHGSC |
| | | | | CGGTGCCGCAGCCATCGCGTCGCTAGCTACAGGACTACCGGCCTCTGCG | CAGCAGG | AAAAAG | MERCCGTDTTPAVQ |
| | | | | GCACCCGTGTCTCGCGCAACCAAGCACGGGGAAGGACGACGCCGTCTC | AGTGGCCG | CACTTT | GPTPQAAAAVPVQV |
| | | | | CAGACACGATGGGGACCTCGGGTGAGCATCCCACGAGCCGCACGCCGT | CTCTACTG | (SEQ ID | WPQWQRQTMVAW |
| | | | | CCAGGATCGAGGTGGGGACCTCCACGCGCGGCAGGGGCCTCTGGCCAA | ACGGCGG | NO: | TTSHGGRCRDCSTRC |
| | | | | CTTCCTGCCAGCGCCTCCGGGGCCACTGGCCAACTTCCGGAGCATGTGG | AGACGAG | 1320) | GRSLPSLAHRPRLSPR |
| | | | | AGGCCATCACCACGACACCACGTGTGGCATCGGACGCTGATGAAGGAC | GCCAAGAC | | RQPRLRLRQLSDEER |
| | | | | CGACACCGCCGGATCCGTGGATACTCCGCTTCGACGGCGCATGCAGGC | CGAGGAC | | DXAADALQELSDVM |
| | | | | GTAACCCCGGACCGGGCGGTGCAGGTGCTGCATTGTTTAAGCCGAGTG | AGCGACGC | | ASKIVDADSWDTGE |
| | | | | GCGCCGTGGTGTGGACGTGCTCCCACTACATGCCAAGCAGCAACGAAA | GGACGCA | | GYISSIPERIREVLQPY |
| | | | | CCAACAACACCGCCGAGTACACGGCACTGCTGCTGGGCGTACAGAGCG | GCCAAGCG | | TTRPPRPGHQQQQR |
| | | | | CGGTCCACCACGGTGCCACTCGCCTAGACATCGAGGGCGACAGCAGCC | CCAAGCCG | | RRPPRVTRNQREHRL |
| | | | | TGGTGATTGCCCAGGTCAAGGGCACATTCGCGTGCAGGAACGCGAAAC | CTCAAGCA | | DEALDDMQATQQA |
| | | | | TCCGGCAGCTCCGCAACCGCGTCCGGCATGCGCTCCGCTCCGTGGAGAA | GCACCGAG | | APRDQRAIHRARRRV |
| | | | | GTACACCCTCCGCCACATCGACCGCAAGGCCAACGCCCACGCAGACCGT | ACCCCATA | | GRVRASMAKQELRQ |
| | | | | CTGGCCAACCGCGCGCTGGACCGGCGGTCGAGCAGCAGCGAGTGCGA | CCCMGGA | | AFAKDESKCVSKILAG |
| | | | | GCCACACGGCTCGTGCATGGAGCGATGCTGTGGCACCGACACGACACC | CACCGCGC | | ASAETAAEEHVDECP |
| | | | | AGCGGTGCAAGGACCGACACCGCAAGCAGCAGCAGCAGTGCCAGTGCA | CGTACGAC | | IDAATLHAHFTGTNA |
| | | | | GGTGTGGCCCCAGTGGCAGCGGCAGACGATGGTAGCGTGGACGACGA | GGCCACAG | | PRTDFDYDAACGQEF |
| | | | | GCCATGGAGGTCGATGCCGAGATTGCAGCACGAGATGCGGGCGAAGC | GGACTCGG | | RGALDSMQPPTVAT |
| | | | | CTTCCCAGTCTTGCCCATCGGCCCAGGCTCAGCCCCAGGCGGCAACCTC | TGCTGGCT | | DAFEEELTIDEVEDQL |
| | | | | GGCTTCGACTGCGCCAACTCAGCGACGAGGAACGCGACRMAGCAGCG | GTGTACGC | | TRAAKTSSPGHDGIG |
| | | | | GACGCCCTCCAGGAGCTTAGCGACGTCATGGCCAGCAAGATCGTTGAC | ACACAACG | | YDIYSRFAAQLVPLLH |
| | | | | GCAGACAGTTGGGACACCGGCGAAGGCTACATCAGCTCCATACCGGAG | CACCTGCA | | AAYQFCWLHRRVPA |
| | | | | CGCATCCGAGAGGTGCTGCAGCCGTACACCACGCGACCACCACGGCCT | TTCACCTG | | LWKLGIVRLIHKKGD |
| | | | | GGGCACCAGCAGCAGCAACGGCGACGGCCACCACGTGTGACACGCAAC | CGCGTTGT | | PMQPTNWRPICLQP |
| | | | | CAGCGCGAACACCGGCTAGACGAAGCGCTGGACGACATGCAAGCCACG | GTGTGTAC | | AIYKIYSGLLARRLSR |
| | | | | CAGCAAGCAGCACCGCGGGACCAACGGGCGATACATCGAGCGCGGCGT | ACAGCACG | | WMEQNQRLPMAQ |
| | | | | CGCGTCGGGCGTGTCCGGGCATCGATGGCCAAGCAAGAGCTACGGCAG | CAACTTCG | | KGFRAFNGCHEHNF |
| | | | | GCGTTCGCCAAGGACGAGTCCAAGTGTGTGTCCAAGATATTGGCCGGT | CCGAGCTG | | VATTLLDQTRRSHRR |
| | | | | GCCTCGGCGGAGACAGCGGCGGAAGAGCACGTCGACGAGTGCCCGAT | ACCAAGCA | | LYQVWYDLRNAFGS |
| | | | | TGACGCCGCCACGCTGCATGCCCACTTCACAGGCACCAATGCGCCACGG | TCGCCATG | | LPQQLMWSVLRHLG |
| | | | | ACGGACTTCGACTACGACGCTGCATGCGGTCAAGAATTCCGAGGAGCG | CAGCGCAT | | VDASFIARCKNIYQDS |
| | | | | CTGGACAGCATGCAGCCGCCGACCGTTGCGACCGACGCGTTCGAGGAA | CGTCACAC | | AFVVANAVDGATDP |
| | | | | GAGTTGACGATCGACGAGGTGGAGGACCAGCTTACACGCGCGGCCAAG | CCGCTTCG | | VRQEVGVYQGCPLSP |
| | | | | ACCTCCAGCCCGGGACATGACGGCATCGGCTACGACATCTACAGTCGCT | TGGATCAC | | LLFISALVPLIRRLEKL |
| | | | | TCGCCGCGCAGCTCGTGCCACTGCTCCACGCCGCGTACCAGTTCTGCTG | TTCCACAG | | DGVGVPLAEGVRPC |
| | | | | GCTGCATCGGCGCGTGCCAGCCCTGTGGAAGTTGGGCATCGTCCGCCTC | CGGGTGCA | | ATAYADDIKVFSDSA |
| | | | | ATCCACAAGAAGGGCGACCCGATGCAGCCAACGAACTGGCGACCGATC | CGTGTGGC | | AGIRKCHDAVTRFLE |
| | | | | TGTCTGCAGCCCGCGATTTACAAGATCTACAGCGGACTGCTGGCGCGTC | ATCGGCTT | | WTGLRANPGKCASL |
| | | | | GGCTGTCGCGCTGGATGGAGCAGAACCAGCGACTCCCCATGGCACAGA | CCAGTCGC | | AVTTNARGNPVRDD |
| | | | | AGGGGTTCCGAGCGTTCAATGGTTGCCACGAACACAATTTCGTGGCAAC | GCGCGGC | | GVHLELQGEVIAPLSL |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CACGCTCCTGGATCAGACGCGCCGGTCGCACCGCAGGCTGTACCAAGTC | AGCTACGC | | HDSYRYLGVGDGFD |
| | | | | TGGTACGACCTGCGGAACGCGTTCGGGTCACTGCCGCAGCAGCTCATGT | GACACGCT | | HVRHRLQLEPKLQQI |
| | | | | GGAGCGTGCTCCGCCACCTCGGCGTCGACGCAAGCTTCATCGCCCGGTG | CAAGCCTG | | KREAVALMQSGLAG |
| | | | | CAAGAACATCTACCAAGACTCGGCTTTCGTGGTGGCGAACGCGGTGGA | TGCAGACA | | WQVVKALKTFVYPK |
| | | | | CGGCGCGACGGATCCTGTCCGCCAGGAGGTGGGCGTGTACCAAGGTTG | GCACACAC | | VEYALRHLRPLQSQL |
| | | | | TCCCCTGAGCCCCCTCCTCTTCATCTCGGCGCTTGTGCCGCTCATTCGCCG | GCCACCGT | | QGFDRAVVRGLRHLL |
| | | | | CCTCGAGAAGCTCGACGGCGTAGGGGTGCCGTTGGCCGAGGGTGTACG | AGCTGCCT | | RLPQSATTEFFYTPTS |
| | | | | ACCGTGTGCCACCGCCTACGCCGACGACATCAAGGTGTTCAGTGACAGC | CGCGCGAC | | GGGLGLQSLVEMHQ |
| | | | | GCCGCTGGCATCCGTAAATGCCACGACGCTGTCACTCGTTTCCTCGAGT | CCGGCMN | | ALQVAHAWQMLHS |
| | | | | GGACAGGCCTGCGGGCAAACCCCGGCAAGTGTGCCAGCCTAGCGGTGA | CCASTGCS | | KDAAVVAVAKEQVC |
| | | | | CGACAAACGCCCGCGGCAACCCGGTCCGCGACGACGGCGTGCACCTAG | SCCSGNGC | | QVARKRYRLQEEHW |
| | | | | AGCTGCAAGGCGAAGTCATCGCCCCCCTCAGTCTCCACGATAGCTATCG | CGGMAGC | | RGRGDELVRLFLNSE |
| | | | | CTACCTGGGTGTGGGCGATGGCTTCGACCATGTGCGCCACCGCCTCCAG | GASGAGG | | LAASPFADCLRRNGD |
| | | | | CTTGAACCCAAGCTCCAACAGATCAAGCGAGAGGCGGTGGCGCTGATG | AGGACCN | | IGSLWTDVQRTLRLH |
| | | | | CAGTCCGGACTGGCGGGGTGGCAGGTGGTGAAGGCGCTCAAGACCTTC | CGCACCCC | | HLSLTAQDDRDGQD |
| | | | | GTGTACCCCAAGGTCGAGTACGCGCTGCGCCACCTACGACCACTCCAGT | CCGGTCCT | | PLALRVPHHTKWLD |
| | | | | CCCAGCTCCAAGGCTTCGACCGCGCCGTCGTCCGTGGCCTGCGCCACCT | CTSSTCGC | | HKTVLRHVKLHMKIR |
| | | | | ACTGCGCCTCCCCCAGTCCGCCACCACCGAGTTCTTCTACACACCAACGT | GGCAGCAT | | HQTRWKGLVDQGKT |
| | | | | CTGGAGGTGGGCTGGGGCTGCAGTCCCTCGTGGAGATGCATCAGGCGC | CTGCAGCT | | VRVHGGLGAKFVST |
| | | | | TGCAGGTGGCGCATGCCTGGCAGATGCTCCATTCCAAGGACGCGGCCG | GCAGCAGC | | GAGLSDDAYRFGVK |
| | | | | TCGTGGCCGTTGCGAAGGAGCAGGTCTGCCAGGTAGCACGCAAGCGCT | CGCATCAA | | ARLNQVDTNAVLKR |
| | | | | ACCGCCTGCAGGAAGAACATTGGCGCGGGCGTGGCGACGAGCTCGTGA | GCGCCACT | | KRLRSSKTCRDPTCSS |
| | | | | GGCTCTTCCTCAACTCCGAGCTCGCCGCCTCGCCCTTCGCTGACTGCCTC | CCAGCTGC | | AETLAHALNHCASN |
| | | | | CGCCGCAACGGCGACATCGGATCCCTCTGGACGGACGTGCAGCGCACG | AGATACTG | | MDAIRQRHDDALEQ |
| | | | | CTCCGCCTCCATCACCTCAGCCTGACGGCTCAAGACGACAGAGATGGCC | CCACCACG | | IGSKIRGALERAKSTT |
| | | | | AAGACCCGCTTGCCCTTCGCGTGCCGCACCACACCAAGTGGCTCGACCA | CAGAGCGC | | ELRLNQTVPEYTGAA |
| | | | | CAAGACTGTGCTGCGGCACGTGAAGTTGCACATGAAGATCCGCCACCA | CGTGCCCA | | LRPDIVLRNVAAKKM |
| | | | | GACCCGATGGAAGGGGCTAGTGGACCAGGGCAAGACGGTACGCGTGC | TCGCTACT | | VIADLAVTFEDHAAG |
| | | | | ACGGTGGCCTCGGTGCGAAGTTCGTGTCGACCGGGGGGGGCTGTCGG | CCTGGGCC | | ARHSSLQLSHDHKTL |
| | | | | ACGACGCATACCGGTTCGGCGTGAAGGCCCGCCTCAACCAGGTCGACA | CCAGTACG | | KYQPIVAELRVQGW |
| | | | | CGAACGCCGTGCTCAAGCGCAAGCGGCTGCGGTCCAGCAAGACCTGCA | CCCCCCAC | | QVQTAAIVYGSLGSV |
| | | | | GAGACCCGACCTGCTCCTCGGCCGAGACGCTGGCTCATGCTCTCAATCA | GTGCTGGA | | QPSNFKTYTEKLKLHK |
| | | | | CTGCGCGTCCAACATGGACGCCATCCGCCAGCGTCATGACGACGCCTTA | GCCACCTC | | REARQLDLQLSSHCI |
| | | | | GAGCAGATCGGGTCCAAGATCCGCGGCGCGCTTGAGCGAGCCAAGTCG | CAGAGCTC | | QASHRIWGWHCRR |
| | | | | ACCACAGAGCTGCGCCTGAACCAGACGGTGCCTGAGTATACAGGCGCA | CGAGTTTC | | HREGQRSGNTSRAS |
| | | | | GCTCTGCGACCCGACATCGTCCTGCGGAACGTGGCCGCCAAGAAGATG | CGGCAAAC | | RGSGGTPRRTSQVRA |
| | | | | GTGATCGCCGACTTGGCAGTCACGTTCGAGGACCACGCGGCCGGCGCT | GCCGMCG | | RR (SEQ ID NO: |
| | | | | CGTCACTCCTCGCTGCAGCTCAGCCACGATCACAAGACACTCAAGTACC | CCTCAACA | | 1442) |
| | | | | AGCCAATCGTGGCAGAGCTGCGGGTGCAGGGGTGGCAGGTGCAGACC | CGCCGATC | | |
| | | | | GCGGCGATTGTGTACGGGTCGCTGGGCTCGGTGCAGCCCAGCAACTTC | GACCTGCA | | |
| | | | | AAGACGTACACCGAGAAGTTGAAGTTGCACAAGCGCGAGGCTCGACAG | GCCGCTGG | | |
| | | | | CTGGATCTTCAACTGTCGAGCCACTGCATTCAAGCCAGCCACCGCATCTG | ACGTGGAC | | |
| | | | | GGGCTGGCATTGCCGGCGCCATCGCGAAGGACAACGAAGCGGCAATAC | GCGCTG | | |
| | | | | CTCGCGAGCATCGCGTGGGTCTGGGGGGACCCCGCGGCGCACATCGCA | (SEQ ID | | |
| | | | | GGTAAGGGCACGGCGATAAGCTGGTCATTTGACCGACAGGGCACTACC | NO: 1197) | | |
| | | | | CAGGTAGGGAACCGCCCTTCAGAAACCCAGGAAGACACAAACACCCTC | | | |
| | | | | CCTTTAGTGACATACATATTTAGGCTACATTTCAGTTACGGAGAGGTTA | | | |
| | | | | CTAACTGGTAAATAAAAAGCACTTT (SEQ ID NO: 1074) | | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| NeSL | Utopia- | — | *Phytophthora* | GCTCGGCCTCGCGGCTGCCTTCCCAGGCGCCGCCGACTTCGCGCTCTGG | GCTCGGCC | TAGGCG | MLADPAALAAGLAR |
| | 2_PI | | *infestans* | CGCGGCCCACACGCCGCCGCCGAGCCTCCAAGCGCGCCCGTTGGCTTCC | TCGCGGCT | GAAACC | APPPPSAPQDPSPAF |
| | | | | GCAGACGCAGGGCTCGCGGCGACGGCCCTCGCCAGCCCCCAAGACCCC | GCCTTCCC | AGGCCC | PAGPAGQNPRAAAP |
| | | | | CCCTACGATGTGGCACCACCCGGCAGGGCGGCCGGCAGGCTGCCCGAC | AGGCGCC | AAGACG | ARVEVHTVVAPPGR |
| | | | | TCGGTATCGCCGGGTGCTACACTCTCAGCCGCCACAGCTCGGGCCTTGG | GCCGACTT | GCCGAC | AGGMLPDPGLVDSS |
| | | | | CGGTCCGCCATTGGCCCTTGGAGCTCGACAGCGACAGCAGCGACGACG | CGCGCTCT | AGGGCC | PAAATAATPAPVAAT |
| | | | | AGGACGCTCAAGACCCCCACGCCGCCGCCCCAGGACCCCCCGCAGACGT | GGCGCGG | CCACCC | ATTARAAARVAVEH |
| | | | | CGCGAGTGTGCTTGCCCCACCCGGCAAGGCAGGCAGCATGCTCGCCGA | CCCACACG | AGGTAG | HAHAEPNQEHLPMA |
| | | | | CCCAGCAGCGCTGGCAGCCGGTCTGGCTCGCGCTCCGCCGCCCCCATCG | CCGCCGCC | GGAACC | RVLVEPMQVDECSSC |
| | | | | GCACCCCAGGACCCAAGCCCCGCCTTCCCTGCTGGCCCCGCCGGCCAGA | GAGCCTCC | GCCCTA | DRSTLTADDGSGDD |
| | | | | ACCCTCGCGCCGCCGCCCCAGCCCGTGTTGAAGTCCACACAGTCGTGGC | AAGCGCGC | GAAACC | VAAPSSMLSNDVAA |
| | | | | ACCACCCGGCAGGGCGGGCGGCATGCTGCCCGACCCGGGGTTGGTTGA | CCGTTGGC | CATTTCG | PMDVDSGTSCPPTL |
| | | | | CTCAAGCCCAGCAGCGGCTACCGCAGCTACTCCAGCTCCGGTAGCTGCT | TTCCGCAG | GTGGTC | QQPLQRPRALHVGS |
| | | | | ACTGCTACAACTGCTCGCGCTGCTGCTCGCGTCGCCGTGGAGCACCACG | ACGCAGG | GACTCG | KRRRLDADDGEEAH |
| | | | | CGCACGCTGAGCCGAACCAAGAACATCTACCGATGGCTCGCGTGCTCGT | GCTCGCGG | AAGGCC | QLQEEEEAGIHAPAL |
| | | | | GGAGCCCATGCAGGTCGACGAGTGCAGCAGCTGCGACCGCAGCACTTT | CGACGGCC | TTACCTA | RLSAASAQPASVLAV |
| | | | | GACAGCCGACGACGGGAGCGGTGACGACGTTGCAGCCCCAAGCTCCAT | CTCGCCAG | TTTTTTC | YTHNASRFDCTLCAY |
| | | | | GCTCAGCAACGACGTCGCCGCCCCCATGGACGTTGACTCCGGCACCAGT | CCCCCAAG | CTTAGA | TAGSFASLLTHRNSR |
| | | | | TGCCCTCCAACGTTGCAGCAGCCGCTCCAGCGACCGCGTGCGCTGCACG | ACCCCCCC | CATTCAA | HRRTAFLDRFSAGCA |
| | | | | TAGGCAGCAAGCGCCGCCGACTCGACGCAGATGACGGTGAAGAAGCTC | TACGATGT | TTAGGT | CGVPFASRLAAARHA |
| | | | | ACCAGCTGCAAGAAGAGGAGGAGGCTGGCATTCATGCCCCAGCGCTCA | GGCACCAC | AGCGAC | QACASLSSAPSAEASS |
| | | | | GGCTATCCGCGGCCAGCGCTCAACCGGCCTCCGTCCTCGCCGTGTACAC | CCGGCAG | CAAATT | AAGTSSPTADGADST |
| | | | | GCACAACGCGTCGCGGTTCGACTGCACGCTGTGCGCGTACACGGCCGG | GGCGGCC | ACAAAT | VSAVAHAEPGLPHH |
| | | | | CAGCTTCGCGTCACTTCTGACGCACAGGAACTCTCGGCACCGCCGCACC | GGCAGGCT | TTGGTA | NDTELTASPPLVSSSD |
| | | | | GCATTCCTCGACCGATTCTCGGCGGGTTGCGCGTGTGGCGTGCCATTCG | GCCCGACT | ACGAGT | VEVQATKTEATDNR |
| | | | | CCTCGAGGCTGGCTGCAGCAAGACACGCGCAAGCGTGCGCCAGCCTCT | CGGTATCG | AAGCCA | WGAPLPRVLVASRIA |
| | | | | CGAGCGCACCATCGGCCGAGGCTTCGTCGGCAGCAGGAACATCAAGCC | CCGGGTGC | AATGGT | GRLAQVPPPRWGPP |
| | | | | CCACTGCCGACGGAGCCGACTCCACCGTCTCAGCCGTGGCTCACGCTGA | TACACTCT | AATACA | LPRTTIAARIATRLAA |
| | | | | GCCCGGCCTGCCCCACCACAACGACACGGAGCTCACAGCGTCCCCCCCG | CAGCCGCC | CAAAAC | TPAPRWDPPLPRSLV |
| | | | | CTGGTGAGCTCCTCCGATGTTGAAGTGCAGGCAACAAAGACCGAAGCC | ACAGCTCG | TTTTCTG | VSRIAARLLPALPDAP |
| | | | | ACCGACAACCGCTGGGGCGCCCCGCTTCCGCGCGTGCTGGTCGCGTCTC | GGCCTTGG | TTCTAAT | ACEEEAKDSDTMDW |
| | | | | GAATCGCCGGGCGCCTCGCTCAGGTGCCACCCCCACGCTGGGGCCCCCC | CGGTCCGC | CAGTGT | APTWTNEETKESEPH |
| | | | | GCTGCCGCGCACCACCATCGCAGCCCGCATTGCGACGAGGCTCGCAGCC | CATTGGCC | GAAAAC | DEAPGQVDEETIDDA |
| | | | | ACGCCTGCCCCCCGCTGGGACCCACCGCTGCCACGAAGCCTGGTTGTGT | CTTGGAGC | TGGTTTT | DGEWLLRFDGACRA |
| | | | | CACGCATCGCCGCCCGCCTGCTACCCGCGCTACCAGACGCGCCTGCATG | TCGACAGC | CGCCTTT | NPGPGGAGAALFKP |
| | | | | CGAGGAAGAGGCCAAGGACAGCGACACGATGGACTGGGCGCCAACTT | GACAGCA | TGGCGG | SGPVVWTCSHYDPS |
| | | | | GGACAAACGAGGAGACCAAGGAAAGCGAGCCACATGACGAAGCGCCA | GCGACGAC | ACTTTTT | TTATNNTAEYTALLL |
| | | | | GGGCAGGTCGACGAGGAGACCATCGACGACGCCGACGGCGAGTGGCT | GAGGACG | CACTCG | GARAAADHGVTKLRI |
| | | | | TTTGCGCTTCGACGGTGCTTGCCGTGCAAACCCAGGCCCAGGCGGCGCC | CTCAAGAC | CATTTTT | EGDSTLVIQQVRGIF |
| | | | | GGCGCAGCTCTCTTCAAGCCCAGCGGCCCCGTAGTGTGGACTTGTTCCC | CCCCACGC | GGGCAA | ATRSTRLRALRNKVKL |
| | | | | ACTACGACCCGAGCACCACGGCAACGAACAACACAGCAGAGTACACTG | CGCCGCCC | TCGTCT | ELARVGSFSLHHIDR |
| | | | | CGTTGCTGCTCGGGGCCAGGGCCGCCGCCGACCACGGCGTCACGAAGC | CAGGACCC | GCGGCT | QANGHADRLANAGL |
| | | | | TGCGCATCGAGGGCGACAGCACGCTGGTCATCCAGCAAGTGCGGGGCA | CCCGCAGA | AGCTTG | DRRRTKLECSVHPDG |
| | | | | TCTTCGCGACGAGAAGCACGCGGCTCCGAGCACTGCGCAACAAGGTCA | CGTCGCGA | CTAGCG | RGCTNTSVATAAPTA |
| | | | | AGCTCGAGCTCGCGCGCGTGGGGAGCTTCTCGCTCCACCACATCGACCG | GTGTGCTT | GCGGAC | PAAPLPSARPPASTA |
| | | | | GCAGGCGAACGGTCACGCCGACCGCCTTGCCAACGCCGGCCTCGACCG | GCCCCACC | GAGCGG | APSPDDDHSDQGDI |
| | | | | ACGCCGCACCAAGCTCGAGTGCAGTGTGCACCCCGATGGCAGGGGCTG | CGGCAAG | TCTCCG | DDGEVYAAMCISPD |
| | | | | CACCAACACCTCCGTGGCGACCGCAGCGCCTACTGCTCCTGCAGCGCCC | GCAGGCA | GGGGCG | AVPHRRPRLRLRRLT |
| | | | | TTGCCCTCAGCCCGGCCTCCTGCATCTACGGCCGCTCCGTCTCCTGATGA | GC (SEQ ID | TTCACCT | DEESEEAGNVVERLA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGACCACAGCGACCAAGGCGACATCGACGACGGCGAGGTGTACGCCGC | NO: 1198) | TTCCCCC | ASLAAKIADAPDWET |
| | | | | AATGTGCATCAGCCCCGATGCTGTGCCGCACCGCCGACCGCGCCTCCGC | | GCGAGG | AEGYITALPYALYDKL |
| | | | | CTACGGCGCTTGACGGACGAAGAGTCCGAGGAGGCTGGCAACGTCGTG | | CCAACT | QPYSQSQHQPPRQQ |
| | | | | GAGAGGTTGGCAGCGTCGCTGGCGGCGAAGATTGCAGATGCGCCAGA | | ACACCG | QQQQRQRPRQQQQ |
| | | | | CTGGGAGACGGCGGAGGGCTACATCACGGCCCTACCGTACGCCCTCTA | | ATCTTCT | TRQRRQRRCKRGGG |
| | | | | CGACAAGCTGCAGCCGTACTCCCAGTCCCAGCACCAACCTCCACGTCAA | | CTACACT | SQHRQRKTRRRRPPR |
| | | | | CAGCAGCAGCAGCAGCGGCAACGCCCACGGCAGCAGCAGCAAACACG | | TTTCTAA | VTRHHREHRIDEALD |
| | | | | GCAGCGTCGACAGCGGAGATGCAAGCGCGGCGGTGGCAGCCAACACA | | TTCGCCT | DLHALESRRPQDRTA |
| | | | | GGCAGCGGAAGACGCGCCGCCGACGGCCCCCACGGGTGACACGCCACC | | CCGTCTT | ISKARRRVGRIRSALD |
| | | | | ACCGCGAGCACCGGATCGATGAAGCCCTCGACGACCTCCACGCGCTCG | | CGGTCT | QHQLRHRFDTDEKA |
| | | | | AGAGCAGGCGCCCTCAGGACAGGACGGCCATCAGCAAGGCCAGGCGTC | | TCGGCT | CVDGILAAARDKDRA |
| | | | | GAGTCGGTCGCATCCGCTCCGCCCTTGACCAGCACCAATTGCGCCACCG | | GTCGGA | ASVTTTAQTAAPPHS |
| | | | | CTTCGACACCGACGAGAAGGCCTGCGTGGACGGCATCCTGGCCGCCGC | | TTTTTTT | APASAPSSAVDDGIC |
| | | | | GCGCGACAAGGACAGGGCGGCATCAGTGACGACAACAGCGCAAACAG | | CTTTTTG | PIPGDLLHAFFTDVN |
| | | | | CGGCTCCGCCTCATTCTGCACCAGCTTCAGCTCCTTCGTCGGCGGTGGAC | | ACCAAT | TPRTEFDADSPIGARF |
| | | | | GACGGAATCTGCCCGATTCCGGGAGACTTGCTCCATGCCTTCTTCACAG | | CAGAGC | REALAQLPAAIAATEL |
| | | | | ACGTGAACACGCCGCGCACGGAGTTCGACGCCGACTCGCCCATCGGAG | | GCGCCA | LMEPPSPDEVEDQL |
| | | | | CCCGCTTTCGGGAGGCGCTTGCTCAGCTGCCCGCTGCCATCGCTGCCAC | | TGCGAC | QRVRGTSSPGLDGV |
| | | | | GGAGCTACTCATGGAGCCGCCGTCGCCGGACGAGGTTGAGGACCAGTT | | TCTTCTG | GYDVYKTFTQQLLPA |
| | | | | GCAACGTGTACGGGGTACGTCCAGCCCCGGCTTGGACGGAGTGGGGTA | | GCCAAT | LHAAFSRCWTDQRV |
| | | | | CGACGTCTACAAGACCTTCACACAGCAACTCCTACCGGCCCTGCACGCC | | CAGAGA | PQSWKLGVVRLLFKK |
| | | | | GCTTTCTCCAGGTGTTGGACTGATCAGCGCGTCCCACAGAGCTGGAAGC | | CCGGGC | GDRQDPANWRPICL |
| | | | | TCGGAGTCGTGCGGCTCCTGTTCAAGAAAGGAGATCGGCAGGACCCCG | | CCTGTCC | QQAVYKLYAGILAHR |
| | | | | CCAACTGGAGGCCGATCTGCCTCCAGCAAGCCGTCTACAAGCTGTACGC | | TCGGAC | FTRWLDANTRHADA |
| | | | | CGGTATCCTGGCCCACCGGTTCACACGCTGGCTCGACGCCAACACCCGG | | AGCGAG | QKGFRAVNGCGEHN |
| | | | | CACGCTGACGCACAGAAGGGATTCCGCGCGGTTAACGGCTGCGGGGAA | | GCCTCC | FLAATLTDNARRRR |
| | | | | CACAATTTCCTCGCAGCCACGCTGACGGACAACGCCCGCCGCCGACGCC | | ACGGCC | ELHVVWYDIKNAFGS |
| | | | | GCGAGCTGCACGTGGTCTGGTACGACATCAAGAACGCGTTCGGCAGTG | | AGCCAA | VPHELLWEVLRRMG |
| | | | | TGCCCCACGAACTGCTGTGGGAGGTGCTGAGGCGCATGGGAGTGCCGG | | TCAAGT | VPAQFIACCQGIYDA |
| | | | | CGCAGTTCATCGCGTGCTGCCAAGGGATCTACGACGCGGCAGCTTTCAC | | CTCGGC | AAFTVGNAADGTTA |
| | | | | GGTCGGGAACGCAGCAGACGGCACGACGGCCCCAATTCAGCTGCGCTT | | AGCGAC | PIQLRLGVFQGCPLSP |
| | | | | GGGCGTGTTTCAGGGATGTCCCTTGAGCCCCCACCTCTTCACGGCGGTG | | GCGTCT | HLFTAVISPLLHALKR |
| | | | | ATCAGCCCACTCCTCCACGCACTCAAGCGGCTCCCTGGCACGGGGGTAC | | TTCTATA | LPGTGVQLSAVDRPG |
| | | | | AGCTCTCAGCCGTCGACCGGCCAGGTGCGTCAGCATATGCCGACGACCT | | GCGCAG | ASAYADDLKVFSDTK |
| | | | | CAAGGTCTTCAGTGACACCAAGGATGGCATCACGCGGCAGCACCAGCT | | CTGACG | DGITRQHQLVTDFLR |
| | | | | CGTCACCGACTTCCTGCGCTGGACAGGCATGGTGGCAAACCCGTCCAAG | | AGGCCG | WTGMVANPSKCST |
| | | | | TGCAGCACCATGTCTGTCCAGAGGGACAACCGCGGCGTTTTGAAGACC | | ATCTGG | MSVQRDNRGVLKTA |
| | | | | GCCAACCTCACGCTCCAGCTGGACGGCGCCCAAATCCCAGCACTCGGGA | | CGGCCC | NLTLQLDGAQIPALG |
| | | | | TGACCGAGGCGTACGCGTACCTGGGCATAGGCGACGGATTCGACCACG | | CCGATT | MTEAYAYLGIGDGFD |
| | | | | TACGCCGCCGCGTCGAGTTGGCCCCCAAGCTCCGCGAACTGAAGGCAG | | GGTCCG | HVRRRVELAPKLREL |
| | | | | ACACGACGGCGCTGATGCAGTCGGGGCTGGCGCCGTGGCAAGTIGTGA | | ACTTTCG | KADTTALMQSGLAP |
| | | | | AGGCCCTCAAGGTTTACATCTACCCACGCGTGGAATATGCCCTCCGCCA | | GCCAAT | WQVVKALKVYIYPRV |
| | | | | CCTCCGACCGTTTCAGCAGCAGCTCCAAGGCTTTGACCGACACCTCGCG | | CAGCGA | EYALRHLRPFQQQLQ |
| | | | | CGCGGGCTGCGTCACCTTCTCCGCCTGCCAACATCAGCCACCACCGAGT | | CGACGA | GFDRHLARGLRHLLR |
| | | | | TCCTGTATGCACCAACGTCGCGAGGAGGTTTGGGGCTGCTACCGCTTAC | | GGGGGC | LPTSATTEFLYAPTSR |
| | | | | AGAGGTTCACGGTGCCCTTCAGATTGCGCACGCCTGGCAGACCCTGCAC | | AGGGGT | GGLGLLPLTEVHGAL |
| | | | | TCGCCGGACCCCGCCATCCGCCGCATTGCCCGCGTGCAGCTTCGCCAAG | | TTACACT | QIAHAWQTLHSPDP |
| | | | | TCGCCGACGCCCGGCACCGCTTGGACGCCGAGCACTGGAAGGAGCGGG | | TTTGCCC | AIRRIARVQLRQVAD |
| | | | | GGGAGGAGCTGTGCGAGCGGCTGCTAAACTCGCAGCTCGGGACATCGG | | CCGTTTC | ARHRLDAEHWKERG |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCCACGCGCCTCCCAAACGACGCAATTGCGACATCGGCTCGCTGTGGGT | | GACTTC | EELCERLLNSQLGTSA |
| | | | | CGATGTCCAGCGCCACCTCCGCTCTCTCGGCCTACAGCTACAGACAGCC | | AACTTCA | HAPPKRRNCDIGSLW |
| | | | | CCCGCGGACACGCACACTGGCGCACCAGCTCAGCCTCTCCAGCTTCGCG | | GGCCAA | VDVQRHLRSLGLQLQ |
| | | | | TGCCGCACCACGACAAGTGGCTGACGCACAAGGACGTGCTGCGGCACG | | AATGGC | TAPADTHTGAPAQPL |
| | | | | TGAAGCTGCACATCAAGAATAACCACTGGCACCGCTGGACATCCATGCG | | GATTTC | QLRVPHHDKWLTHK |
| | | | | GGACCAAGGGAAGACGGCCCGCGCCCACGGCGGTGAAGGCAGCGGCT | | GACCCT | DVLRHVKLHIKNNH |
| | | | | TCCTTACGCAGCCGCGAGGCATGTGGGAAGCCGACTACCGGTTCGCGG | | CCACGC | WHRWTSMRDQGKT |
| | | | | TGGCGGGTCGTCTTAACCAAGTGGACACGTACAGCGTACTGAAGCGCC | | GCCGTG | ARAHGGEGSGFLTQ |
| | | | | GGCGCCTGCGCTCGCACGACAGATGCCGCCAGCCAGGATGCCATCGTG | | CCACTG | PRGMWEADYRFAV |
| | | | | CCGAAACACTGGCTCACGTGCTAAACCACTGTCCCGGCACGATGGACGC | | CTCGGC | AGRLNQVDTYSVLKR |
| | | | | GGTCCGAGGGCGGCACGACGGAGCGCTCAAGCGCATCGAGCGTGAGC | | ACCGGC | RRLRSHDRCRQPGC |
| | | | | TCCACGCGTCGGCCACGGACCGCCGGGACCGCGTCGAGCTCCGAGTGA | | GGCGAT | HRAETLAHVLNHCPG |
| | | | | ACCAGACCGTGCCGTCACTCGCCGGCCCCGCGTTACGGCCCGATCTCCA | | TCAGCG | TMDAVRGRHDGALK |
| | | | | GCTCTACAACCACACCAAGAAGACGGTGGCGGTGGTCGACCTGGCCGT | | GGTGCA | RIERELHASATDRRD |
| | | | | GGCGTTTGAGGAGCAGGCGAGTGACGACGCGAGCAGCTCGGCGCTGT | | ACTTCG | RVELRVNQTVPSLAG |
| | | | | CCCTTATCGCCAGCCACAAGCGAGCCAAGTACGACCGCATCAAGCGACA | | GGCACG | PALRPDLQLYNHTKK |
| | | | | CCTCGAGCGCCAAGGATGGAAGGTACACCTCTCGGCGCTCGTGTACGG | | TGTGCA | TVAVVDLAVAFEEQA |
| | | | | GTCGCTTGGGGCGGTCGCTAGTGGCAACTACCAGGTGTACACCACACAC | | ACACAT | SDDASSSALSLIASHK |
| | | | | CTGGGGCTACTCAAGCGCGATGCAAAGCGGCTGGACCGGCAGCTGTCT | | GCAGCG | RAKYDRIKRHLERQG |
| | | | | GTCGAATGCATCCAGTCCAGCCGCCGCATCTGGAATCTACACTGCAGCC | | CCCATTG | WKVHLSALVYGSLGA |
| | | | | AGCACCGGACTCGCCAACACCAGGCGAGGCCCAGCCAAGGACCAAGAG | | CACGCC | VASGNYQVYTTHLGL |
| | | | | GCAGCCGGGCGACGGAGACCGGGGGGACTCCGTCCCAGACAAGCCGC | | AAGCGG | LKRDAKRLDRQLSVE |
| | | | | CGCTAGGCGGAAACCAGGCCCAAGACGGCCGACAGGGCCCCACCCAGG | | CATCGC | CIQSSRRIWNLHCSQ |
| | | | | TAGGGAACCGCCCTAGAAACCCATTTCGGTGGTCGACTCGAAGGCCTTA | | GGGACG | HRTRQHQARPSQGP |
| | | | | CCTATTTTTTCCTTAGACATTCAATTAGGTAGCGACCAAATTACAAATTTG | | ACGCCT | RGSRATETGGTPSQT |
| | | | | GTAACGAGTAAGCCAAATGGTAATACACAAAACTTTTCTGTTCTAATCAG | | CGGCCG | SRR (SEQ ID NO: |
| | | | | TGTGAAAACTGGTTTTCGCCTTTTGGCGGACTTTTTCACTCGCATTTTTG | | CTCAAG | 1443) |
| | | | | GGCAATCGTCTGCGGCTAGCTTGCTAGCGGCGGACGAGCGGTCTCCGG | | CGCAGC | |
| | | | | GGGCGTTCACCTTTCCCCCGCGAGGCCAACTACACCGATCTTCTCTACAC | | CCCGCC | |
| | | | | TTTTCTAATTCGCCTCCGTCTTCGGTCTTCGGCTGTCGGATTTTTTTCTTTT | | CTTCCAG | |
| | | | | TGACCAATCAGAGCGCGCCATGCGACTCTTCTGGCCAATCAGAGACCGG | | CACGAC | |
| | | | | GCCCTGTCCTCGGACAGCGAGGCCTCCACGGCCAGCCAATCAAGTCTCG | | CTCGCG | |
| | | | | GCAGCGACGCGTCTTTCTATAGCGCAGCTGACGAGGCCGATCTGGCGG | | CCGTTT | |
| | | | | CCCCCGATTGGTCCGACTTTCGGCCAATCAGCGACGACGAGGGGGGCAG | | GGCGGA | |
| | | | | GGGTTTACACTTTTGCCCCCGTTTCGACTTCAACTTCAGGCCAAAATGGC | | TCGCCAT | |
| | | | | GATTTCGACCCTCCACGCGCCGTGCCACTGCTCGGCACCGGCGGCGATT | | CAAGAC | |
| | | | | CAGCGGGTGCAACTTCGGGCACGTGTGCAACACATGCAGCGCCCATTG | | GTGCGA | |
| | | | | CACGCCAAGCGGCATCGCGGGACGACGCCTCGGCCGCTCAAGCGCAGC | | GAGCCA | |
| | | | | CCCGCCCTTCCAGCACGACCTCGCGCCGTTTGGCGGATCGCCATCAAGA | | GGCGGG | |
| | | | | CGTGCGAGAGCCAGGCGGGGTCGGGCAAAATATACTTACTCTAAGTAT | | GTCGGG | |
| | | | | GCCCGAATCCCTGCCCTCTCAGGCTGAACGCGGCCCCATACTTGATCTAA | | CAAAAT | |
| | | | | GTATGGGAGGGATCCCTGGCCTCTCAGGCTGTACGCGAGACCCGTACG | | ATACTTA | |
| | | | | GCCGAATCCCCTGGCCTCTCAGCCTGTACGCGGGGC (SEQ ID NO: | | CTCTAA | |
| | | | | 1075) | | GTATGC | |
| | | | | | | CCGAAT | |
| | | | | | | CCCTGCC | |
| | | | | | | CTCTCAG | |
| | | | | | | GCTGAA | |
| | | | | | | CGCGGC | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | CCCATACTTGATCTAAGTATGGGAGGGATCCCTGGCCTCTCAGGCTGTACGCGAGACCCGTACGGCCGAATCCCCTGGCCTCTCAGCCTGTACGCGGGGC (SEQ ID NO: 1321) | |
| NeSL | Utopia-2_PR | — | *Phytophthora ramorum* | TCAAGCCCCGCCGCCAAGCCCAGCTGCGGCTGTTGCCGCCCCTCCAGCAGCAGCAGTCGCAGCTGAACCTACAGCCCCTCCTGCTGATCGCGCCGCCGTGGAGCCCCGCGCGCGCGCCGAGCCGCCCCAAGAACAAGCACCCCCAGCTAGCGCGCGCGTGGAGCCCATGTCGGGCGACGTGGTCAGCAGCGACGGCAGCAGCAGGACGACGGACGCGAGCGGCGACGGCGACGACGGCGCAGGCAGCAGCGATGCAGCAGGCGACGTCGGCGTCGTCGCCATGGACGTTGACCAAGGTGCCCGCCGACAGCAGCCGCCATGGCAGCGCGTCGGCGGCAAGCGTCGACGTCTCAACGACGTCGACGACGAAGACACCCGCGAGCTGGCCGAGCTCCTGCTCGAGGAGGAGGACGAGGCTGGGGACCACGCTCCAGCGCCTAGGCTATCCGCGGCCAGCGCTCGCCCGGCCTCCGTCCTCTCCGTGTACGCGCACAATGCGCAGCGCTTCCAGTGCACGCTGTGCACGTACACGGCCGCCAGCTTCGCGTCGCTCAAGCGACACCGGGACTCCCGGCACCGCCGCACCGCCTTCCTCGACCGGTTCTCGGCGGGATGTGCGTGCGGTGCGCCCTTCGCGTCGAGGCTGGCTGCTGCGAACCACGCACACGCGTGCGCCAGCCTCAACCGCACCTTATCGGTAGCGGCTACGCCGGCAGCAGGGGAACTGAGCCCCACTGCTGGTGCAGCCAACGCCACCGTCAAGGCGGCCACCGTCACGCCCGACTCCCCCCGCCAAGACCCCCCGGAGCTCGCAGCGTCCCCCCCGCTAGCGAGCTCCCCCGACGTTGCTGTGCAGGCCGCCGACATGCAGGCCCCGACTCGTTGGGACCCGCCCCTCCCCCGCACGCTGGTGGCGACACGGGTCGCCTCCCGCCTCACCGACCTGACACCGCCGCGGTGGGGACCGCCGCTGCCTCGAGCCACGGTGGTGTCTCGCATCGCGGCGAGACTCGAGGCCGCACCAACGCCCCGTTGGGGCCCTCCACTTCCACGCGTCGTGGTTGCGTCCMGGATCGCCGAACGCTTAGCTCCGCCCGAGCTGGCAGCTGACGACGAGACCAAGGACGGCGAGGAAGACCAGAGCTTTACGGAACCTGTGGCTGCCGCCCGGTCMGAKGGCGGCGAGGACGCGAACGGCGAGTGGCTGCTTCGCTTCGACGGCGCCTGCCGAGCCAACCCAGGCCCCGGCGGTGCGGGCGCAGCGCTGTTCAAGCCCAGCGGCCCGGTGGTGTGGACCTGCTCCCACTATATGCCGAGCAGCAGCGAGACCAACAACACGGCCGAGTACACGGCTCTGCTGCTCGGCATGCGGGCTGCGGCGGACCATGGCGCTACGCGCG | TCAAGCCCCGCCGCCAAGCCCAGCTGCGGCTGTTGCCGCCCCTCCAGCAGCAGCAGTCGCAGCTGAACCTACAGCCCCTCCTGCTGATCGCGCCGCCGTGGAGCCC (SEQ ID NO: 1199) | TGAGCACCTTGGGTTGCTCAAGCGTGATGCGAAGCGGCTGGACCGGCAGCTCTCGGTGGCGTGCATCCAGTCCAGCCGCCGCATCTGGAACCTGCACTGCAGCCAGCACCGCGCGCGCCAGCACCAAGCACCAGGGGGAAGTCGGGCGGCGGAGACCGGGGGGACTCCGCCGCG | MSGDVVSSDGSSRTTDASGDGDDGAGSSDAAGDVGVVAMDVDQGARRQQPPWQRVGGKRRRLNDVDDEDTRELAELLLEEEDEAGDHAPAPRLSAASARPASVLSVYAHNAQRFQCTLCTYTAASFASLKRHRDSRHRRTAFLDRFSAGCACGAPFASRLAAANHAHACASLNRTLSVAATPAAGELSPTAGAANATVKAATVTPDSPRQDPPELAASPPLASSPDVAVQAADMQAPTRWDPPLPRTLVATRVASRLTDLTPPRWGPPLPRATVVSRIAARLEAAPTPRWGPPLPRVVVASRIAERLAPPELAADDETKDGEEDQSFTEPVAAARSXGGEDANGEWLLRFDGACRANPGPGGAGAALFKPSGPVVWTCSHYMPSSSETNNTAEYTALLLGMRAAADHGATRVHVEGDSTLVIQQV |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGCACGTCGAAGGTGACAGCACCCTGGTGATCCAGCAAGTGCGGGGCA | | CACCGG | RGIFATRSTRLRGLRK |
| | | | | TCTTCGCTACCCGTAGCACCCGGCTCCGTGGACTGCGCAAGAGCGTGAA | | CCGCCG | SVKAEMARMEHVTL |
| | | | | GGCGGAGATGGCGCGGATGGAGCATGTCACGCTCCACCACATCGACCG | | CTAGAC | HHIDRQANGHADRL |
| | | | | CCAAGCCAACGGCCATGCCGACCGCCTCGCCAACGCCGCCCTCGACCGC | | GGCACA | ANAALDRRKTKLECG |
| | | | | CGCAAGACCAAGCTGGAGTGCGGACTCCACCCTGACGGCCAAGGCTGC | | CAGGCC | LHPDGQGCSSTAATT |
| | | | | TCCAGCACCGCCGCGACGACGGCGGTCCCCTCTGTGGTGCCGGACCGG | | CACAGC | AVPSVVPDRPPSSTA |
| | | | | CCTCCCTCGTCAACCGCTGCCGCGCCAACGCCAAGCGCCGAACCCGACG | | GGCCGA | AAPTPSAEPDETEQG |
| | | | | AGACCGAGCAGGGCGACATCGACGACGGCGAGGTCTACGCCGCCATGT | | CAGGGC | DIDDGEVYAAMCIGP |
| | | | | GCATTGGCCCGGACTCCATACCGGAGCGCCGACCACGCCTCCGCCTACG | | CACACC | DSIPERRPRLRLRQLS |
| | | | | GCAGCTGTCCGAGACCGAGGAGGAGGAGGCGGGTGCCATTGTGGAGA | | CAGGTA | ETEEEEAGAIVERLAA |
| | | | | GGCTGGCGGCAACGTTGGCGGGCAAGATCACGGACGCGAGTGACTGG | | GGGAAC | TLAGKITDASDWATA |
| | | | | GCGACGGCGGAGGGCTACATCACTGCCCTCCCCTACACTCTATACGACA | | CGCCCTC | EGYITALPYTLYDKLQ |
| | | | | AACTGCAGCCGTTCGCCCAGCACCGCCACCAGCCTCGCCCACAGCACCG | | AAACCC | PFAQHRHQPRPQHR |
| | | | | GCAGCAACCCCAGCGCGACCCACCCCTCGGCACCCACGACGGGGACCA | | CGCCGG | QQPQRDPPLGTHDG |
| | | | | CGGCCAGCCGAGCACCAGCCGCAGCCGTCGCCGTCGCCGCCGCGCCAA | | TACATTA | DHGQPSTSRSRRRRR |
| | | | | GGATCGCTTACGCCGACGCCCACCGCGTATTACCCGCCACCACCGTGAG | | TGGTCC | RAKDRLRRRPPRITR |
| | | | | CACCGCCTCGACGAGGCTCTGGACGACCTGCGGGCGGTGGAGCACGCC | | GACACC | HHREHRLDEALDDLR |
| | | | | AGTCCCCACGACCGGCCGGCCGTCGCTCGGGCCCGGCGGCGCGTTGGC | | TATGAG | AVEHASPHDRPAVA |
| | | | | CGCGTCAACTCCGCCATTGCCCAGCAACAGCTGCGACACAAGTTTGACA | | GTGCAA | RARRRVGRVNSAIAQ |
| | | | | AGGACGAGAAGGCGTGCGTGGATGGAATCTTGGCCGCGGCCCGAGCTT | | CCTGTAC | QQLRHKFDKDEKAC |
| | | | | CTCGCGGGTTAGCAACCCCATCGGCCTCAGCCTCGAGGCATCCACCGCC | | ACAAGT | VDGILAAARASRGLA |
| | | | | GGTACCCTCCACCGCTGCTGATGACGGCTCCTGCCCCATCCCCAGCGAT | | TACACA | TPSASASRHPPPVPST |
| | | | | GAGCTCCACGCCTTCTTCACGGCCGTGAACACGCCGGCGGGCACCTTCG | | CCACAT | AADDGSCPIPSDELH |
| | | | | AGCCCATGGCACCAGTGGGTGCCCCGTTCCGCTCCGCCGTCGCCCACCT | | AGCGAC | AFFTAVNTPAGTFEP |
| | | | | CCCCGCCGCGACATCGCAGCCTGAGTTGCTCTCGGACGCGCCGACCACG | | TACCAG | MAPVGAPFRSAVAH |
| | | | | GACGACATCGAGGACCAACTGCAGCGTGCCCGTGGCAGCTCCAGCCCT | | GTATTTA | LPAATSQPELLSDAPT |
| | | | | GGCCTGGACGGCGTGGGGTACGACATTTACAAGGCGTTCGCGGCCCAG | | CTACCTG | TDDIEDQLQRARGSS |
| | | | | CTCCTGCCGGCCCTGCACGCAGCATTCGCGTGCTGCTGGCGCCACAAGC | | GAAGCC | SPGLDGVGYDIYKAF |
| | | | | AAGTCCCGCAGAGCTGGAAGGTGGGGGTGGTGCGCCTCCTGTTCAAGA | | AAGGAT | AAQLLPALHAAFACC |
| | | | | AGGGGGAGCGAACCGAGCCGGCGAACTGGCGCCCGATCTGCCTGCAG | | TAACCG | WRHKQVPQSWKVG |
| | | | | CAGGCAATCTACAAGCTGTACGCCGGGGTGCTAGCTCGCCGACTCACCC | | GTCGGT | VVRLLFKKGERTEPA |
| | | | | GCTGGCTGGACGCCAACGGCCGCCACGCAGACACGCAGAAGGGATTCC | | AATACA | NWRPICLQQAIYKLY |
| | | | | GGGCGATGAACGGCTGCGGGGAACACAATTTCCTCGCAGCCACGCTGG | | CATAACT | AGVLARRLTRWLDA |
| | | | | TCGACCAGGCCCGCCGCAAGCGACGAGAGCTCCACGTCGTGTGGTACG | | TT (SEQ | NGRHADTQKGFRA |
| | | | | ACTTCGCCAACGCCTTCGGCAGCGTGCCACATGACCTGCTGTGGGAGGC | | ID NO: | MNGCGEHNFLAATL |
| | | | | GCTCGAGCGGCAGGGCGTCCCCAGCCCCTTCATTGCTTGCTGCCGGGGC | | 1322) | VDQARRKRRELHVV |
| | | | | CTCTACGCGGATGCCGTCTTCACAGTCGGCAACGCAGCGGACGGCACCA | | | WYDFANAFGSVPHD |
| | | | | CGGCACCGATCGCGCTACGGGTGGGGGTCTTCCAGGGATGTCCGCTGA | | | LLWEALERQGVPSPF |
| | | | | GCCCCCACCTCTTCACGGCCGCGATCGCCCCGCTGCTCCACGCGCTCAA | | | IACCRGLYADAVFTV |
| | | | | GCGCTTACCAGACACGGGCGTACAGCTGTCTCGTGTCGACTGCCTCGGT | | | GNAADGTTAPIALRV |
| | | | | GCCTCCGCGTACGCGGACGACCTCAAGATATTCAGCGGCACCGAGGGC | | | GVFQGCPLSPHLFTA |
| | | | | GGGACCAAGAGACAGCACGCGCTCGTGGCGGACTTCCTGCGCTGGACC | | | AIAPLLHALKRLPDTG |
| | | | | GGCATGCGCGCGAATCCGGCGAAGTGCTGCACCATGTCGGTCCAGCGC | | | VQLSRVDCLGASAYA |
| | | | | GACACACGTGGAGTGCTCAAGGCCTGCAACCTCGGACTGCAGCTGGAT | | | DDLKIFSGTEGGTKR |
| | | | | GGCGCCCCGATCCCCGCGCTGACCATGAGCGCCTCGTACGCCTACCTGG | | | QHALVADFLRWTG |
| | | | | GGATCGGGGATGGCTTCGACCATGTGCGCCGCCGCATCGAGCTCGCGC | | | MRANPAKCCTMSV |
| | | | | CCAAACTCCAGGAGCTCAAGCACGATGCGACGGCGCTGCTGCAGTCCG | | | QRDTRGVLKACNLGL |
| | | | | GACTGGCCCCATGGCAGGTAGTGAAGGCGGTGAAGGTGTACCTCTACC | | | QLDGAPIPALTMSAS |
| | | | | CTCGGGTGGAGTACGCCCTTCGCCACCTTCGCCCCTTCCACCAGCAGCTG | | | YAYLGIGDGFDHVRR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAGGGCTTCGACAGACACCTCGTGCGCGGCCTCCGCCACCTCCTCCGCC<br>TGCCCGCCAACGCCACGACGGCATTCTTCTACGCGCCGGTGTCGCGCGG<br>CGGGCTGGGCCTGCTGCCCCTGACGGAGCTGCACGCGGCGCTACAAGT<br>CGCGCACGGATGGCAGATGCTGAACTCGAAGGACCCTGCCATCCGACG<br>CATCGCGCGCGTGCAGCTCCGGCAAATCGCCGACGCGCGCCACCGGAT<br>CGACGCTCAAGCGTGGCAAGACCGGGAGGAAGAGCTGGCGCAGCTCCT<br>CCTGAACTCGCAGCTCGGGGCGTCCACCGGCGCACCCCCGAAGCGCCG<br>CAACGGCGACATCGGCTCGCTCTGGGTGGACGTCCAGCGCCACCTCCGC<br>CATCTCAGCCTCAAGCTGGAGACCGCACCGGCGTGTGCGGAGACCGGC<br>ACCGCCGCGGCCATGCTGCAGCTTCGCGTGCCGCACCACGACAAGTGG<br>CTAGACCACAAGACTGTGCTGCGGCACGTGAAGCTGCACTACAAGAAC<br>AAGCACTGGGCCAGGTGGGCGGCCATGMGSGACCAAGGCAAGACGGC<br>ACGCACGCATGGGGGCGCGGGGAGCGGCTTCCTCACCCGGCCACGAG<br>GCATGTGGGAAGCCGACTACCGCTTCGCGGTGGCCGCCCGCCTGAACC<br>AGCTCGACACGCACAGCGTSCTGAAGCGCCGGCGCCTCCGGSMSCACG<br>ACCGCTGTCGACAGCCGGGCTGCACCCAGGGSGGAGACGCTGGCGCAC<br>GTGCTCAACCACTGCGCCGGCACCATGGACGCGGTCCGCGGCCGCCAC<br>GACGACGCCCTCAAGCACATCGAGCGCGCGCTGCACGCGTCGTCGCCG<br>GGCGGCCAGGACCGCGTCGAGCTCCGGGTCAACCAGACGGTGCCGTCG<br>CTCGCCGGCCCCGCGCTACGGCCCGACCTCCAGCTGTACAACCACACCA<br>AGAAGACGGTGGCGGTGGTCGACCTGGCCGTGGCGTTCGAGGAGCAG<br>GCGAGCGACGACCCGGAGAGCTCGGCGCTGGCACGCATCGCCGCACAC<br>AAGCGCGCGAAGTATGCCGGCGTCAAGCGACACCTCGAGCGCCAAGGG<br>TGGAAGGTCCACCTCTCGGCGCTCGTGTACGGCTCGCTCGGCGCGGTGC<br>CGGCCGGCAACCACAAGGTGCTTACTGAGCACCTTGGGTTGCTCAAGCG<br>TGATGCGAAGCGGCTGGACCGGCAGCTCTCGGTGGCGTGCATCCAGTC<br>CAGCCGCCGCATCTGGAACCTGCACTGCAGCCAGCACCGCGCGCGCCA<br>GCACCAAGCACCAGGGGGAAGTCGGGCGGCGGAGACCGGGGGGACTC<br>CGCCGCGCACCGGCCGCCGCTAGACGGCACACAGGCCCACAGCGGCCG<br>ACAGGGCCACACCCAGGTAGGGAACCGCCCTCAAACCCCGCCGGTACA<br>TTATGGTCCGACACCTATGAGGTGCAACCTGTACACAAGTTACACACCA<br>CATAGCGACTACCAGGTATTTACTACCTGGAAGCCAAGGATTAACCGGT<br>CGGTAATACACATAACTTT (SEQ ID NO: 1076) | | | RIELAPKLQELKHDAT<br>ALLQSGLAPWQVVK<br>AVKVYLYPRVEYALR<br>HLRPFHQQLEGFDR<br>HLVRGLRHLLRLPAN<br>ATTAFFYAPVSRGGL<br>GLLPLTELHAALQVA<br>HGWQMLNSKDPAIR<br>RIARVQLRQIADARH<br>RIDAQAWQDREEEL<br>AQLLLNSQLGASTGA<br>PPKRRNGDIGSLWV<br>DVQRHLRHLSLKLET<br>APACAETGTAAAML<br>QLRVPHHDKWLDHK<br>TVLRHVKLHYKNKH<br>WARWAAMXDQGK<br>TARTHGGAGSGFLTR<br>PRGMWEADYRFAV<br>AARLNQLDTHSVLKR<br>RRLRXHDRCRQPGCT<br>QGGDAGARAQPLRR<br>HHGRGPRPPRRRPQ<br>AHRARAARVVAGRP<br>GPRRAPGQPDGAVA<br>RRPRATARPPAVQP<br>HQEDGGGGRPGRG<br>VRGAGERRPGELGA<br>GTHRRTQAREVCRR<br>QATPRAPRVEGPPLG<br>ARVRLARRGAGRQP<br>QGAY (SEQ ID NO:<br>1444) |
| NeSL | Utopia-<br>2_PU | — | *Pythium*<br>*ultimum* | TGACTGGTGTTTGATCACGATCAATGAGGTGATTAACATGAGCCGGAGC<br>AGGCCCCTTACACGCTGGTGCTGTAATGGTTCAGGAATGCTCTTATGAG<br>TAACTCCACAGTATAATTTTTGTTAGCGGGGGTGAGCGCGTGCGCCGCC<br>CCCACCTTTCTCTTTTCGTTTGTATTTGGTTCCTCTGGAGCGACTTCCGTG<br>GCTTTTGTCGCGCGCTATCGCGCCCGGCATGAGGATCGTCGCTCCTGAC<br>GCCATGTGCGCCAGTATATCGGAGCCCCGTGCTCCGCTTGGGTGTGTGT<br>TCCGCCACGACGCCACGCGATTTGCGTGCACGGCATGCGCTGGCGACTT<br>CCGCTCAGTGCGCGAACTCGCGGTGCATCGTCGACGTGCGCACCGGTCT<br>CTGGCCTTCCAGGACTGGTATGAGTCGTCGTGCGCGTGCAGAGCGCTCT<br>TCACCGCCCGTCTCGACGCGTTCGTTCATTCGAGCCGTTGCGACCACAAT<br>GCGAACCAATCAGCGAACGCCGTCCCCTCGTCCGCCGCCTCGACAACGA<br>GAGCGGACGCGGATGCGACGGCCCCCCCTCCCGCTATCTCTCTTCCGCG<br>GACGGGCTTCCCCCGCCCCTGTCCTAGTTGCGCCGCTCTCCTTCTGGATG<br>CGGCAACTTGGACGACCCACGTGCACGCGTGCGCTGCCGCCAGTGCGA<br>CGGCGTTGATCCAGCGTCATCTACACGCCGTTCCTCCCGTATCGACAGCA | TGACTGGT<br>GTTTGATC<br>ACGATCAA<br>TGAGGTGA<br>TTAACATG<br>AGCCGGA<br>GCAGGCCC<br>CTTACACG<br>CTGGTGCT<br>GTAATGGT<br>TCAGGAAT<br>GCTCTTAT<br>GAGTAACT<br>CCACAGTA<br>TAATTTTT | TAAGCG<br>GGGGGT<br>CCAGAC<br>CCCACA<br>AGAGAG<br>AAGCAG<br>GAATCA<br>TGGTCC<br>GCATGG<br>ACCAGT<br>AGGGCA<br>CGCTCC<br>ACAAAG<br>GTTATC<br>GCCCTC | MDYDDSEFFDAICIP<br>DEDADVLDDGDEGD<br>EGGNDDESSEPLPLAI<br>TNAPSAPLHATMLC<br>GTVTQPWLLRFDGA<br>CRRNPGPAGAGATL<br>TRPNGIILWTHYRYIP<br>DKTATNNVAEYEALL<br>DGLRCAAHHGVKHL<br>RIEGDSNLVIEQVKGI<br>FACSTSLRPRRDQVR<br>EILRHFETYSFRHIDR<br>ALNRQADRLANQAL<br>DLLKTVSVCALSQTR<br>VQDDTGAAHGCWH |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACCGATCTCAACGGCGATGATAGCCAACCTCCAGACCCGCGTGCCAACA | GTTAGCGG | AAACCC | WTPPDASPTDDASTS |
| | | | | TCCAACAGCTTCCAGCCATCCATTCGACAACGACAACGACAACGACAAC | GGGTGAG | ATCACA | ILTQDVPVPMDIDDY |
| | | | | GACGACGACCCGCTGCTCGACGACGTGCTCATGGACTACGACGACTCG | CGCGTGCG | CGAAGG | DPDEPMNAADDPVS |
| | | | | GAGTTTTTCGACGCCATCTGCATTCCAGACGAAGACGCTGACGTGCTCG | CCGCCCCC | ATCTAA | INAEREGGTVYPVLRL |
| | | | | ACGATGGTGACGAAGGTGACGAAGGTGGTAACGACGACGAGTCGTCC | ACCTTTCT | AAAGAA | GPNVVPERQKRLQIP |
| | | | | GAGCCACTGCCTCTAGCGATCACGAACGCTCCAAGCGCTCCCTTGCACG | CTTTTCGTT | AGCAAC | WLPPREMQKLEKKIE |
| | | | | CGACCATGCTCTGCGGCACAGTTACACAGCCATGGCTCCTGCGCTTCGA | TGTATTTG | AATCGA | VLGETFASRIRDAPD |
| | | | | CGGCGCGTGCCGACGCAACCCAGGACCCGCCGGCGCCGGCGCCACGCT | GTTCCTCT | AATAGT | WFSAEGYITALTSELA |
| | | | | CACGCGGCCCAATGGTATCATCCTATGGACGCACTACAGGTATATCCCG | GGAGCGA | AAATAG | TLIRQSTAATTGPNA |
| | | | | GACAAGACGGCGACCAACAACGTTGCCGAGTACGAAGCGCTGCTTGAC | CTTCCGTG | TAAATA | ARPCERTISKEKRRAR |
| | | | | GGGCTGCGCTGCGCGGCGCACCACGGCGTCAAACATCTGCGTATTGAA | GCTTTTGT | GCTTAG | RTTPLQRALAEAKHE |
| | | | | GGTGACTCCAACCTCGTCATCGAGCAAGTCAAAGGCATCTTCGCGTGCT | CGCGCGCT | AAAGGT | LQIIQPDASRKSVRKA |
| | | | | CCACATCGCTGCGCCCGCGCCGCGACCAAGTCCGCGAGATCCTGCGCCA | ATCGCGCC | CAACAT | ARRVKRISQAQQRH |
| | | | | CTTCGAGACCTACAGCTTCCGCCACATCGACCGCGCACTTAATCGACAA | CGGCATGA | GCGAAA | DLRRLFSTNERRCVEK |
| | | | | GCCGACCGCCTGGCCAACCAGGCACTCGATCTCCTCAAGACGGTCTCCG | GGATCGTC | TGCATG | ILRDPPVGPSSTSSSL |
| | | | | TGTGCGCGCTCTCTCAAACTCGCGTCCAAGACGATACCGGTGCCGCACA | GCTCCTGA | AGGAAC | PATDDDRCTIDPADL |
| | | | | TGGGTGCTGGCACTGGACGCCGCCAGATGCGTCGCCAACCGACGATGC | CGCCATGT | GTAAGA | FAYFQTQATAPTNFD |
| | | | | ATCCACGTCGATACTCACGCAGGACGTTCCAGTCCCCATGGATATCGAT | GCGCCAGT | TGGTAA | FDDEGGELFRSVLDE |
| | | | | GATTACGACCCCGACGAGCCCATGAATGCGGCCGATGATCCAGTCAGC | ATATCGGA | TACATTT | LPRADQEVHLLEDEIT |
| | | | | ATTAATGCTGAACGAGAAGGTGGTACTGTCTACCCAGTGCTTCGCCTCG | GCCCCGTG | TTATA | RDEIEDQLSRISKSTA |
| | | | | GTCCCAACGTCGTCCCCGAACGACAAAAGAGGTTGCAAATCCCGTGGCT | CTCCGCTT | (SEQ ID | PGLDGITNAVYVRFK |
| | | | | CCCGCCGCGTGAGATGCAAAAACTCGAAAAGAAGATCGAAGTGCTGGG | GGGTGTGT | NO: | LQLLDALQAAFNAC |
| | | | | GGAGACTTTTGCGTCGCGCATTCGTGACGCGCCCGATTGGTTCTCTGCA | GTTCCGCC | 1323) | WRYNRVPSMWKAA |
| | | | | GAAGGCTACATCACGGCTCTAACGTCCGAGCTTGCAACGCTCATTCGCC | ACGACGCC | | FVRLIYKKGNRAVPS |
| | | | | AATCAACGGCGGCGACGACGGGACCGAATGCAGCACGACCCTGCGAGC | ACGCGATT | | NWRPICLQQTVYKLY |
| | | | | GCACCATCAGCAAGGAAAAGCGGCGCGCGCGAAGAACGACACCGTTAC | TGCGTGCA | | TAILASRLQRWMDA |
| | | | | AACGCGCGCTCGCGGAGGCAAAGCACGAGCTCCAGATCATTCAGCCTG | CGGCATGC | | NARFTMSQKGFRAF |
| | | | | ATGCCTCGCGCAAGAGCGTGAGGAAGGCTGCACGACGAGTCAAACGGA | GCTGGCGA | | NGCHEHNFVATCLH |
| | | | | TCTCCCAAGCGCAGCAGCGCCACGACCTGCGTCGCCTCTTCTCGACCAA | CTTCCGCT | | DQTRRLRKKLAIVWY |
| | | | | CGAGCGTCGTTGTGTCGAGAAAATCCTTCGTGATCCCCCAGTGGGGCCA | CAGTGCGC | | DLRNAFGSLPHEYLW |
| | | | | TCGAGTACCAGCTCCAGCTTGCCAGCCACCGACGATGACCGCTGTACCA | GAACTCGC | | RVLARLGMPPQFVA |
| | | | | TTGACCCAGCCGACCTGTTCGCCTACTTCCAGACGCAAGCCACGGCCCC | GGTGCATC | | RVRQLYADASFTVES |
| | | | | AACGAACTTCGACTTTGACGACGAAGGCGGCGAACTGTTCCGCTCGGTG | GTCGACGT | | RDGTTDPVQLERGVY |
| | | | | CTCGACGAACTGCCGCGCGCCGACCAAGAGGTTCACCTTCTTGAGGACG | GCGCACCG | | QGCPLSPYLFIAALIPL |
| | | | | AGATCACTCGGGACGAGATCGAAGACCAGCTCTCGCGCATCTCGAAATC | GTCTCTGG | | VRALHKLKDQHGIVL |
| | | | | GACGGCACCGGGACTCGACGGCATCACGAACGCTGTGTACGTGCGCTT | CCTTCCAG | | APGVTDCVSAYADDI |
| | | | | CAAGCTACAGCTGCTTGATGCGCTACAAGCTGCATTCAATGCATGTTGG | GACTGGTA | | KIFARSGTGAKALHEI |
| | | | | CGATACAATCGTGTTCCCAGCATGTGGAAGGCGGCGTTTGTGCGTCTGA | TGAGTCGT | | VVRFLSWTNMAANP |
| | | | | TCTACAAAAAGGGCAATCGCGCTGTGCCAAGCAATTGGCGGCCGATCT | CGTGCGCG | | AKCALMVTDGARGG |
| | | | | GCCTACAGCAGACAGTGTACAAACTATACACAGCCATCCTCGCCTCGCG | TGCAGAGC | | DDTDASMTLSIEGETI |
| | | | | ACTGCAGAGATGGATGGACGCGAACGCGCGGTTCACGATGTCGCAAAA | GCTCTTCA | | PRLTGKEGYVYLGVE |
| | | | | AGGATTTAGAGCGTTTAACGGTTGCCACGAACACAATTTTGTGGCTACC | CCGCCCGT | | DGLAHERRATCLRDS |
| | | | | TGTCTACACGACCAAACACGACGCCTTCGAAAGAAGCTTGCGATCGTGT | CTCGACGC | | LKAASADVVRLLRSD |
| | | | | GGTATGATCTCCGGAACGCATTCGGCTCGCTCCCGCATGAGTATTTGTG | GTTCGTTC | | LAPWQIVRAIKSHVL |
| | | | | GCGAGTACTGGCGCGCCTTGGCATGCCACCGCAGTTTGTCGCAAGAGT | ATTCGAGC | | SRFDYVLRHLRPFLSL |
| | | | | GAGGCAGCTGTACGCGGATGCAAGCTTCACCGTGGAATCCCGTGACGG | CGTTGCGA | | FDGFDKMLVRGIKRL |
| | | | | GACGACAGACCCCGTCCAGCTGGAGCGTGGCGTATATCAAGGGTGTCC | CCACAATG | | CQLPQTATSEFLFSPT |
| | | | | TCTGAGTCCATACTTGTTTATCGCCGCACTCATTCCGCTGGTGCGCGCAC | CGAACCAA | | SAGGLGFLPLKELFAA |
| | | | | TCCACAAGCTCAAAGACCAGCACGGCATCGTGCTGGCTCCCGGCGTCAC | TCAGCGAA | | LQIVHALQMLHSKDA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGACTGCGTCTCGGCTTATGCCGACGACATCAAGATTTTCGCTCGATCG | CGCCGTCC | | NVRAIARHQALQVV |
| | | | | GGAACCGGCGCCAAAGCCCTCCACGAGATCGTGGTGCGATTTCTGTCCT | CCTCGTCC | | RKRYALQSDHWSDR |
| | | | | GGACGAACATGGCAGCGAACCCGGCCAAGTGCGCGCTGATGGTGACCG | GCCGCCTC | | EEELLEEFFNGTLERS |
| | | | | ATGGCGCTCGTGGCGGTGACGACACCGATGCGAGCATGACGCTATCTA | GACAACGA | | PFALAKKVSGDIASL |
| | | | | TCGAAGGTGAGACGATCCCACGCCTCACCGGCAAAGAAGGCTACGTGT | GAGCGGA | | WTDVRVNLTKYGLKF |
| | | | | ATCTCGGAGTGGAAGATGGGCTCGCGCATGAGCGCAGAGCAACGTGCC | CGCGGATG | | GEAHGRRLQPLVSHT |
| | | | | TGCGCGACTCGCTCAAGGCAGCGAGCGCGGATGTCGTCCGCCTGCTTCG | CGACGGCC | | DKQLAPQQWASAIK |
| | | | | CAGCGACCTCGCACCTTGGCAAATCGTGCGTGCGATCAAGTCGCACGTG | CCCCCTCC | | THMRLRHLKRWTTL |
| | | | | CTCTCGCGTTTCGATTATGTACTCCGACACTTGCGCCCGTTCCTTAGTCTC | CGCTATCT | | VDQGKTARMHERIG |
| | | | | TTTGACGGCTTCGACAAGATGCTGGTGCGCGGAATCAAGAGGCTGTGC | CTCTTCCG | | SAFLTRPSGVYDASY |
| | | | | CAGCTGCCGCAAACAGCCACGTCCGAGTTTTTGTTCTCGCCCACCTCGGC | CGGACGG | | AFAVRARLNQVDTRS |
| | | | | GGGTGGCCTCGGCTTCCTGCCACTGAAGGAGCTTTTTGCGGCGCTGCAG | GCTTCCCC | | ALKRKRIVNNSRCRV |
| | | | | ATTGTGCACGCACTTCAAATGCTGCACTCGAAGGACGCCAACGTCCGTG | CGCCCCTG | | SGCSELETLAHVLNH |
| | | | | CCATTGCACGGCACCAAGCGCTGCAAGTGGTGCGTAAGCGCTACGCGC | TCCTAGTT | | CRFGSDSIRARHAETL |
| | | | | TGCAGTCTGACCATTGGAGCGACCGCGAAGAGGAACTTCTCGAAGAGT | GCGCCGCT | | LLIKTTMERELTRPGR |
| | | | | TCTTTAACGGCACGCTGGAGCGCTCGCCCTTCGCCCTCGCAAAGAAAGT | CTCCTTCT | | QHQRLLVDATVPEAR |
| | | | | GTCAGGGGACATCGCGTCACTCTGGACGGATGTACGAGTGAATCTCACC | GGATGCG | | DPVPSNDAAESNIGA |
| | | | | AAGTACGGACTCAAATTCGGCGAGGCGCACGGACGGCGACTGCAGCCG | GCAACTTG | | MAPSISHLRPDIQLYD |
| | | | | CTCGTCAGTCACACTGACAAGCAGCTTGCACCTCAACAATGGGCTAGTG | GACGACCC | | NKTMEAVIIDLAVAF |
| | | | | CAATCAAGACGCACATGCGCCTGCGCCACCTCAAGCGATGGACCACCCT | ACGTGCAC | | EDQSTDDAASSSSFA |
| | | | | GGTCGACCAGGGTAAGACAGCCCGGATGCATGAGCGCATCGGAAGTGC | GCGTGCGC | | RVKGVKTKKYEVIKQ |
| | | | | GTTTCTGACAAGGCCGTCTGGAGTGTACGACGCCAGCTATGCGTTCGCG | TGCCGCCA | | FLEYKGYTVHVAALV |
| | | | | GTTCGAGCAAGACTAAACCAAGTCGATACGCGCAGCGCATTGAAGCGC | GTGCGACG | | YGSLGSVDTGNFAVY |
| | | | | AAGCGCATCGTGAACAATAGCCGCTGCCGTGTGAGTGGATGCAGCGAG | GCGTTGAT | | TERLGLRKGAVRRLE |
| | | | | CTGGAAACGCTCGCCCACGTACTGAATCACTGCCGATTCGGGTCAGACT | CCAGCGTC | | CSLSARHINFAHRM |
| | | | | CGATACGAGCACGACACGCAGAGACACTCTTGCTGATCAAGACGACCAT | ATCTACAC | | WRRHAIAHTTGLRLI |
| | | | | GGAACGTGAGCTCACGCGGCCAGGGCGGCAGCACCAGCGCCTCCTGGT | GCCGTTCC | | GTNSVQQQGVQRA |
| | | | | CGACGCGACAGTACCCGAAGCTCGTGATCCCGTACCAAGTAATGACGCT | TCCCGTAT | | PAEKQQHQRPVQRP |
| | | | | GCTGAGAGCAACATTGGCGCAATGGCACCCAGCATCTCCCACTTGCGCC | CGACAGCA | | SRAQAPRDQPSQQQ |
| | | | | CCGACATTCAACTCTACGACAACAAGACAATGGAAGCCGTGATCATCGA | ACCGATCT | | QSQQSFQQQSQQS |
| | | | | CCTCGCGGTTGCGTTCGAAGACCAGTCAACGGACGACGCCGCATCCAGT | CAACGGCG | | QQSQQSQQSQQSR |
| | | | | TCCAGTTTCGCGCGCGTCAAGGGTGTGAAGACAAAGAAATATGAGGTA | ATGATAGC | | QRHAPTPTPVPVPVP |
| | | | | ATCAAGCAATTTCTGGAATACAAAGGCTACACTGTGCATGTAGCAGCGC | CAACCTCC | | VPVSTPTLTPTPTPTR |
| | | | | TAGTCTATGGTTCACTAGGCTCCGTTGACACCGGCAACTTTGCCGTGTAT | AGACCCGC | | RPKPAPSSTQPQQG |
| | | | | ACGGAACGTCTCGGTCTCCGCAAGGGCGCAGTGCGGCGACTGGAGTGC | GTGCCAAC | | APAQRRQQREQKKQ |
| | | | | TCGCTCTCGGCGCGCCACATCAACTTCGCGCACCGTATGTGGCGACGCC | ATCCAACA | | PACRRRHATAVRETP |
| | | | | ACGCGATCGCCCACACGACCGGTTTGCGCCTTATCGGCACGAACAGCGT | GCTTCCAG | | PAAPTAARTATPTAR |
| | | | | GCAACAGCAGGGTGTGCAGCGCGCCCCGGCAGAGAAGCAACAACATCA | CCATCCAT | | PTATTRSTSTTRSTAT |
| | | | | GCGACCAGTGCAGCGACCCAGCCGCGCGCAAGCTCCACGTGATCAGCC | TCGACAAC | | ATSTTRSSAPTSRPSA |
| | | | | ATCGCAGCAACAGCAGTCCCAGCAGTCGTTCCAGCAGCAGTCCCAGCAG | GACAACGA | | PRPRSSAPRPRSSAPT |
| | | | | TCCCAGCAGTCCCAGCAGTCCCAGCAGTCCCAGCAGTCGCGTCAACGCC | CAACGACA | | TRSAAPTTRSAAPTAI |
| | | | | ACGCCCCAACTCCTACCCCAGTCCCAGTCCCAGTCCCAGTTCCAGTATCG | ACGACGAC | | ATTSVYKSRRTTNAIS |
| | | | | ACACCGACACTAACACCGACACCGACACCGACACGCCGGCCCAAGCCG | GACCCGCT | | GATTRRSASSKRAPM |
| | | | | GCTCCGTCCTCGACTCAACCCCAGCAAGGAGCTCCAGCACAGCGACGAC | GCTCGACG | | QPRTALTPTQQQR |
| | | | | AACAACGAGAGCAGAAAAAGCAACCTGCGTGCCGCCGTCGACACGCAA | ACGTGCTC | | Q (SEQ ID NO: 1445) |
| | | | | CGGCAGTGAGAGAGACACCGCCAGCAGCTCCGACAGCAGCTCGGACAG | (SEQ ID | | |
| | | | | CAACTCCGACAGCGAGACCGACAGCGACAACGAGATCAACATCGACAA | NO: 1200) | | |
| | | | | CGAGATCAACAGCGACAGCGACATCGACAACGAGATCATCAGCACCGA | | | |
| | | | | CATCGAGACCATCAGCACCGAGACCGAGATCATCAGCACCGAGACCGA | | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GATCATCAGCACCGACAACGAGATCAGCAGCTCCGACAACGAGATCAG<br>CTGCACCGACAGCGATAGCGACAACCAGCGTTTACAAAAGTCGACGCAC<br>GACCAACGCCATCTCTGGCGCAACGACGCGACGCAGTGCGTCATCCAA<br>GCGTGCGCCAATGCAGCCCCGAACTGCATTGACGCCAACACAACAACAA<br>CAACGACAGTAAGCGGGGGGTCCAGACCCCACAAGAGAGAAGCAGGA<br>ATCATGGTCCGCATGGACCAGTAGGGCACGCTCCACAAAGGTTATCGCC<br>CTCAAACCCATCACACGAAGGATCTAAAAAGAAAGCAACAATCGAAATA<br>GTAAATAGTAAATAGCTTAGAAAGGTCAACATGCGAAATGCATGAGGA<br>ACGTAAGATGGTAATACATTTTTATA (SEQ ID NO: 1077) | | | |
| NeSL | Utopia-3_PI | — | *Phytophthora infestans* | GTACGGCCGAATCCCTGGCCTCTCAGCCTGTACGCGGGGCTATACTTGG<br>TCTAAGTATGCCCCGGTCGCTGGCCTCTGAGCCCGTACACAGCTCGGCC<br>TCGCGGCTGCCTTCCCAGGCGCCGCCGACTTCGCGCTCTGGCGCGGCCC<br>ACACGCCGCCGCCGAGCCTCCAAGCGCGCCCGTTGGCTTCCGCAGACGC<br>AGGGCTCGCGGCGACGGCCCTCGCCAGCCCCCAAGACCCCCCCTACGAT<br>GTGGCACCACCCGGCAGGGCGGCCGGCAGGCTGCCCGACTCGGTATCG<br>CCGGGTGCTACACTCTCAGCCGCCACAGCTCGGGCCTTGGCGGTCCGCC<br>ATTGGCCCTTGGAGCTCGACAGCGACAGCAGCGACGACGAGGACGCTC<br>AAGACCCCCACGCCGCCGCCCCAGGACCCCCCGCAGACGTCGCGAGTG<br>TGCTTGCCCCACCCGGCAGGGCAGGCAGCATGCTCGCCGACCCAGCAG<br>CGCTGGCAGCCGGTCTGGCTCGCGCTCCGCCGCCCCCATCGGCACCCCA<br>GGACCCAAGCCCCGCCCTCCCTGCTGGCCCCGCCGGCCAGAACCCTCGC<br>GCCGCCGCCCCAGCCCGTGTTGAAGTCCACACAGTCGTGGCACCACCCG<br>GCAGGGCGGGCGGCATGCTGCCCGACCCGGGGTTGGTTGACTCAAGCC<br>CAGCAGCGGCTACCGCAGCTACTCCAGCTCCGGTAGCTGCTACTGCTAC<br>AACTGCTCGCGTCGCCGTGGAGCACCACGCGCACGCTGAGCCGAACCA<br>AGAACATCTACCGATGGCTCGCGTGCTCGTGGAGCCCATGCAGGTCGAC<br>GAGTGCAGCAGCTGCGACCGCAGCACTTTGACAGCCGACGACGGGAGC<br>GGTGACGACGTTGCAGCCCCAAGCTCCATGCTCAGCAACGACGTCGCCG<br>CCCCCATGGACGTTGACTCCGGCACCAGTTGCCCTCCAACGTTGCAGCA<br>GCCGCTCCAGCGACCGCGTGCGCTGCACGTAGGCAGCAAGCGCCGCCG<br>ACTCAACGCAGATGACGGTGAAGAAGCTCACCAGCTGCAAGAAGAGGA<br>GGAGGCTGGCATTCATGCCCCAGCGCTCAGGCTATCCGCGGCCAGCGCT<br>CAACCGGCCTCCGTCCTTGCCGTGTACACGCACAACGCGTCGCGGTTCG<br>ACTGCACGCTGTGCGCGTACACGGCCGGCAGCTTCGCATCACTGAAGAC<br>GCACAGGAACTCTCGGCACCGCCGCACCGCATTCCTCGACCGATTCTCG<br>GCGGGTTGCGCGTGTGGCGTGCCCTTCGCCTCGAGGCTGGCTGCAGCA<br>AGACACGCGCAAGCGTGCGCCAGCCTCTCGAGCGCACCATTGGCCGAG<br>GCTTCGTCGGCAGCAGGAGCATCAAGCCACACTGTCGACGGAGCCGAC<br>TCCACCGTCTCAGCCGCGGGTCACGCTGAGCCCGACCTGCCCCGCCACA<br>ACGCCACGGAGCTCACAGCGTCCCCCCCGCTGGTGAGCTCCACCGATGT<br>TGAAGTGCAGGCAACAGAGACCGAGGCCACCGAGAACCGCTGGGGCA<br>CTCCACTTCCGCGCGTGCTGGTCGCGTCTAGGATCGCCGGGCGCCTCGC<br>TCAGGTGCCACCCCCACGCTGGGGCCCCCGCTACCGCGCACCACCATC<br>GCGGGCCGCATTGCGACGAGGCTCGCCGCCACACCTGCCCCCCGCTGG<br>AGCCCACCGCTTCCACGAAGCCTGGTTGCGTCACGCATCGCCGGCCGCC<br>TGCTACCCGCTCTGCCAGACGCGCCTGCATGCGAGGACGAGGCCAAGG<br>ACAGCGACGAAATGGACTGGGAGGCGAGCGAGCCGCACGTCGAAGCG<br>CCAGGGCCGGTCGACGAGGAGACCATCGACGACGCCGACGGCGAGTG | GTACGGCC<br>GAATCCCT<br>GGCCTCTC<br>AGCCTGTA<br>CGCGGGG<br>CTATACTT<br>GGTCTAAG<br>T (SEQ ID<br>NO: 1201) | TAGACG<br>GCAAAG<br>TTCTGG<br>CCCGCG<br>TAGGCC<br>GAAAGG<br>GCCCCG<br>CCCAGG<br>TAGGGT<br>AACGCC<br>CTCGGG<br>AAAACC<br>ATTCTG<br>GTGTTT<br>GGCTGT<br>TTTTCAA<br>CAGTCG<br>AACTTCA<br>ACTCGG<br>AGCATA<br>TCAGAT<br>ACACTTA<br>CTCACAC<br>ATTTAG<br>ATATCA<br>GATAGG<br>GAACCT<br>TTATTAG<br>GGAGAT<br>AACGGG<br>TACACC<br>GGATGG<br>TAAATAT<br>ACAAAA<br>CCTTCTC<br>TGTTCTA<br>ATCAGT<br>GTGAAA<br>ACTGGT | MPRSLASEPVHSSAS<br>RLPSQAPPTSRSGAA<br>HTPPPSLQARPLASA<br>DAGLAATALASPQDP<br>PYDVAPPGRAAGRLP<br>DSVSPGATLSAATAR<br>ALAVRHWPLELDSDS<br>SDDEDAQDPHAAAP<br>GPPADVASVLAPPGR<br>AGSMLADPAALAAG<br>LARAPPPPSAPQDPS<br>PALPAGPAGQNPRA<br>AAPARVEVHTVVAPP<br>GRAGGMLPDPGLVD<br>SSPAAATAATPAPVA<br>ATATTARVAVEHHA<br>HAEPNQEHLPMARV<br>LVEPMQVDECSSCD<br>RSTLTADDGSGDDV<br>AAPSSMLSNDVAAP<br>MDVDSGTSCPPTLQ<br>QPLQRPRALHVGSKR<br>RRLNADDGEEAHQL<br>QEEEEAGIHAPALRLS<br>AASAQPASVLAVYTH<br>NASRFDCTLCAYTAG<br>SFASLKTHRNSRHRR<br>TAFLDRFSAGCACGV<br>PFASRLAAARHAQAC<br>ASLSSAPLAEASSAAG<br>ASSHTVDGADSTVSA<br>AGHAEPDLPRHNAT<br>ELTASPPLVSSTDVEV<br>QATETEATENRWGT<br>PLPRVLVASRIAGRLA<br>QVPPPRWGPPLPRT<br>TIAGRIATRLAATPAP<br>RWSPPLPRSLVASRIA<br>GRLLPALPDAPACED |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCTCCTGCGCTTTGACGGTGCCTGCCGTGCCAACCCAGGCCCAGGCGGC | | TTTCGCC | EAKDSDEMDWEASE |
| | | | | GCCGGCGCAGCTCTCTTCAAGCCAAGCGGTCCCGTAGTGTGGACTTGTT | | TTTTGGC | PHVEAPGPVDEETID |
| | | | | CCCACTACGACCCGAGCACCACGGCAACGAACAACACAGCAGAGTACA | | GGACTT | DADGEWLLRFDGAC |
| | | | | CTGCGTTGCTTCTCGGGGCCAGGGCCGCCGCCGACCACGGCGTCACGA | | TTTCACT | RANPGPGGAGAALF |
| | | | | AGCTGCGCGTCGAGGGCGACAGCACGCTGGTCATCCAGCAAGTGCGGG | | CGCATTT | KPSGPVVWTCSHYD |
| | | | | GCATCTTCGCGACGAGAAGCACGCGGCTCCGAGCACTGCGCAACAAGG | | TTGGGC | PSTTATNNTAEYTALL |
| | | | | TCAAGCTCGAGCTCGCGCGCGTGGGGAGCTTCTCGCTCCACCACATCGA | | AATCGT | LGARAAADHGVTKL |
| | | | | CCGGCAGGCGAACGGTCACGCCGACCGCCTTGCCAACGCCGGCCTCGA | | CTGCGG | RVEGDSTLVIQQVRG |
| | | | | CCGACGCCGCACCCAGCTCGAGTGCAGTGTGCACCCCGATGGTAGGGG | | CTAGCTT | IFATRSTRLRALRNKV |
| | | | | CTGCACCAACACCTCCGTAGCGACCGCAGCGCCTACAGCTTCTGCAGCA | | GCTAGC | KLELARVGSFSLHHID |
| | | | | CCCTCGACCCCAACCCGGCCTCCTGCAACTACGGCCGCTCCGTTTCACAG | | GGCGGA | RQANGHADRLANAG |
| | | | | CGACCAAGGCCACATCGACGAGGACGACGAACGTCGTGCCGACATCGA | | CGAGCG | LDRRRTQLECSVHPD |
| | | | | CGACGGTGAAATCTACGCCCCAATGACGCTCGGGCCAGACGAAGTGCC | | GTCTCC | GRGCTNTSVATAAPT |
| | | | | TGCTCGGCGACCGCGCCTCCGACTCCGCCAACTCAGCGACGAAGAACTC | | GGGGGC | ASAAPSTPTRPPATT |
| | | | | GAGGCCGCTGGTGCCATCGTGGAAAGGCTCAGCGCATCGTTGTCAGCC | | GTTCACC | AAPFHSDQGHIDED |
| | | | | AAGATCACCGACGCAGAAGACTGGGGGACGGCAGAAGGCTACATTACG | | TTTCCCC | DERRADIDDGEIYAP |
| | | | | GCCCTGCCTCACCTGCTGTACGACAAGCTCCTACCGTACTCGCGGACAG | | CGCGAG | MTLGPDEVPARRPRL |
| | | | | CGCCCCGTCATCAGCGGCCACCCCGGCCATCGCGCAACCAGCAAGACCA | | GCCAAC | RLRQLSDEELEAAGAI |
| | | | | CCCGCAGCCGCGACGCGACCAACCGCAGCGCAACGTGGACGAACAGCA | | TACACC | VERLSASLSAKITDAE |
| | | | | GCATGCGGAGTCACAGCAGGGTGAAGACCAGCGACAGCAGCAGCCGC | | GATCTTC | DWGTAEGYITALPHL |
| | | | | CGACGCGCCGCCGACGTCGGCGAGGGAAGCGTAGAGGCCGCCGACAG | | TCTACAC | LYDKLLPYSRTAPRH |
| | | | | CGACGACACCCTCGCCAGCCAGGACAGAGTACCAGAGCCTCCCAGCAA | | TTTTCTA | QRPPRPSRNQQDHP |
| | | | | AGCCGGCAGCGCCGACCCCGACCCCCGCGCGTTACCCGCCACCACCGCG | | ATTCGCC | QPRRDQPQRNVDEQ |
| | | | | AGCACCGCATCGACGAGGCGTTGGATGAGCTCCATACACTGGAGCGGG | | TCCGTCT | QHAESQQGEDQRQ |
| | | | | CGCGGCCACAGGACCGATCGGCGATTGACAAGGCGAGACGGCGCGTC | | TCGGTC | QQPPTRRRRRRGKR |
| | | | | GGACGTGTCCGCGGGGCCATCAACCAACACCTGCTGCGCCACCGGTTTG | | TTCGGTT | RGRRQRRHPRQPGQ |
| | | | | ACACCGACGAGAAGGCGTGCGTGGCGGACATCTTGGAGAAAGCGCAC | | GTCGGG | STRASQQSRQRRPRP |
| | | | | GCGGCGCGAGCGGCACGTACGGCACAGGCGGCGGGCGCAGCAACGTC | | CTTTTTT | PRVTRHHREHRIDEA |
| | | | | TACAGGAGGAGCAGCGACAGCACCAACACAGCAAGCAGCCACGTCAGC | | CTTTTTG | LDELHTLERARPQDR |
| | | | | CCTTGGTGATGCCGACGACGGAACCTGCCCCATCCTGGCCGACGAGCTC | | ACCAAT | SAIDKARRRVGRVRG |
| | | | | TGGCAGTACTTCACCGGCACCAACACGCCGCGCTGGGAGTTCAACCCCG | | CAGAGC | AINQHLLRHRFDTDE |
| | | | | CGACACCCGTCGGCGAGGCGTTCCGTACGGCGATGGCAAGGCTTCCTCC | | GCGCCA | KACVADILEKAHAAR |
| | | | | GGCGACGAGGCTCCGCGAACTGCTGACAGAAGCCCCGACTGCGGACGA | | TGCGAC | AARTAQAAGAATST |
| | | | | AATCGAGACCCAGCTACAGCACGTGCGGGGATCCTCGAGCCCAGGACT | | TCTTCTG | GGAATAPTQQAATS |
| | | | | CGATGGCATCGGCTACGACGTCTACCAGCGCTTCGCACAGCAACTGCTC | | GCCAAT | ALGDADDGTCPILAD |
| | | | | CCGGTGCTCACCGCTTCGTTCAAGCGATGCTGGACAGCCAAGATGGTGC | | CAGAGA | ELWQYFTGTNTPRW |
| | | | | CACAGAGCTGGCAGGTGGGGGTCGTGCGACTGCTGTACAAGAAGGGC | | CCGGGC | EFNPATPVGEAFRTA |
| | | | | GCGCATGACGACCCGGCAAACTGGCGGCCCATTTGCCTCCAGCAAGCCA | | CCTGTCC | MARLPPATRLRELLT |
| | | | | TCTACAAGCTTTACACAGGTGTACTTGCTCGGCGACTCGTGCGGTGGCT | | TCGGAC | EAPTADEIETQLQHV |
| | | | | GGACGTGAACGACAGGCACGCACCAGGACAGAAGGGGTTCAGGGCAG | | AGCGAG | RGSSSPGLDGIGYDV |
| | | | | TGAACGGCTGCGGGGAGCACAACTTCCTCGCAGCCACGCTCATCGACCA | | GCCTCC | YQRFAQQLLPVLTAS |
| | | | | AGCACGTCGCAAGCGCCGATCCCTATACGAGGTATGGTACGACTTCAGG | | ACGGCC | FKRCWTAKMVPQS |
| | | | | AACGCCTTCGGCAGCGTGCCATTCCAGCTGCTGTGGGACTCGCTGCAGC | | AGCCAA | WQVGVVRLLYKKGA |
| | | | | GCCTCGGCGCTCCCGCAGACTTCATCGACATGTGCAAGGGGCTGTACCA | | TCAAGT | HDDPANWRPICLQQ |
| | | | | CCAGGCCGCCTTCGTCATCGGGAACGCCGCCGACGGACCGACAGCAGC | | CTCGGC | AIYKLYTGVLARRLVR |
| | | | | AATCCGGCAGCAGGTTGGCGTCTTCCAAGGGTGCCCACTGAGCCCCCAG | | AGCGAC | WLDVNDRHAPGQK |
| | | | | CTCTTCAACGTCGCGATCAGCCCGCTGCTCTTCGCGCTCCGCAGGCTGCC | | GCGTCT | GFRAVNGCGEHNFL |
| | | | | GGAGACCGGGGTGCAGCTGTCCGGCGACGATCGTGTTGGAGTTTCGGC | | TTCTATA | AATLIDQARRKRRSLY |
| | | | | TTATGCGGACGACCTCAAGACCTTCAGCAGCACCAAGGCGGGCGCCAC | | GCGCAG | EVWYDFRNAFGSVP |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAAGCAACACGAGCTCGTCGCCGCGTTCCTGGCTTGGACTGGCATGAAA | | CTGACG | FQLLWDSLQRLGAP |
| | | | | GCCAACGCAGCCAAGTGCAGCAGCATGGGCGTACGGCGCAACAGCAAC | | AGGCCG | ADFIDMCKGLYHQA |
| | | | | GGCGCGACAGAGGCGGACAATCTGGACCTCGCGCTCGACGGCACTCCG | | ATCTGG | AFVIGNAADGPTAAI |
| | | | | ATCCCCAGCATGACTCACATGCAATCGTACACCTACCTGGGGATCGGAG | | CGGCCC | RQQVGVFQGCPLSP |
| | | | | ACGGTTTCGACCATGTGCACCGCCGCATCGAGCTCGCGCCCAAGCTGAA | | CCGATT | QLFNVAISPLLFALRR |
| | | | | GACGCTCAAGCAGGACACGACGGCGCTACTCGAGTCCGGCCTCGCGCC | | GGTCCG | LPETGVQLSGDDRVG |
| | | | | TTGGCAGGTGGTGAAGGCCGTGAAGGTTTACCTTTACCCTCGTGTCGAG | | ACTTTCG | VSAYADDLKTFSSTKA |
| | | | | TACGCGCTTCGGCATCTGAGACCCGAAGACCAGCTGCTGGAGAGCTTCG | | GCCAAT | GATKQHELVAAFLA |
| | | | | ACCTTCACCTCCGCGCCGGCCTTCGCCACCTGCTCCGCCTGCCCAAGAAC | | CAGCGA | WTGMKANAAKCSS |
| | | | | GCCAACAACGACTTCTTCTACTCGCCGGTCTCGCGCGGTGGCTTGGGAC | | CGACGA | MGVRRNSNGATEAD |
| | | | | TCCTGCCGCTGGTGGAGCTGCACGCGGCGCTACAAATCGCGCACGGGT | | GGGGGC | NLDLALDGTPIPSMT |
| | | | | GGCAGATGCTTAACTCGACGGACCCAGCCACCCGACGCATCGCGCGCG | | AGGGGT | HMQSYTYLGIGDGF |
| | | | | AGCAGCTCCACCAGATTGCGGATGCAAGGCACCGCCTTGACAAGGCAC | | TTACACT | DHVHRRIELAPKLKTL |
| | | | | ACTGGAAAGAGCGTGGCGATGAGCTCTGCCAGCTCTTCCTTAACTTGGA | | TTTGCCC | KQDTTALLESGLAPW |
| | | | | CCTCGGGACGTCGGCCCACGCACCGCCCAAACGCCGCAACTGCGACATC | | CCGTTTC | QVVKAVKVYLYPRVE |
| | | | | GGCTCGCTGTGGGTCGACGTCCGCAAGAACCTGCAGGCCTTTGGGCTCA | | GGCTTC | YALRHLRPEDQLLESF |
| | | | | AGCTCGAGACCGCCCCGGCCGACGCTGAGTCCGGCACACCCGCCCTGCC | | AACTTCA | DLHLRAGLRHLLRLPK |
| | | | | GCTGCAGCTTCGCGTGCCACACCACGAGAAGTGGTTGACGCACCGCGA | | GGCCAA | NANNDFFYSPVSRG |
| | | | | CGTGCTGCGGCACGTGAAGCAGCACCTGAAGAACAAACATTGGCGGGC | | AATGGC | GLGLLPLVELHAALQI |
| | | | | GTGGTGTGCCTTCCAAGACCAAGGCAGGACGGCACGGGCACACGGTGG | | GATTTG | AHGWQMLNSTDPA |
| | | | | GGTCGGCAGCAGCTTCATCACCCGCCCCCGTGGCATGTGGGAGAGCGA | | GACCCT | TRRIAREQLHQIADA |
| | | | | CTACCGCTTTGCGGTGGCCGCTCGCCTCAATATGGTGGACACGAGTGCC | | CCACGC | RHRLDKAHWKERGD |
| | | | | ACTCTCGCGCGCCGACGCCTCCGCGCCCATGACCGCTGCCGCTACCCGG | | GCCGTG | ELCQLFLNLDLGTSA |
| | | | | GCTGCCGCTGGAAGGAGTCACTGGAGCACGTGCTCAACCACTGTCCGG | | CCACTG | HAPPKRRNCDIGSLW |
| | | | | GCACGATGGACGCCGTGCGTGGCCGCCACGACGGTGTGCTCCGAGAGA | | CTCGGC | VDVRKNLQAFGLKLE |
| | | | | TTGAGCACGCGCTCCGTGCACCATCGGGAGCACGCAGAGAGCTGCGCG | | ACCGGC | TAPADAESGTPALPL |
| | | | | TGAACCAGACGGTTCCGGGCCTACCCGGCCCCGCACTACGCCCCGACAT | | GGCGAT | QLRVPHHEKWLTHR |
| | | | | CCAGGTCTACAACCACGACCAACGCACGGTCGCAGTGGTGGACCTGGC | | TCAGCG | DVLRHVKQHLKNKH |
| | | | | GGTGGCCTTCGACAGGCAGGACCGCGACGACCCAGAGACCTCGGGCCT | | GGTGCA | WRAWCAFQDQGRT |
| | | | | GGCCAAAGCCGCGGCGGAGAAGAAGGCCAAGTACACTGGCATCCAGC | | ACTTCG | ARAHGGVGSSFITRP |
| | | | | GACACCTCGAGCGCCAAGGGTGGAAGGTCCACCTTTCCGCGCTCGTCTA | | GGCACG | RGMWESDYRFAVAA |
| | | | | CGGGTCACTGGGCTCGGTGGCCCCCAACAACTACAAAGTCTACACGGA | | TGTGCA | RLNMVDTSATLARRR |
| | | | | GCACCTGGGGCTCCTCAAGCGTGACGCCAAGCGGCTGGACCGGACGCT | | ACACAT | LRAHDRCRYPGCRW |
| | | | | GTCGGTCGCGTGCATCCAGTCCAGCCGCCGCATCTGGAACCTGCACTGC | | GCAGCG | KESLEHVLNHCPGTM |
| | | | | GCCAAGCATCGGGCGCGGCAGCACCAGACGCCATCCCAGTCAAGGGGC | | CCCATTG | DAVRGRHDGVLREIE |
| | | | | AGGCGGGTGACGGAGACCGGGGGGGCTCCGTCGCGCACCGATCGCCG | | CACGCC | HALRAPSGARRELRV |
| | | | | CTAGACGGCAAAGTTCTGGCCCGCGTAGGCCGAAAGGGCCCCGCCCAG | | AAGCGG | NQTVPGLPGPALRPD |
| | | | | GTAGGGTAACGCCCTCGGGAAAACCATTCTGGTGTTTGGCTGTTTTTCA | | CATCGC | IQVYNHDQRTVAVV |
| | | | | ACAGTCGAACTTCAACTCGGAGCATATCAGATACACTTACTCACACATTT | | GGGACG | DLAVAFDRQDRDDP |
| | | | | AGATATCAGATAGGGAACCTTTATTAGGGAGATAACGGGTACACCGGA | | ACGCCT | ETSGLAKAAAEKKAK |
| | | | | TGGTAAATATACAAAACCTTCTCTGTTCTAATCAGTGTGAAAACTGGTTT | | CGGCCG | YTGIQRHLERQGWK |
| | | | | TCGCCTTTTGGCGGACTTTTTCACTCGCATTTTTGGGCAATCGTCTGCGG | | CTCAAG | VHLSALVYGSLGSVA |
| | | | | CTAGCTTGCTAGCGGCGGACGAGCGGTCTCCGGGGGCGTTCACCTTTCC | | CGCAGC | PNNYKVYTEHLGLLK |
| | | | | CCCGCGAGGCCAACTACACCGATCTTCTCTACACTTTTCTAATTCGCCTCC | | CCCGCC | RDAKRLDRTLSVACI |
| | | | | GTCTTCGGTCTTCGGTTGTCGGGCTTTTTTCTTTTTGACCAATCAGAGCG | | CTTCCAG | QSSRRIWNLHCAKH |
| | | | | CGCCATGCGACTCTTCTGGCCAATCAGAGACCGGGCCCTGTCCTCGGAC | | CACGAC | RARQHQTPSQSRGR |
| | | | | AGCGAGGCCTCCACGGCCAGCCAATCAAGTCTCGGCAGCGACGCGTCTT | | CTCGCG | RVTETGGAPSRTDRR |
| | | | | TCTATAGCGCAGCTGACGAGGCCGATCTGGCGGCCCCCGATTGGTCCGA | | CCGTTT | (SEQ ID NO: 1446) |
| | | | | CTTTCGGCCAATCAGCGACGACGAGGGGGCAGGGGTTTACACTTTTGCC | | GGCGGA | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCCGTTTCGGCTTCAACTTCAGGCCAAAATGGCGATTTGGACCCTCCACG CGCCGTGCCACTGCTCGGCACCGGCGGCGATTCAGCGGGTGCAACTTC GGGCACGTGTGCAACACATGCAGCGCCCATTGCACGCCAAGCGGCATC GCGGGACGACGCCTCGGCCGCTCAAGCGCAGCCCCGCCCTTCCAGCAC GACCTCGCGCCGTTTGGCGGATCGCCATCAAGACGTGCGAGAGCCAGG CGGGGTCGGGCAAAATATACTTACTCTAAGTATGCCCGAATCCCTGCCC TCTCAGGCTGTACGCGGCCCCATACTTGACCTAAGTATGGGAGGATCCC TGGCCTCTCAGGCTGTACGCGRGGACCAAGTACAGCCGAATCCCTGGCC TCTCAGCCTGTACGCGGGGCTATACTTGGTCTAAGTATGCCCCGGTCGC TGGCCTCTGAGCCCGTACGC (SEQ ID NO: 1078) | | TCGCCAT CAAGAC GTGCGA GAGCCA GGCGGG GTCGGG CAAAAT ATACTTA CTCTAA GTATGC CCGAAT CCCTGCC CTCTCAG GCTGTA CGCGGC CCCATAC TTGACCT AAGTAT GGGAGG ATCCCTG GCCTCTC AGGCTG TACGCG RGGACC AAGTAC AGCCGA ATCCCTG GCCTCTC AGCCTG TACGCG GGGCTA TACTTG GTCTAA GTATGC CCCGGT CGCTGG CCTCTGA GCCCGT ACGC (SEQ ID NO: 1324) | |
| NeSL | Utopia-3_PR | — | *Phytophthora ramorum* | TGCGCGGCAGACCAAGACGCGCAGCCAACAACAGACCGTGCAGCGTGC GGGTGGAAAGCGCCGCCGCCTGAACGCTGGTGACGATGAAGACCAGC GAGAGCTGGCCGAGCTCCTGCTCGTGGACGAGGACAAGGCTGGCGCCG AACACCCCGCGCTCAGGCTGCCCACGGCCAGCGCTCATCCGGCCTCCGT CCTCTCCGTGTACGCGCACGCTGCAACTCGCTTCGACTGCACGCTGTGCA CGTACACGGCTGCCAGCCTCGCTTCGCTCAAGCGCCACCGCTCGTCTCG | TGCGCGGC AGACCAAG ACGCGCAG CCAACAAC AGACCGTG CAGCGTGC | TAGACG GCAACA CTCTGG CCCGCG TCGGCC GAAAGG | MQDQVDAEQQARN RWGPPLPRPLVASRV AARLGEVPPPRWGP PLPRGVVVSRIAARLE AVPVPRGGPPLPRSF VATRIADRLAPPSPDL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCACCGACGCACGGCCTTCCTCGACAAGTTCTTGGCGGGCTGCGCGTGC | GGGTGGA | GCCCCA | SLLDEEMKESEPPDP |
| | | | | GGCACGCCCTTCGCATCGAGGTTGGCCGCAGCCAGACACGCGCAAGCG | AAGCGCCG | CCCACG | THHSADEDSTDAETA |
| | | | | TGCGCCAACCTCTGCACCACCTCGGCGACGACTTCGACGGCAGCAAAGG | CCGCCTGA | TAGGGA | DAVMEPAFVSDPPT |
| | | | | CATCAAGCCCCACTGCTGCCGGAGGCAGACCCACCGTCCGTGCAGTGGT | ACGCTGGT | ACCGCC | ATPREWRLQFDGAC |
| | | | | CACCGCCGCGCCCGACCTGCCCCGCCAGTATCCCTCGGAGCTCGTTGCG | GACGATGA | CTCGGG | RGGPNPGGAGALLY |
| | | | | TCCCCCCCGCAGCCGAGCTCCACCAACGTTGCAATGCAGGACCAGGTCG | AGACCAGC | AAACCC | NPEGAVVWTGSHY |
| | | | | ACGCAGAGCAGCAGGCGCGAAATCGCTGGGGCCCACCGCTCCCTCGAC | GAGAGCT | AGTCTG | MPGAKETNNSAEYT |
| | | | | CGCTGGTGGCCTCCCGGGTCGCAGCCCGACTCGGCGAGGTACCGCCGC | GGCCGAG | GTGTTC | ALLIGARAAADHGAR |
| | | | | CGCGATGGGGCCCACCACTTCCGCGAGGGGTGGTGGTGTCCCGTATTG | CTCCTGCT | GGCCAA | QLRIEGDSLLVIRQVK |
| | | | | CGGCCCGGCTGGAAGCCGTCCCAGTCCCACGCGGGGGACCCCCGCTCC | CGTGGACG | GAAATG | GLYATKSTRLRQLRN |
| | | | | CACGCAGCTTCGTCGCGACCAGGATCGCAGACCGCCTCGCTCCCCCCTC | AGGACAA | CACCAC | AVRHELARVGQHSL |
| | | | | CCCGGACCTGTCGCTGCTGGACGAGGAGATGAAGGAGAGCGAGCCGC | GGCTGGC | CACCAC | HHIDRQGNAFADRL |
| | | | | CTGACCCGACGCACCACTCAGCGGACGAGGATTCCACGGACGCAGAGA | GCCGAACA | GGCGGA | ANRALDLKSDKVECK |
| | | | | CGGCGGACGCAGTGATGGAGCCCGCGTTCGTCAGCGACCCACCCACGG | CCCCGCGC | GGTGCA | EHPVAGACTTCMGS |
| | | | | CGACACCCCGGGAGTGGCGCCTCCAATTCGATGGAGCTTGCCGTGGCG | TCAGGCTG | TTTCGAC | PSAGPPATPPPTTADI |
| | | | | GGCCCAACCCCGGTGGTGCTGGCGCACTGCTCTACAACCCCGAGGGTG | CCCACGGC | AGTCGA | EMADAGSDDELRAD |
| | | | | CTGTCGTGTGGACGGGTTCGCACTACATGCCGGGCGCCAAGGAGACGA | CAGCGCTC | ACTTCAA | IDDGEVYAPMRLEPG |
| | | | | ACAACTCGGCCGAGTACACGGCCCTCCTGATCGGCGCCCGCGCAGCAG | ATCCGGCC | CCCGCC | VIPTRRSRLRLRQLTD |
| | | | | CAGACCACGGTGCACGACAGCTGCGCATCGAGGGCGACAGCCTGCTGG | TCCGTCCT | ACATATC | DEMEAAGEVVERLS |
| | | | | TCATTCGTCAAGTCAAGGGATTGTACGCCACCAAGAGCACTCGGCTGCG | CTCCGTGT | GGATAT | AGLSAKIADADDWE |
| | | | | ACAGCTCCGGAACGCCGTTCGCCACGAGCTGGCTCGGGTGGGGCAGCA | ACGCGCAC | AGTTAC | TAEGYITALPYMLYD |
| | | | | CTCGCTCCACCACATCGACCGGCAAGGCAACGCGTTCGCGGACCGCCTC | GCTGCAAC | AGCTCT | KLQQYTQVRHGTAR |
| | | | | GCCAACCGGGCGCTCGACCTGAAGAGCGACAAAGTCGAGTGCAAGGAA | TCGCTTCG | AGTTAG | SPAPHPQRRDVQGQ |
| | | | | CACCCCGTGGCCGGCGCGTGCACGACATGCATGGGTTCGCCCTCGGCG | ACTGCACG | ACATCG | VETHREPRHETIGQP |
| | | | | GGCCCGCCAGCGACACCGCCCCCTACCACTGCCGACATCGAGATGGCG | CTGTGCAC | GATAGG | DQPGEPSPTRRRRG |
| | | | | GACGCGGGGAGCGACGACGAGCTCCGAGCAGACATCGACGACGGTGA | GTACACGG | AACTTCT | KRKGRRQRRHPRRT |
| | | | | AGTGTATGCTCCGATGCGCTTAGAGCCCGGCGTGATCCCGACCCGCCGC | CTGCCAGC | TAGAAA | NCGGGGRQQRKQR |
| | | | | TCGCGCCTCCGCCTTCGCCAGCTGACCGACGATGAGATGGAGGCAGCT | CTCGCTTC | ATTAAC | HPRPPRGTRHHREH |
| | | | | GGTGAGGTAGTCGAGCGCTTGAGTGCGGGCCTGTCGGCCAAGATCGCG | GCTCAAGC | GGGTAT | RIDEAIDELHALERAR |
| | | | | GACGCCGACGACTGGGAGACGGCGGAAGGCTACATCACAGCCCTCCCG | GCCACCGC | ACCGGA | PQARPAIAKARRVG |
| | | | | TACATGCTCTACGACAAGCTGCAGCAGTACACTCAGGTGCGGCATGGCA | TCGTCTCG | TGGTAA | RIRSAIDQQLLRHRFD |
| | | | | CGGCTCGTTCACCAGCGCCCCACCCACAGCGCCGAGACGTCCAAGGCCA | GCACCGAC | ATAAAA | TAEKECVDGILAAAR |
| | | | | GGTGGAAACCCACCGGGAGCCGCGGCACGAGACCATTGGTCAGCCAGA | GCACGGCC | TAAAAA | TARDARTTVRAAAAT |
| | | | | CCAGCCAGGTGAGCCGTCACCGACGCGCCGCCGCCGCCGAGGAAAGCG | TTCCTCGA | CTTC | GTTATPETAVTSGTE |
| | | | | TAAAGGCCGCCGCCAGCGACGTCATCCCCGACGGACCAATTGTGGTGG | CAAGTTCT | (SEQ ID | QQDDNGTCPIPSEVL |
| | | | | TGGTGGCCGTCAGCAGCGGAAGCAACGGCATCCACGCCCACCGCGCGG | TGGCGGG | NO: | WRHFDSVNTPQRDF |
| | | | | GACACGCCACCACAGGGAGCACCGCATCGACGAAGCCATCGACGAACT | CTGCGCGT | 1325) | DPEAPEGAAFRSAM |
| | | | | GCACGCGCTGGAGCGTGCCCGTCCCCAAGCTCGCCCAGCCATTGCCAAA | GCGGCAC | | ARLPAATRFMELLKE |
| | | | | GCTCGCCGCCGAGTTGGCCGGATCCGATCGGCGATCGATCAGCAGCTTC | GCCCTTCG | | EPSTDGIEVQLQHAS |
| | | | | TGCGCCACCGCTTCGACACCGCCGAGAAGGAGTGCGTGGATGGCATCT | CATCGAGG | | STSSPGLDGVGYDVY |
| | | | | TGGCAGCAGCTCGCACGGCACGCGACGCACGGACAACAGTGAGGGCG | TTGGCCGC | | KRFASQLLPVLKAAFK |
| | | | | GCCGCGGCAACAGGGACGACAGCGACTCCAGAGACGGCAGTGACGAG | AGCCAGAC | | CCWTHKQVPQSWK |
| | | | | CGGTACGGAGCAGCAGGACGATAACGGCACCTGCCCCATCCCGAGCGA | ACGCGCAA | | LGVVRLLYKKGDRED |
| | | | | GGTGCTGTGGAGACACTTCGACAGCGTCAATACGCCCCAGAGGGACTT | GCGTGCGC | | PANWRPICLQQAIYK |
| | | | | CGACCCGGAGGCTCCCGAGGGTGCTGCGTTCCGTTCTGCGATGGCCCG | CAACCTCT | | IYTGVLARRLTRWQD |
| | | | | GCTGCCAGCAGCCACGCGATTCATGGAGCTGCTGAAGGAAGAGCCGTC | GCACCACC | | ANDRHAPGQKGFRP |
| | | | | CACGGACGGCATCGAGGTCCAGCTGCAGCACGCGAGCAGCACCTCCAG | TCGGCGAC | | VNGCGEHNFLAAML |
| | | | | CCCGGGCCTCGACGGCGTCGGCTACGACGTGTACAAGCGCTTCGCGTC | GACTTCGA | | IDHARRKHRPLYEVW |
| | | | | GCAGCTGCTGCCGGTGCTGAAGGCGGCTTTCAAGTGCTGCTGGACGCA | CGGCAGCA | | YDFRNAFGSVPLGLL |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAAGCAGGTGCCCCAGAGCTGGAAGCTCGGCGTGGTGCGCCTCCTGTA | AAGGCATC | | WDALERTGVPAEYIA |
| | | | | CAAGAAGGGCGACCGTGAAGACCCGGCGAACTGGAGGCCCATCTGCCT | AAGCCCCA | | AVQGLYDHAAFMVG |
| | | | | CCAGCAAGCCATCTACAAGATCTACACGGGGGTGCTCGCGCGGCGCCTC | CTGCTGCC | | NAVDGSTAPILQRVG |
| | | | | ACCCGCTGGCAGGACGCCAACGACCGCCACGCCCCGGGCCAGAAGGGC | GGAGGCA | | VFQGCPLSPPLFSAAI |
| | | | | TTCCGGCCGGTGAATGGCTGCGGGGAACACAACTTCCTCGCGGCCATGC | GACCCACC | | SPLLHALQLLPSSGVQ |
| | | | | TCATCGACCACGCGCGCCGCAAGCACCGGCCACTGTACGAGGTGTGGT | GTCCGTGC | | LSGDDRPGVSAYAD |
| | | | | ACGACTTCCGGAACGCTTTCGGAAGCGTACCCCTCGGGCTGCTGTGGGA | AGTGGTCA | | DLKTFSGTKAGVTEQ |
| | | | | CGCCCTGGAGCGGACAGGCGTTCCCGCCGAGTACATCGCTGCCGTCCA | CCGCCGCG | | HELVAMFLRWTGM |
| | | | | GGGCTTGTACGACCACGCAGCGTTCATGGTGGGCAACGCGGTGGACGG | CCCGACCT | | AANPAKCRSMGVRR |
| | | | | CAGCACGGCGCCGATCCTGCAGCGTGTCGGAGTGTTCCAGGGGTGCCC | GCCCCGCC | | NGNGAIEADHLELAL |
| | | | | GCTGAGCCCACCGCTGTTCTCGGCGGCGATCAGCCCCCTCCTCCACGCG | AGTATCCC | | DDTPIPTLTHLQSYTY |
| | | | | TTGCAGCTACTGCCCAGCTCAGGAGTACAGCTCTCGGGTGACGACCGCC | TCGGAGCT | | LGIGDGFDHVRRRVA |
| | | | | CGGGTGTCTCCGCGTACGCCGACGACCTCAAGACCTTCAGCGGCACCAA | CGTTGCGT | | LAPKLKLLKQDATAL |
| | | | | GGCGGGCGTCACCGAGCAGCACGAGCTAGTGGCCATGTTCCTGCGATG | CCCCCCCG | | MESGLAPWQVVKA |
| | | | | GACCGGCATGGCGGCGAACCCGGCCAAGTGCAGGTCGATGGGCGTGC | CAGCCGAG | | VKGYLYPRVEYALRH |
| | | | | GCCGCAACGGCAACGGCGCCATCGAGGCGGACCACCTGGAGCTGGCGC | CTCCACCA | | LRPDDQLLESFDLHLR |
| | | | | TGGACGACACGCCGATCCCTACGTTGACGCACCTGCAGTCGTACACGTA | ACGTTGCA | | RGLRHLLRLPKSANN |
| | | | | CCTGGGGATCGGCGACGGCTTCGACCACGTGCGCCGCCGCGTCGCGCT | (SEQ ID | | DFVYAPVSRGGLGFL |
| | | | | CGCGCCCAAGCTCAAGTTGCTCAAGCAGGACGCGACGGCGCTGATGGA | NO: 1202) | | PLVELHAALQIAHGW |
| | | | | GTCCGGCCTCGCGCCGTGGCAGGTGGTGAAGGCCGTGAAGGGGTACCT | | | QMINSPDPAIRRIAR |
| | | | | CTACCCTCGGGTGGAGTACGCCCTCCGGCACCTGCGACCCGACGACCAG | | | EQLHQVADARHRLD |
| | | | | CTCCTGGAGAGCTTCGACCTCCACCTCCGCCGCGGCCTCCGCCACCTGCT | | | KDHWKQRGDELCEL |
| | | | | CCGCCTCCCCAAGAGCGCCAACAACGACTTCGTGTACGCGCCGGTGTCG | | | LLNGELGTSAHAPPK |
| | | | | CGCGGGGGCCTGGGCTTCCTGCCGCTGGTGGAGCTGCACGCGGCGCTG | | | RRNGDIGSLWVDVR |
| | | | | CAGATTGCGCACGGGTGGCAGATGATCAACTCGCCCGACCCAGCCATCC | | | KNLKAFGLKLATAPA |
| | | | | GGCGCATCGCGCGCGAGCAGCTTCACCAGGTTGCCGACGCGCGGCACC | | | DPESGAPAKPLQLCV |
| | | | | GGCTCGACAAGGACCACTGGAAGCAGCGCGGTGACGAGCTGTGCGAG | | | PHHAEWLDHRNVLR |
| | | | | CTCCTCCTCAACGGGGAGCTCGGGACGTCGGCCCACGCGCCACCCAAAC | | | HVKQHMKNKRWRA |
| | | | | GGCGCAACGGCGACATTGGCTCGCTGTGGGTCGACGTCCGCAAGAATC | | | WCSHVDQGRTARA |
| | | | | TCAAGGCCTTCGGGCTGAAGCTCGCAACCGCGCCCGCCGACCCGGAGT | | | HGGVGSGFLTRPRG |
| | | | | CCGGCGCACCTGCCAAGCCGCTGCAGCTTTGCGTGCCGCACCACGCTGA | | | MWESDYRFAVAARL |
| | | | | GTGGCTGGACCACCGCAACGTGCTGCGGCACGTGAAGCAGCACATGAA | | | NMLDTVNVLARRRL |
| | | | | GAACAAGCGCTGGCGGGCCTGGTGCAGCCACGTGGACCAGGGGCGGA | | | RAHDRCRHPGCRWK |
| | | | | CGGCGCGCGCGCACGGAGGCGTCGGCAGCGGTTTCCTGACGAGACCGC | | | ETLAHVLNHCPGTM |
| | | | | GGGGCATGTGGGAGAGCGACTACCGCTTCGCGGTGGCCGCTCGCCTCA | | | DSIRGRHDDALKEIER |
| | | | | ACATGCTTGACACGGTGAACGTGCTCGCGCGCAGACGCCTCCGCGCCCA | | | TLHASSGDRQGRTEL |
| | | | | CGACCGTTGCCGTCACCCGGGCTGTCGGTGGAAGGAGACGTTGGCACA | | | RTNQTVPGLAGPALR |
| | | | | CGTCCTCAACCACTGCCCGGGTACGATGGACAGCATCCGCGGCCGCCAC | | | PDLQVYNHDQRTVA |
| | | | | GACGACGCGCTCAAGGAAATCGAGCGCACGCTCCACGCGTCGTCGGGC | | | VVDLAIAFDEQPRDD |
| | | | | GACCGCCAGGGCCGCACCGAGCTCCGCACGAACCAGACCGTGCCGGGC | | | PESSGLAKAAAEKKA |
| | | | | CTGGCCGGGCCAGCTCTGCGCCCCGACCTCCAGGTCTACAACCACGACC | | | KYAGIKRHLERQGW |
| | | | | AACGCACGGTCGCGGTGGTGGACCTGGCCATCGCGTTCGACGAGCAGC | | | KVHLSALVYGSLGSV |
| | | | | CGCGCGACGACCCAGAGAGCTCCGGGCTGGCGAAGGCGGCGGCCGAG | | | APSNYKVYTEHLGLLK |
| | | | | AAGAAGGCCAAGTATGCGGGCATCAAGCGACACCTCGAGCGCCAAGGG | | | RDAKRLDRQLSVACI |
| | | | | TGGAAGGTCCACCTCTCGGCGCTCGTGTACGGCTCGCTGGGCTCGGTGG | | | QSSRRIWNLHCAQH |
| | | | | CACCCAGCAACTACAAGGTGTACACCGAGCACCTGGGGCTGCTCAAGC | | | RARQHQDQPAPRGR |
| | | | | GGGACGCCAAGCGGCTGGACCGGCAGCTGTCGGTGGCGTGCATCCAGT | | | RVTETGGTPSRTDRR |
| | | | | CCAGCCGCCGCATCTGGAACCTGCACTGCGCCCAGCACCGCGCCAGGCA | | | (SEQ ID NO: 1447) |
| | | | | GCACCAAGACCAACCAGCCCCAAGGGGCAGGCGGGTGACGGAGACCG | | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGGGGACTCCGTCGCGCACCGATCGCCGCTAGACGGCAACACTCTGGC | | | |
| | | | | CCGCGTCGGCCGAAAGGGCCCCACCCACGTAGGGAACCGCCCTCGGGA | | | |
| | | | | AACCCAGTCTGGTGTTCGGCCAAGAAATGCACCACCACCACGGCGGAG | | | |
| | | | | GTGCATTTCGACAGTCGAACTTCAACCCGCCACATATCGGATATAGTTAC | | | |
| | | | | AGCTCTAGTTAGACATCGGATAGGAACTTCTTAGAAAATTAACGGGTAT | | | |
| | | | | ACCGGATGGTAAATAAAATAAAAACTTC (SEQ ID NO: 1079) | | | |
| NeSL | Utopia-4_PI | AATU01001281.1 | *Phytophthora infestans* | AGCTCGGCCTCGCGGCTGCCTTCCCAGGCGCCGCCGACTTCGCGCTCTG | AGCTCGGC | TAAACG | MLADPAALAAGLAR |
| | | | | GCGCGGCCCACACGCCGCCGCCGAGCCTCCAAGCGCGCCCGTTGGCTTT | CTCGCGGC | GGTCAC | APPPPSAPQDPSPAF |
| | | | | CGCAGACGCAGGGCTCGCGGCGACGGCCCTCGCCAGCCCCCAAGACCC | TGCCTTCC | TTGACC | PAGPAGQNPRAAAP |
| | | | | CCCCTACGATGTGGCACCACCCGGCAGGGCGGCCGGCAGGCTGCCCGA | CAGGCGCC | GACAGG | ARVEVHTVVAPPGR |
| | | | | CTCGGTATCGCCGGGTGCTACACTCTCAGCCGCTACAGCTCGGGCCTTG | GCCGACTT | GCACCA | AGGMLPDPGLVEEPI |
| | | | | GCGGTCCGCTATTGGCCCTTGGAGCTCGACGGCGACAGCAGCGACGAC | CGCGCTCT | CCCAGG | QATYAHDAAQFECA |
| | | | | GAGGACGCTCAAGACCCCCACGCCGCCGCCCCAGAACCCCCAGAAGAC | GGCGCGG | TAGGGA | LCPYVAESMAVLVQ |
| | | | | GTCGCGAGTGTGCTTGCCCCACCCGGCAGGGCAGGCAGCATGCTCGCC | CCCACACG | ACCGCC | HRRSAHRGTRFKDIF |
| | | | | GACCCAGCAGCGCTGGCAGCCGGTCTGGCTCGCGCTCCGCCGCCCCCAT | CCGCCGCC | CTTTAAA | TSGCQCSLVFYARIVA |
| | | | | CGGCACCCCAGGACCCAAGCCCCGCCTTCCCTGCTGGTCCCGCCGGCCA | GAGCCTCC | ACCCAG | ASHAVACARRNQRA |
| | | | | GAACCCTCGCGCCGCCGCCCCAGCCCGTGTTGAAGTCCACACAGTCGTG | AAGCGCGC | GAAGAC | VPPAPTPVAPTRPEA |
| | | | | GCACCACCCGGCAGGGCGGGCGGCATGCTGCCCGACCCGGGGTTGGTT | CCGTTGGC | ACAAAC | TPQPTGYLAAAMTA |
| | | | | GAAGAACCTATCCAAGCGACGTACGCGCACGACGCTGCCCAGTTCGAG | TTTCGCAG | ACCCTCC | AAAAASSDTVVAAAT |
| | | | | TGTGCGTTGTGCCCGTACGTCGCTGAGAGCATGGCAGTGCTCGTTCAGC | ACGCAGG | ACATAG | NMQSAVPAAAKTTG |
| | | | | ACCGACGGTCGGCTCACCGCGGCACCCGCTTCAAGGACATCTTCACCAG | GCTCGCGG | TGACAT | LQLVPPELEPALPQR |
| | | | | CGGGTGCCAGTGCAGCCTAGTGTTTTACGCGCGCATTGTTGCCGCCAGC | CGACGGCC | ACATATT | ASCHAGKRRRLNAD |
| | | | | CATGCAGTGGCCTGTGCCAGGCGCAACCAGCGAGCCGTGCCACCAGCT | CTCGCCAG | TTAGCCT | EAVTPCTPTARVSPQ |
| | | | | CCGACCCCTGTTGCCCCCACGCGGCCCGAGGCTACCCCACAACCTACTG | CCCCCAAG | AGATTTC | TEVAMAPHDAPQD |
| | | | | GGTACCTCGCCGCGGCGATGACTGCCGCTGCGGCAGCCGCATCAAGCG | ACCCCCCC | AGTTAC | DTVLQREAAEPQPDP |
| | | | | ACACCGTAGTGGCAGCCGCCACCAACATGCAGAGCGCCGTGCCAGCCG | TACGATGT | GGAGAG | AATQGAQVQRVEDT |
| | | | | CCGCCAAGACTACTGGGCTTCAGCTCGTCCCCCCCGAGCTGGAGCCTGC | GGCACCAC | GTTACTA | TAAQDDTVQQDHD |
| | | | | CCTTCCGCAGCGTGCTTCTTGCCATGCAGGCAAACGCCGTCGGCTCAAT | CCGGCAG | ACTGGT | ADTAQVSPPRRTPTR |
| | | | | GCCGACGAGGCAGTGACACCGTGTACGCCTACGGCGCGGGTGTCGCCG | GGCGGCC | ACATAA | WGPRPSSTQEPSPM |
| | | | | CAAACAGAAGTGGCGATGGCGCCTCACGACGCACCCCAGGACGACACC | GGCAGGCT | AATTAC | TGEPAATLAARRPLT |
| | | | | GTCCTACAGCGTGAGGCCGCCGAGCCACAGCCAGACCCAGCAGCAACG | GCCCGACT | ACATTCT | PAATGTRATRWGPC |
| | | | | CAGGGTGCCCAAGTGCAGCGAGTCGAAGACACAACTGCGGCGCAGGAT | CGGTATCG | GTTCTAA | HRAIGAAAIARLVTGL |
| | | | | GACACTGTGCAGCAGGACCACGACGCCGACACTGCCCAGGTCTCGCCG | CCGGGTGC | TCAGTG | PTEPAQPQRRQPPPP |
| | | | | CCCCGGCGCACACCGACACGCTGGGGACCAAGACCAAGCTCAACTCAA | TACACTCT | TGAAAA | QEPPLQPEPQAAAAT |
| | | | | GAGCCTAGCCCCATGACAGGCGAGCCGGCTGCCACCCTGGCAGCGCGA | CAGCCGCT | CTGGTTT | VAADIAATVAADIAA |
| | | | | AGACCACTGACTCCTGCCGCAACGGGCACTCGTGCCACGCGGTGGGGG | ACAGCTCG | TCGCCTT | AAANAAMDVDGGP |
| | | | | CCATGTCACCGCGCGATCGGGGCCGCAGCCATCGCACGACTTGTCACGG | GGCCTTGG | TTGGCG | AADETWLLRFDGAC |
| | | | | GCCTTCCAACGGAGCCAGCGCAGCCTCAGCGACGGCAGCCACCGCCAC | CGGTCCGC | GACTTTT | RRNPGPGGAGAALF |
| | | | | CACAAGAACCTCCTTTGCAGCCAGAGCCACAAGCAGCAGCAGCAACAGT | TATTGGCC | TCACTCG | APSGAVVWTCSHFM |
| | | | | CGCAGCAGACATCGCAGCAACAGTAGCAGCAGACATTGCGGCAGCAGC | CTTGGAGC | CATTTTT | PSRSETNNTAEYTALL |
| | | | | AGCGAACGCAGCAATGGACGTGGATGGTGGACCGGCAGCCGACGAGA | TCGACGGC | GGGCAA | LGAQSAVHHGAKRL |
| | | | | CATGGCTGTTGCGCTTTGACGGCGCATGCCGACGGAACCCAGGACCTG | GACAGCA | TCGTCT | NIEGDSHLILSQVRGA |
| | | | | GTGGAGCAGGTGCCGCACTCTTTGCGCCCAGCGGTGCCGTAGTATGGA | GCGACGAC | GCGGCT | FACNNKRLRSLRNRV |
| | | | | CGTGCTCGCACTTCATGCCGAGCCGCTCCGAAACGAACAACACCGCCGA | GAGGACG | AGCTTG | QASLRQLDWYRLQHI |
| | | | | GTACACGGCGCTACTGCTCGGCGCACAGAGCGCAGTCCACCACGGCGC | CTCAAGAC | CTAGCG | DRKANQHADRLANR |
| | | | | CAAACGCTTGAATATCGAGGGCGATAGCCACCTGATCCTCTCGCAAGTG | CCCCACGC | GCGGAC | ALDLRRTVTECGPHA |
| | | | | CGCGGTGCCTTCGCGTGCAACAACAAGCGGTTGCGGTCTCTCCGAAACC | CGCCGCCC | GAGCGG | ETRNRCFQTPQPLVE |
| | | | | GAGTCCAGGCCTCTCTTCGGCAGCTCGACTGGTACCGCTTGCAGCACAT | CAGAACCC | TCTCCG | PGETHCVPGSDEVLA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGACCGCAAGGCCAACCAGCATGCCGACCGCCTCGCGAACCGCGCCCT | CCAGAAGA | GGGGCG | ANTAMEDATAVPTE |
| | | | | GGACCTGCGCCGCACGGTGACCGAGTGCGGCCCACACGCGGAGACTCG | CGTCGCGA | TACACCT | DDEAEVAARDGGEV |
| | | | | CAATCGGTGCTTTCAGACACCGCAGCCCCTCGTCGAGCCCGGCGAGACG | GTGTGCTT | TTCCCCC | FPTIAIGPDSAPAKQP |
| | | | | CATTGTGTACCGGGGTCTGATGAGGTCCTCGCTGCTAATACCGCGATGG | GCCCCACC | GCGAGG | RLRLKKLDEDDFDAA |
| | | | | AGGATGCGACCGCTGTGCCTACCGAAGACGACGAGGCTGAGGTTGCAG | CGGCAGG | CCAACT | AAAVTRVSEELASKIV |
| | | | | CGCGAGACGGGGGTGAGGTGTTTCCAACCATCGCCATCGGGCCTGACT | GCAGGCA | ACACCG | DAGDWTSGEGYISAI |
| | | | | CCGCCCCTGCCAAGCAACCACGGCTTCGCCTCAAGAAGCTGGACGAAGA | GC (SEQ ID | ATCTTCT | PERLRAALRPFALPTQ |
| | | | | CGATTTCGATGCGGCTGCCGCCGCCGTGACGCGTGTGTCCGAGGAGCT | NO: 1203) | CTACACT | PARPQPREPRMQQP |
| | | | | GGCAAGCAAGATCGTGGACGCTGGCGACTGGACATCAGGTGAAGGCTA | | TTTCTAA | PRRPPRVTRDHLEHR |
| | | | | CATCAGCGCAATTCCTGAACGACTTCGAGCAGCGCTCCGGCCATTTGCC | | TTCGCCT | LDEALDTMENVQRS |
| | | | | CTTCCGACGCAGCCAGCACGACCACAGCCCCGGGAGCCTCGTATGCAGC | | TCGTCTT | TPQNQKAVRRARRR |
| | | | | AGCCACCCCGCCGGCCACCCCGCGTCACACGCGACCACCTGGAGCACAG | | CGGTCT | VGRLRSAMDRTRLRK |
| | | | | GCTTGACGAGGCGCTCGACACCATGGAGAATGTGCAGCGCTCCACGCC | | TCGGCT | KFATHERECVAEILRR |
| | | | | GCAAAACCAGAAGGCAGTGCGCAGGGCCCGGCGCCGTGTCGGGCGGC | | GTCGGA | ASTEEAANPSQEKCPI |
| | | | | TTCGTTCGGCGATGGACCGGACCAGACTGCGGAAGAAGTTCGCCACAC | | TTTTTTT | DRATLHEYFTATSTQ |
| | | | | ACGAACGGGAGTGCGTGGCCGAGATCCTGCGACGTGCTTCAACGGAGG | | CTTTTTG | RTPFDYDSAKGTEFR |
| | | | | AGGCGGCGAACCCCAGTCAGGAGAAATGTCCTATCGACCGCGCCACCC | | ACCAAT | TFLEVMSTPSHETSAL |
| | | | | TCCACGAGTACTTTACCGCCACCAGCACCCAGCGGACACCATTCGACTAC | | CAGAGT | TAEPTLDEIEDQLAH |
| | | | | GACAGCGCCAAAGGCACAGAGTTCCGCACGTTCCTGGAGGTGATGTCG | | GCGCCA | VKAGSSPGHDGVGY |
| | | | | ACGCCTAGCCACGAGACAAGCGCGTTGACCGCAGAGCCTACGCTGGAC | | TGCGAC | DVYRRFQVQLLPLLH |
| | | | | GAGATCGAAGACCAGCTCGCCCACGTCAAAGCCGGCTCAAGTCCAGGG | | TCTTCTG | AAFRFCWRHRRVPA |
| | | | | CATGATGGGGTCGGGTACGACGTGTACCGCCGCTTCCAGGTTCAGCTGC | | GCCAAT | LWKVGFVRLLHKKG |
| | | | | TGCCCCTCCTGCATGCAGCCTTCCGGTTTTGCTGGCGCCACCGCCGCGTG | | CAGAGA | DPQQPNNWRPICLQ |
| | | | | CCTGCCCTGTGGAAGGTCGGCTTCGTTCGCCTGCTGCACAAGAAAGGTG | | CCGGGC | TAIYKLYSGLLARRLSK |
| | | | | ACCCGCAGCAGCCAAACAACTGGCGACCAATCTGCCTACAGACCGCCAT | | CCTGTCC | FLEANELLPMAQKGF |
| | | | | CTACAAGCTCTACAGCGGCCTCCTCGCCCGTCGACTGTCCAAGTTCCTGG | | TCGGAC | RAFNGCHEHNFVAT |
| | | | | AAGCCAACGAGCTGTTGCCCATGGCACAGAAGGGCTTCCGAGCGTTCA | | AGCGAG | TLLDQTRRMHRRLY |
| | | | | ACGGTTGCCACGAGCACAACTTCGTGGCAACCACGCTCCTGGACCAGAC | | GCCTCC | QVWYDLRNAFGSLP |
| | | | | GCGCCGCATGCATCGCAGGCTGTACCAGGTCTGGTACGACCTGCGCAAT | | ACGGCC | QQLMWGVLRQLGV |
| | | | | GCTTTCGGGTCGCTGCCGCAGCAGCTCATGTGGGGCGTCTTACGCCAGC | | AGCCAA | TEEFVARCSGIYEDSY |
| | | | | TTGGGGTGACAGAGGAGTTTGTGGCTCGCTGCAGTGGCATCTACGAGG | | TCAAGT | FVVGNASDGATEPV |
| | | | | ACTCATACTTCGTGGTCGGCAACGCGAGCGACGGAGCGACGGAGCCAG | | CTCGGC | RQEVGVYQGCPLSPL |
| | | | | TGCGCCAGGAGGTGGGAGTATACCAGGGCTGCCCGCTCAGCCCCCTCCT | | AGCGAC | LFITALVPLLRALENQ |
| | | | | CTTTATCACTGCGCTCGTGCCACTCCTCCGGGCGCTAGAGAACCAGGAT | | GCGTCT | DGVGVPLADGVRPC |
| | | | | GGCGTTGGCGTCCCGCTCGCAGACGGAGTACGCCCGTGCGCCACCGCG | | TTCTATA | ATAYADDIKVFCDSA |
| | | | | TACGCGGACGACATCAAGGTCTTCTGTGACAGCGCGACGGGCATCCAG | | GCGCAG | TGIQRCHALVTRFLE |
| | | | | CGCTGCCACGCCCTCGTGACGCGCTTCCTGGAGTGGACTGGGCTGCAG | | CTGACG | WTGLQANPAKCAFL |
| | | | | GCCAACCCGGCCAAGTGCGCGTTCCTGCCGGTGACACGCAGCCAGCAC | | AGGCCG | PVTRSQHSNPTRDRD |
| | | | | AGCAACCCCACACGCGACCGAGACATCGAGCTTCGCATCCACGGCGAG | | ATCTGG | IELRIHGEAIATLGLQE |
| | | | | GCCATCGCCACCCTCGGACTTCAAGAAAGCTACCGGTACCTGGGGGTTG | | CGGCCC | SYRYLGVGDGFDHVR |
| | | | | GCGACGGCTTCGATCACGTGCGACACCGCCTCCAGCTCGAACCCAAGCT | | CCGATT | HRLQLEPKLKQIKREA |
| | | | | GAAGCAGATCAAGCGAGAGGCGGTGGCACTGCTGCACTCGGAGCTGGT | | GGTCCG | VALLHSELVPWQILK |
| | | | | GCCGTGGCAGATTCTCAAGGCTCTGAAGGTGTACATCTACCCGAAGGTA | | ACTTTCG | ALKVYIYPKVEYALRH |
| | | | | GAGTACGCCCTCAGACACCTGCGGCCGCTCAAGTCACAGCTTCAGGGCT | | GCCAAT | LRPLKSQLQGFDSAIV |
| | | | | TCGACAGCGCCATCGTGCGCGGCCTGCGCCACCTGCTCCGCCTGCCGGA | | CAGCGA | RGLRHLLRLPENSHD |
| | | | | GAACAGCCACGACGGCCTCTTCTTCTCACCCACCTCGGCTGGGGGACTG | | CGACGA | GLFFSPTSAGGLGLLS |
| | | | | GGACTGCTGTCGCTCGTCGAGCTGCACGAAGCGCTGCAGGTGGCACAC | | GGGGGC | LVELHEALQVAHAW |
| | | | | GCGTGGCAAATGCTCCACTCCAAGGACCCGGCCATCCGTGCCATCGCGC | | AGGAGT | QMLHSKDPAIRAIAR |
| | | | | GCACGCAGGTGGGACAAGTGGCGCGCAAGCGGTTCAAGCTGGTCGAG | | TTACACT | TQVGQVARKRFKLVE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAGCACTGGCGCGGACGGGAAGACGACCTCGCACAGCGCTTCCTCAAC | | TTTGCCC | EHWRGREDDLAQRF |
| | | | | ACGGAGCTCGCCGCCTCGCCCCACGCCACGGAGACACGCCGCAACGGC | | CCGTTTC | LNTELAASPHATETR |
| | | | | GACATCGGTTCCCTATGGAACGACGTCCGCGACACGCTGCAGACCCTCG | | GACATC | RNGDIGSLWNDVRD |
| | | | | GACTCAAGTTCGCCGCAGGCGACGAGGAGGAAGCACCTGGACTACTGC | | AACTTCA | TLQTLGLKFAAGDEE |
| | | | | AGCTCCGCGTGCCGCACCACACCAAGTGGCTCAGCCACTCGACGGTGTT | | GGCCAA | EAPGLLQLRVPHHTK |
| | | | | GAGGCACGTGAAGCTGCACATGAAACTGCGCCGCATGGACACGTGGAA | | AATGGC | WLSHSTVLRHVKLH |
| | | | | GTCCAAGGTCAGTCAGGGCACGACGGTGCGAGAGCACGGCGGCGTGG | | GATTTC | MKLRRMDTWKSKVS |
| | | | | GCTCACGCTTCATCACGGCGGGTGCAGGCCTGTCCGACGCCGAGTATCG | | GACCCT | QGTTVREHGGVGSR |
| | | | | CTTCGCTATTGCGCCCCGCGCCCACCTGATTGATACCAACAGCACCCTCA | | CCACGC | FITAGAGLSDAEYRFA |
| | | | | AGCGCCGTCGACTCCGGGCCAACGACACCTGCCGGGCTCCGGGATGCT | | GCCGTG | IAPRAHLIDTNSTLKR |
| | | | | CCTACACGGAACCCCCCGCCCACATCCTGAACAAATGCAGTCCCAACAT | | CCACTG | RRLRANDTCRAPGCS |
| | | | | GGACGCGATCAGGAAACGCCACGACGATGCTCTCGAGCGTATCGCTGA | | CTCGGC | YTEPPAHILNKCSPN |
| | | | | CGCCCTGCGGCGCAAGGTGGAGAAGTCCGGCGGCAGGCTCGAGGTGG | | ACCGGC | MDAIRKRHDDALERI |
| | | | | CCATCAACAAGACGGTACCGGAGTACGACGGCGCGGCCCTGCGCCCCG | | GGCGAT | ADALRRKVEKSGGRL |
| | | | | ACATCGTACTCCGGAACACGGAGACCAAGCGTGCCATCATCGCCGACCT | | TCAGCG | EVAINKTVPEYDGAA |
| | | | | GGCGATCACCCACGAGAACCAGCCGACCGACGCGACCACGTCTTCAGC | | GGTGCA | LRPDIVLRNTETKRAII |
| | | | | GCTACAGCAAAGCCGTGACAACAAGATTACCAAGTACCAGACGGTCGC | | ACTTCG | ADLAITHENQPTDAT |
| | | | | GGCGGCAATGATGCGCGCCGGTTGGCGGGTTCGCGTGACGGGCATCGT | | GGCACG | TSSALQQSRDNKITKY |
| | | | | CTACGGCTCGCTCGGCTCAGTCCTGCCGAGCAACTTCAAGGTCTACACC | | TGTGCA | QTVAAAMMRAGW |
| | | | | GAGCTGCTGGCGCTGCTCAAGCGGGACGCCCGCCGCCTTAACCGCCAG | | ACACAT | RVRVTGIVYGSLGSVL |
| | | | | CTCTCCAGCCACTGCATCCGGGCCAGCGCGCGGATATGGAGCGCGCACT | | GCAGCG | PSNFKVYTELLALLKR |
| | | | | GCCGACGACACCGTGAGCGGCAACGAAGCGGCAATGCCTCGCGAGCGT | | CCCATTG | DARRLNRQLSSHCIR |
| | | | | CGCGTGGGTCCGGGGGGGCCCCGCGGCGCACATCGCAGGCATCGGCA | | CACGCC | ASARIWSAHCRRHRE |
| | | | | CGGCGGTAAACGGGTCACTTGACCGACAGGGCACCACCCAGGTAGGGA | | AAGCGG | RQRSGNASRASRGS |
| | | | | ACCGCCCTTTAAAACCCAGGAAGACACAAACACCCTCCACATAGTGACA | | CATCGC | GGAPRRTSQASARR |
| | | | | TACATATTTTAGCCTAGATTTCAGTTACGGAGAGGTTACTAACTGGTACA | | GGGACG | (SEQ ID NO: 1448) |
| | | | | TAAAATTACACATTCTGTTCTAATCAGTGTGAAAACTGGTTTTCGCCTTTT | | ACGCCT | |
| | | | | GGCGGACTTTTTCACTCGCATTTTTGGGCAATCGTCTGCGGCTAGCTTGC | | CGGCCG | |
| | | | | TAGCGGCGGACGAGCGGTCTCCGGGGGCGTACACCTTTCCCCCGCGAG | | CTCAAG | |
| | | | | GCCAACTACACCGATCTTCTCTACACTTTTCTAATTCGCCTTCGTCTTCGG | | CGCAGC | |
| | | | | TCTTCGGCTGTCGGATTTTTTTCTTTTTGACCAATCAGAGTGCGCCATGC | | CCCGCC | |
| | | | | GACTCTTCTGGCCAATCAGAGACCGGGCCCTGTCCTCGGACAGCGAGGC | | CTTCCAG | |
| | | | | CTCCACGGCCAGCCAATCAAGTCTCGGCAGCGACGCGTCTTTCTATAGC | | CACGAC | |
| | | | | GCAGCTGACGAGGCCGATCTGGCGGCCCCCGATTGGTCCGACTTTCGGC | | CTCGCG | |
| | | | | CAATCAGCGACGACGAGGGGGCAGGAGTTTACACTTTTGCCCCCGTTTC | | CCGTTT | |
| | | | | GACATCAACTTCAGGCCAAAATGGCGATTTCGACCCTCCACGCGCCGTG | | GGCGGA | |
| | | | | CCACTGCTCGGCACCGGCGGCGATTCAGCGGGTGCAACTTCGGGCACG | | TCGCCAT | |
| | | | | TGTGCAACACATGCAGCGCCCATTGCACGCCAAGCGGCATCGCGGGAC | | CAAGAC | |
| | | | | GACGCCTCGGCCGCTCAAGCGCAGCCCCGCCCTTCCAGCACGACCTCGC | | GTGCGA | |
| | | | | GCCGTTTGGCGGATCGCCATCAAGACGTGCGAGAGCCAGGCGGGGTCG | | GAGCCA | |
| | | | | GGCAAAATATACTTACTCTAAGTATGCCCGAATCCCTGCCCTCTCAGGCT | | GGCGGG | |
| | | | | GTACGCGGCCCCATACTTGATCTAAGTATGGGAGGATCCCTGGCCTCTC | | GTCGGG | |
| | | | | AGGCTGTACGCGAGACCCGTACGGCCGAATCCCTGGCTTCTCAGCCTGT | | CAAAAT | |
| | | | | ACGCGGGGCTATACTTGGTCTAAGTATGCCCCGGTCGCTGGCCTCTGAG | | ATACTTA | |
| | | | | CCCGTACACA (SEQ ID NO: 1080) | | CTCTAA | |
| | | | | | | GTATGC | |
| | | | | | | CCGAAT | |
| | | | | | | CCCTGCC | |
| | | | | | | CTCTCAG | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GCTGTA | |
| | | | | | | CGCGGC | |
| | | | | | | CCCATAC | |
| | | | | | | TTGATCT | |
| | | | | | | AAGTAT | |
| | | | | | | GGGAGG | |
| | | | | | | ATCCCTG | |
| | | | | | | GCCTCTC | |
| | | | | | | AGGCTG | |
| | | | | | | TACGCG | |
| | | | | | | AGACCC | |
| | | | | | | GTACGG | |
| | | | | | | CCGAAT | |
| | | | | | | CCCTGG | |
| | | | | | | CTTCTCA | |
| | | | | | | GCCTGT | |
| | | | | | | ACGCGG | |
| | | | | | | GGCTAT | |
| | | | | | | ACTTGG | |
| | | | | | | TCTAAGT | |
| | | | | | | ATGCCC | |
| | | | | | | CGGTCG | |
| | | | | | | CTGGCC | |
| | | | | | | TCTGAG | |
| | | | | | | CCCGTA | |
| | | | | | | CACA | |
| | | | | | | (SEQ ID | |
| | | | | | | NO: | |
| | | | | | | 1326) | |
| NeSL | Utopia- | — | *Phytophthora* | CCAGGAATCACCCCCGCCGCCCCCAAGCGCTCCGCCGCCGAGCCCAGCT | CCAGGAAT | TAGACG | MSGDVVSSDGSSRT |
| | 4_PR | | *ramorum* | GCGGCTGCTGCCGCCCCACTGGTGACGGCAGTCGCAGCTGCCCCTGCCA | CACCCCCG | GCACAC | TDASGDGDDGAGSS |
| | | | | CCTCTCCTGTTGGCCGCGCCGCCGTGGAGCCCCGCGCGCGCGCCGAGCC | CCGCCCCC | AGGCCC | DAAGDVGVVAMDV |
| | | | | GCCCCAAGAACAAGCACCCCCAGCTAGCGCGCGCGTGGAGCCCATGTC | AAGCGCTC | ACAGCG | DQGARRQQPPWQR |
| | | | | GGGCGACGTGGTCAGCAGCGACGGCAGCAGCAGGACGACGGACGCGA | CGCCGCCG | GCCGAC | VGGKRRRLNDVDDE |
| | | | | GCGGCGACGGCGACGACGGCGCAGGCAGCAGCGATGCAGCAGGCGAT | AGCCCAGC | AGGGCC | DTRELAELLLEEEDEA |
| | | | | GTCGGCGTCGTCGCCATGGATGTTGACCAAGGTGCCCGCCGACAGCAG | TGCGGCTG | ACACCC | GDHAPAPRLSAASAR |
| | | | | CCGCCATGGCAGCGCGTCGGCGGCAAGCGTCGACGTCTCAACGACGTC | CTGCCGCC | AGGTAG | PASVLSVYAHNAQRF |
| | | | | GACGACGAAGACACCCGCGAGCTGGCCGAGCTCCTGCTCGAGGAGGA | CCACTGGT | GGAACC | QCTLCTYTAASFASLK |
| | | | | GGACGAGGCTGGGGACCACGCTCCAGCGCCTAGGCTATCCGCGGCCAG | GACGGCA | GCCTTCA | RHRDSRHRRTAFLDR |
| | | | | CGCTCGCCCGGCCTCCGTCCTCTCCGTGTACGCGCACAATGCGCAGCGC | GTCGCAGC | AACCCG | FSAGCACGVPFASRL |
| | | | | TTCCAGTGCACGCTGTGCACGTACACGGCCGCCAGCTTCGCGTCGCTCA | TGCCCCTG | GCCGGT | AAANHAHACDSLNR |
| | | | | AGCGACACCGGGACTCCCGGCACCGCCGCACCGCCTTCCTCGACCGGTT | CCACCTCT | ACATTAT | TFSVAAAPAAGELSP |
| | | | | CTCGGCGGGATGTGCGTGCGGCGTGCCCTTCGCGTCGAGGCTGGCTGC | CCTGTTGG | GGTCCG | TAGAANATVKAATV |
| | | | | TGCGAACCACGCACACGCGTGCGACAGCCTCAACCGCACCTTCTCGGTA | CCGCGCCG | ACACCT | TPDSPRQDPPKLAAT |
| | | | | GCGGCTGCGCCGGCAGCAGGGGAATTGAGCCCCACTGCTGGTGCAGCC | CCGTGGAG | ATGAGG | PPLASSALVVDPDHA |
| | | | | AACGCCACTGTCAAGGCGGCCACTGTCACGCCCGACTCCCCCCGCCAAG | CCCCGCGC | TGCAAC | EQQARERWGPPLPR |
| | | | | ACCCCCCGAAGCTCGCAGCGACCCCCCCGCTAGCGAGCTCCGCTCTTGT | GCGCGCCG | CGGTAC | TLVAGRVAARLSEVP |
| | | | | CGTCGACCCGGACCACGCCGAGCAACAAGCCCGCGAGCGCTGGGGCCC | AGCCGCCC | ACAAGT | APRWGPPLPRGVVA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCCCCTACCCAGGACGCTGGTGGCAGGCCGTGTTGCAGCCCGCCTCAGC | CAAGAACA | TACACA | FRIGHRVLPPEMTSD |
| | | | | GAGGTTCCAGCTCCCCGCTGGGGACCCCCACTGCCACGCGGCGTGGTG | AGCACCCC | CCACAT | EETKDDSSVQDGDR |
| | | | | GCATTCCGGATCGGCCACCGCGTGCTCCCGCCGGAGATGACGAGCGAC | CAGCTAGC | AGCGAC | QDYPVAAMDVDSG |
| | | | | GAGGAGACGAAGGACGACTCGAGTGTCCAGGACGGCGACCGCCAGGA | GCGCGCGT | TACCAG | MSGEWLLRFDGACR |
| | | | | CTACCCGGTGGCCGCGATGGACGTGGACAGCGGCATGAGCGGCGAGT | GGAGCCC | GTATTTA | ANPGPGGAGAALSQ |
| | | | | GGCTGCTGCGCTTCGACGGCGCCTGCCGCGCCAACCCTGGCCCAGGTG | (SEQ ID | CTACCTG | PDGSVVWTCSHYMP |
| | | | | GCGCCGGCGCAGCGCTGTCCCAGCCCGACGGCTCCGTTGTATGGACTTG | NO: 1204) | GAAGCC | SSSETNNTAEYTALLL |
| | | | | CTCCCACTACATGCCGAGCAGCAGCGAAACCAACAACACCGCCGAATAC | | AAGGAT | GTRAAADHGTTTLRV |
| | | | | ACGGCGCTGCTGCTCGGTACGCGAGCCGCCGCCGACCACGGAACCACG | | TAACCG | EGDSTLVIQQVRGIF |
| | | | | ACCCTGCGAGTGGAGGGCGACAGCACCTTGGTGATCCAGCAGGTGCGT | | GTCGGT | ATRSVTLRHLRDQVK |
| | | | | GGCATCTTTGCCACGCGGAGCGTCACTCTCCGCCACCTCCGCGACCAAG | | AATACA | LELARVGRFSLHHIDR |
| | | | | TCAAGCTGGAACTCGCCCGGGTGGGGAGATTTTCGCTCCACCACATTGA | | CATAACT | QANAHADRLANRAL |
| | | | | TCGCCAAGCCAATGCCCACGCCGACCGCCTCGCCAACCGAGCCCTCGAC | | TT (SEQ | DLRRTVSECGVHPDG |
| | | | | CTCCGGCGGACAGTGTCGGAGTGCGGCGTCCACCCCGACGGGAACGGC | | ID NO: | NGCTPTAIDDRPLAP |
| | | | | TGCACGCCCACGGCCATCGACGACCGACCCCTAGCGCCGACTCAGCAGC | | 1327) | TQQPPDAPPPPPAA |
| | | | | CACCTGACGCCCCGCCACCGCCGCCCGCCGCCGACATTGAGATGGAGG | | | DIEMEDPDDEDLADI |
| | | | | ACCCGGACGACGAGGACCTCGCCGACATCGACGACGGCGAGGTCTACG | | | DDGEVYAAMRVGP |
| | | | | CGGCCATGCGCGTTGGCCCGAATGCCACTCCGCAGCGACGACGCCGTG | | | NATPQRRRRGRSGT |
| | | | | GACGCTCAGGCACCGCGAAGAAGCACCGCCGCCAGCGCCCACCCCGGG | | | AKKHRRQRPPRVTR |
| | | | | TGACCCGACACCACCGCGAACACCGCCTCGACGAGGCACTCGATGACCT | | | HHREHRLDEALDDLH |
| | | | | CCATGCAGTGGAGCGCTCCACCCCCAGCGACCGCACCACCGTCCGCCGG | | | AVERSTPSDRTTVRR |
| | | | | GCACGACGCCGCGTTGGACGCGTCAATTCGGCCATCGAACAGCAGCGC | | | ARRRVGRVNSAIEQQ |
| | | | | CTCCGCCACCGCTTCGACACGGACGAGAAGGCATGTGTCACCGACATCC | | | RLRHRFDTDEKACVT |
| | | | | TGGCGAAGGCGTGCGCGACGCGAGAGGCAGCGAGGACCACGGCCTCC | | | DILAKACATREAARTT |
| | | | | GGCGGTGATCCACCTGCAGGCCCGGCGACGCCAGCGGCAGGCAGCGC | | | ASGGDPPAGPATPA |
| | | | | AGACGACGGCACCTGCCCCATCTTGGGAGAAGAACTCTGGCGGTTTTTC | | | AGSADDGTCPILGEE |
| | | | | GACAGCGTCAACACGCCGCGCCAAGAATTCGCCCCGGACGCCCCGGTG | | | LWRFFDSVNTPRQEF |
| | | | | GGTGCCGCCTTCCGCTCGGCGTTGGCACGCCTACCGGCCGCGACCAGTT | | | APDAPVGAAFRSALA |
| | | | | GCAAGGAGCTGCTGACTGCGGCGCCGTCGGCCGGCGAAGTGGAAGAC | | | RLPAATSCKELLTAAP |
| | | | | CAGCTACAACACGTCCGTGGCGCCTCCAGCCCTGGACTCGACGGCGTCG | | | SAGEVEDQLQHVRG |
| | | | | GGTACGACGTGTACCAGCACTTCGCGGCGCAGCTCCTGCCGGCACTGAC | | | ASSPGLDGVGYDVY |
| | | | | CGCGGCATTCAAGGCATGCTGGACGGCGAAGAGAGTGCCTCAGAGCTG | | | QHFAAQLLPALTAAF |
| | | | | GAAGCTCGGGGTGGTGCGGCTGCTCCACAAGAAGGGCGCGCGCGAGG | | | KACWTAKRVPQSWK |
| | | | | ACCCGGCAAACTGGAGGCCGATCTGCCTCCAGCAAGCCATTTACAAGCT | | | LGVVRLLHKKGARED |
| | | | | CTACACGGGACTCCTCGCGCGGCGGCTGGTGCGTTGGCTAGACGCCAA | | | PANWRPICLQQAIYK |
| | | | | CGACCGCCACGCTCCAGGCCAGAAGGGCTTCCGAGCGGTGAACGGCTG | | | LYTGLLARRLVRWLD |
| | | | | CGGGGAGCACAACTTCCTCGCAGCCACGCTCGTCGACCAAGCCCGCCGC | | | ANDRHAPGQKGFRA |
| | | | | AAGCGCCGCACCCTCTTCGAAGTCTGGTACGATTTTCGCAACGCGTTCG | | | VNGCGEHNFLAATLV |
| | | | | GCAGCGTGCCATTCGCGCTGCTGTGGGACGCGCTGGCGCGGCTCGGCG | | | DQARRKRRTLFEVW |
| | | | | TGCCCGACGACTACGTTACCATGTGCAAGGGGCTCTACGAGAGCGCGG | | | YDFRNAFGSVPFALL |
| | | | | CGTTTGTCGTCGGGAACGCTATCGACGGCACGACGGACCCAATTGCGCT | | | WDALARLGVPDDYV |
| | | | | GCGGGTGGGCGTCTTCCAAGGGTGCCCACTGAGCCCCCAACTCTTCAAC | | | TMCKGLYESAAFVVG |
| | | | | GCTGCCATTAGCCCGCTGCTCTTCGCGTTGCAGCGGCTGCCGGCCACGG | | | NAIDGTTDPIALRVG |
| | | | | GCGTGCAGCTGTCGGGCGATGACTGCCCTGGTGCCTCGGCTTATGCCGA | | | VFQGCPLSPQLFNAA |
| | | | | CGACCTCAAGATTTTCAGTGGCACCGAGGACGGCATCAAGCGACAGCA | | | ISPLLFALQRLPATGV |
| | | | | CGCGCTCGTGGCCGACTTCTTGCGCTGGACCGGCATGGCGGCGAACCCC | | | QLSGDDCPGASAYA |
| | | | | AACAAGTGCTGCACCATGTCGGTCCAGCGCGACGGACGCGGCGTGCTC | | | DDLKIFSGTEDGIKRQ |
| | | | | AAGACTGACGACCTCCAGCTAGACCTGGCTGGCACGCCGATCCCCGCGC | | | HALVADFLRWTGMA |
| | | | | TGTCCATGAGCGCTTCGTACACCTACCTGGGGATCGGCGATGGATTCGA | | | ANPNKCCTMSVQRD |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCACGTGCGCCGCCGCGTCGAGCTCGCTCCAGCACTCAAGCAGCTTAAG | | | GRGVLKTDDLQLDLA |
| | | | | GACGACGCGACGACGCTGCTGCAGTCGGGCCTCGCCCCGTGGCAGGTG | | | GTPIPALSMSASYTYL |
| | | | | GTGAAGGCGGTGAAGACGTACCTCTACCCCCGGGTGGAGTACGCTCTC | | | GIGDGFDHVRRRVEL |
| | | | | CGCCACCTTCGCCCCTTCCAACAGCAGCTTGAGGGCTTCGACCGGCACC | | | APALKQLKDDATTLL |
| | | | | TCGCGCGCGGCCTCCGCCACCTCCTGCGACTGCCGGGCAACGCCACGGC | | | QSGLAPWQVVKAVK |
| | | | | GGAGTGCTTCTACGCTCCGGTGTCGCGCGGCGGGCTGGGCCTGCTGCC | | | TYLYPRVEYALRHLRP |
| | | | | ACTGACGGAGCTGCACGCGGCGCTCCAAGTCGCGCACGGATGGCAGCT | | | FQQQLEGFDRHLAR |
| | | | | GCTGAATTCGAAGGACCCTGCCATCCGGCGCATCGCGCGCGTGCAGCTC | | | GLRHLLRLPGNATAE |
| | | | | CGGCAGATCGCCGACGCGCGCCACCGTATCGACAGCCGCGCATGGGAG | | | CFYAPVSRGGLGLLPL |
| | | | | GGGCGCGACGAGGAGTTGTGCGAGCTGCTGCTCAACTCGCAGCTCGGG | | | TELHAALQVAHGWQ |
| | | | | ACGTCGCCCGACGCGCCACCGAAGCGTCGGAACGGCGACATCGGTTCT | | | LLNSKDPAIRRIARVQ |
| | | | | CTTTGGGTCGACGTCCAGCGCCACCTCCGCACGCTCGGCCTCAAGTTCG | | | LRQIADARHRIDSRA |
| | | | | CGACCGCGCCGGCCTGCGCGGACGCCGGCTCTGCGGCGACCACGTTGC | | | WEGRDEELCELLLNS |
| | | | | AGCTCCGCGTGCCGCACCACGATAAGTGGTTGGACCATCGCACTGTCCT | | | QLGTSPDAPPKRRN |
| | | | | GCGGCACGTGAAACTGCACGTGAAGCACCGGCACTGGTCCAAGTGGGC | | | GDIGSLWVDVQRHL |
| | | | | GGCCATGCGCGACCAAGGCAAGACGGCCCGCGCCCATGGCGGCGCGG | | | RTLGLKFATAPACAD |
| | | | | GGAGCGGCTTCCTCACCCGGCCACGAGGCATGTGGGAAGCCGACTACC | | | AGSAATTLQLRVPHH |
| | | | | GCTTCGCGGTGGCCGCCCGCCTGAACCAGCTCGACACGCACAGCGTGCT | | | DKWLDHRTVLRHVK |
| | | | | GAAGCGCCGGCGTCTCCGAGCCCACGACCACTGCAGGCAGCCGGGCTG | | | LHVKHRHWSKWAA |
| | | | | CTCCAGGGCGGAGACGCTGGCGCACGTGCTCAACCACTGCGCCGGCAC | | | MRDQGKTARAHGG |
| | | | | CATGGACGCGGTCCGCGGCCGCCACGACGACGCCCTCAAGCACATCGA | | | AGSGFLTRPRGMWE |
| | | | | GCGCGCGCTGCACGCGTCGTCGCCGGGCGGCCAGGACCGCGTCGAGCT | | | ADYRFAVAARLNQL |
| | | | | CCGGGTGAACCAGACGGTGCCGTCGCTCGCCGGCCCCGCGCTACGGCC | | | DTHSVLKRRRLRAHD |
| | | | | CGACCTCCAGCTGTACAACCACACCAAGAAGATGGTGGCGGTGGTCGA | | | HCRQPGCSRAETLAH |
| | | | | CCTGGCCGTGGCGTTCGAGGAGCAGGCGAGCGACGACCCGGAGAGCT | | | VLNHCAGTMDAVRG |
| | | | | CGGCGCTGGCACGCATCGCCGCACACAAGCGCGCGAAGTATGCCGGCG | | | RHDDALKHIERALHA |
| | | | | TCAAGCGACACCTCGAGCGCCAAGGGTGGAAGGTCCACCTCTCGGCGC | | | SSPGGQDRVELRVN |
| | | | | TCGTGTACGGCTCGCTCGGCGCGGTGCCGGCCGGCAACCACAAGGTGC | | | QTVPSLAGPALRPDL |
| | | | | TTACTGAGCACCTTGGGTTGCTCAAGCGTGATGCGAAGCGGCTGGACC | | | QLYNHTKKMVAVVD |
| | | | | GGCAGCTCTCGGTGGCGTGCATCCAGTCCAGCCGCCGCATCTGGAACCT | | | LAVAFEEQASDDPES |
| | | | | GCACTGCAGCCAGCACCGCGCGCGCCAGCACCAAGCACCAGGGGGAAG | | | SALARIAAHKRAKYA |
| | | | | TCGGGCGGCGGAGACCGGGGGGACTCCGCCGCGCACCGGCCGCCGCT | | | GVKRHLERQGWKVH |
| | | | | AGACGGCACACAGGCCCACAGCGGCCGACAGGGCCACACCCAGGTAG | | | LSALVYGSLGAVPAG |
| | | | | GGAACCGCCTTCAAACCCGGCCGGTACATTATGGTCCGACACCTATGAG | | | NHKVLTEHLGLLKRD |
| | | | | GTGCAACCGGTACACAAGTTACACACCACATAGCGACTACCAGGTATTT | | | AKRLDRQLSVACIQS |
| | | | | ACTACCTGGAAGCCAAGGATTAACCGGTCGGTAATACACATAACTTT | | | SRRIWNLHCSQHRA |
| | | | | (SEQ ID NO: 1081) | | | RQHQAPGGSRAAET |
| | | | | | | | GGTPPRTGRR (SEQ |
| | | | | | | | ID NO: 1449) |
| NeSL | Utopia- | — | *Phytophthora* | CTCAAGCCTAGCAGCGGCTACCGCAGCTACTCCAGCTCCGGTAGCTGCT | CTCAAGCC | TGACGC | MARVLVEPMQVDEC |
| | 5_PI | | *infestans* | ACTGCTACAACTGCTCGCGCTGCTGCTCGCGTCGCCGTGGAGCACCACG | TAGCAGCG | ACCGTG | SSCDRSTLTADDGSG |
| | | | | CGCACGCTGAACCGAACCAAGAACATCTACCGATGGCTCGCGTGCTCGT | GCTACCGC | ACATAG | DDVAAPSSLNSNDV |
| | | | | GGAGCCCATGCAGGTCGACGAGTGCAGCAGCTGCGACCGCAGCACTTT | AGCTACTC | TGCGGC | AAPMDVDSGTDCPP |
| | | | | GACAGCCGACGACGGGAGCGGTGACGACGTTGCAGCCCCAAGCTCCTT | CAGCTCCG | ACGTGA | ALQQPPQRPRALHV |
| | | | | GAACAGCAACGACGTCGCCGCCCCCATGGACGTTGACTCCGGCACTGAT | GTAGCTGC | AGATGC | GSKRRRLDADDEEEA |
| | | | | TGCCCTCCAGCGTTGCAACAGCCGCCCCAGCGACCGCGTGCGCTGCACG | TACTGCTA | ACATGA | RQLQEEEEAGIHAPA |
| | | | | TAGGCAGCAAGCGCCGCCGACTCGACGCAGATGATGAGGAAGAAGCTC | CAACTGCT | AGCTCC | LRLSAASAQPASVLA |
| | | | | GCCAGCTGCAAGAAGAGGAGGAGGCTGGCATCCATGCCCCAGCGCTCA | CGCGCTGC | GACACT | VYTHNASRFDCTLYA |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCTATCCGCGGCCAGCGCTCAACCGGCCTCCGTCCTCGCCGTGTACAC | TGCTCGCG | GGGCCA | YTAGSFASLKTHRNS |
| | | | | GCACAACGCGTCGCGGTTCGACTGCACGCTGTACGCGTACACGGCCGG | TCGCCGTG | AGTGGG | RHRRTAFLDRFSAGC |
| | | | | CAGCTTCGCATCACTGAAAACGCACAGGAACTCTCGGCACCGCCGCACC | GAGCACCA | CGGCCA | ACGVPFASRLAAARH |
| | | | | GCATTCCTCGACCGATTCTCGGCGGGTTGCGCGTGTGGCGTGCCCTTCG | CGCGCACG | TGCGCG | AQACASLSSAPLAEA |
| | | | | CCTCGAGGCTGGCTGCAGCAAGACACGCGCAAGCGTGCGCCAGCCTCT | CTGAACCG | ACCAAG | SSAAGASSHTVDEAD |
| | | | | CGAGCGCACCATTGGCCGAGGCTTCGTCGGCAGCAGGAGCATCAAGCC | AACCAAGA | GCAAGA | STVSAAGHTEPDLPR |
| | | | | ACACTGTCGACGAAGCCGACTCCACCGTCTCAGCCGCGGGTCACACCGA | ACATCTAC | CAGCTC | HNATELTASPPLVSSP |
| | | | | GCCCGACCTGCCCCGCCACAACGCCACGGAGCTCACAGCGTCCCCCCCG | CG (SEQ ID | GTGCAC | DVEVQAPETEATENR |
| | | | | CTGGTGAGCTCCCCCGATGTTGAAGTGCAGGCACCAGAGACAGAGGCC | NO: 1205) | ATGGTG | WGTPLPRVLVASRIA |
| | | | | ACCGAGAACCGCTGGGGCACTCCACTTCCGCGCGTGCTGGTCGCGTCTA | | GGGTTG | GRLAQVPPPRWGPP |
| | | | | GGATCGCCGGGCGCCTCGCTCAGGTGCCACCCCCACGCTGGGGCCCCCC | | GTAGTG | LPRTTIAGRIATRLAA |
| | | | | GCTACCGCGCACTACCATCGCGGGCCGCATTGCGACGAGGCTCGCCGCC | | GCTTCCT | TPAPRWDPPLPRSLV |
| | | | | ACACCTGCCCCCCGCTGGGACCCACCGCTGCCACGAAGCCTGGTTGTGT | | CACACG | VSRIAARLLPALPDAP |
| | | | | CACGCATCGCCGCCCGCCTGCTACCCGCGCTACCAGACGCGCCTGCATG | | GCCGCG | ACEEEAKDSDTMDW |
| | | | | CGAGGAAGAGGCCAAGGACAGCGACACGATGGACTGGGCGCCAACTT | | AGGCCT | APTWTNEETKDSEPH |
| | | | | GGACAAACGAGGAGACCAAGGACAGCGAGCCGCATGACGAAGCGCCA | | GTGGGA | DEAPGQVDEETIDDA |
| | | | | GGGCAGGTCGACGAGGAGACCATCGACGACGCCGACGGCGAGTGGCT | | AGCCGA | DGEWLLRFDGACRA |
| | | | | TTTGCGCTTCGACGGTGCTTGCCGTGCAAACCCAGGCCCAGGCGGCGCC | | CTACCG | NPGPGGAGAALFKP |
| | | | | GGCGCAGCTCTCTTCAAGCCCAGCGGCCCCGTAGTGTGGACTTGTTCCC | | GTTCGC | SGPVVWTCSHYDPS |
| | | | | ACTACGACCCGAGCACCACGGCAACGAACAACACAGCAGAGTACACTG | | GGTGGC | TTATNNTAEYTALLL |
| | | | | CGTTGCTGCTCGGGGCCAGGGCTGCCGCCGACCACGGCGTCACGAAGC | | CGGCCG | GARAAADHGVTKLR |
| | | | | TGCGCGTCGAGGGCGACAGCACGCTGGTCATCCAGCAAGTGCGGGGCA | | CTTAAAC | VEGDSTLVIQQVRGIF |
| | | | | TCTTCGCGACGAGAAGCACGCGGCTCCGAGCACTGCGCAACAAGGTCA | | CAGGTA | ATRSTRLRALRNKVKL |
| | | | | AGCTCGAGCTCGCGCGCGTGGGGAGCTTCTCGCTCCACCACATCGACCG | | GACACG | ELARVGSFSLHHIDR |
| | | | | GCAGGCGAACGGCCACGCCGACCGCCTCGCCAACGCCGGCCTCGACCG | | CACAGT | QANGHADRLANAGL |
| | | | | ACGCCGCACCAAGCTCGAGTGCAGTGTGCACCCCGATGGCAGGGGCTG | | GTCCTCA | DRRRTKLECSVHPDG |
| | | | | CACCAACACCTCTGTGGCGACCGCAGCGCCTACTGCTCCTGCAGCGCCC | | AGCGCC | RGCTNTSVATAAPTA |
| | | | | TTGCCCCCAGCCCGGCCTCCTGCAACTACAGCCGCTCCGTCTCATGATGA | | GGCGCC | PAAPLPPARPPATTA |
| | | | | CGACCACAGCGTTCAAGGCGACATCGACGATGGCGAAGTATACGCTGC | | TCCGAG | APSHDDDHSVQGDI |
| | | | | AATGTGCATCGGCCCCGATGCGGTGCCGCACCGCCGACCGCGCCTCCGC | | CACATG | DDGEVYAAMCIGPD |
| | | | | CTACGGCACTTGACGGACGAGGAGTCCGAGGAGGCTGGCGACGTCGTG | | ACAGGT | AVPHRRPRLRLRHLT |
| | | | | GAGAGGCTGGCAGCGTCGCTGGCGGCGAAGATTGCAGACGCGCCCGA | | GCAGAC | DEESEEAGDVVERLA |
| | | | | CTGGGAGACGGCGGAGGGCTACATCACAGCCCTACCGTACGCTCTCTAC | | ACCCAG | ASLAAKIADAPDWET |
| | | | | GACAAGCTGCAGCCGTACTCCCAGGCCCAGCCTCAGCCTCCAAGCCAAC | | GATGCA | AEGYITALPYALYDKL |
| | | | | AGCAGCAGCAGCAGCAGCAGCAGCGACCACGGCAGCAGCAGCAAACACGG | | CGCGCT | QPYSQAQPQPPSQQ |
| | | | | CAGCGTCGACAGCGGAGAGGCAAGCGCGGCGGTGGCAGCCAACGCAG | | CCGAGA | QQQQQQRPRQQQ |
| | | | | GCAGCGGAAGACGCGCCGCCGACGGCCCCCGCGGGTGACACGCCACCA | | CGCTGG | QTRQRRQRRGKRGG |
| | | | | CCGCGAGCACCGGATCGATGAAGCCCTCGACGACCTCCACGCGATCGA | | CGCATG | GSQRRQRKTRRRRPP |
| | | | | GAGCAGGCGCCCTCAAGACAGGACGGCCATCAGCAAGGCCAGGCGTCG | | TGCTTAA | RVTRHHREHRIDEAL |
| | | | | AGTCGGCCGCATCCGCTCCGCCCTTGACCAGCACCAATTGCGCCACCGC | | CCACTG | DDLHAIESRRPQDRT |
| | | | | TTCGACACCGATGAGAAGGTGTGCGTGGACGCCATCCTGGCTGGGGCG | | CGACGG | AISKARRRVGRIRSAL |
| | | | | CGAGCGAGCCAAGGAGCGACAACGGCACCACCGTCGGCAACCACGGAC | | AACCAT | DQHQLRHRFDTDEK |
| | | | | CCCCCAGCTCCGATGGACGACAGCAGGTGCCCCATTCCCGGCGACGATC | | GGACGC | VCVDAILAGARASQG |
| | | | | TATGGAGGTTTTTCGACAGCGTTAACACGCCACGGCGGTCGTTCGACGC | | AGTCCG | ATTAPPSATTDPPAP |
| | | | | AGAGGCACCAGACGGAGCTGCCTTCCGCGAAGCGATGGCGTGCTTGCC | | TGGCCG | MDDSRCPIPGDDLW |
| | | | | CGCCGCCACGAGAGCCCAGGAACTGCTGACGGAGGCGCCTACGGTGGA | | GCCATG | RFFDSVNTPRRSFDA |
| | | | | CGAGGTTGAAGACCAGATTCAGCACGCCCGCGCCAGCTCCAGCCCCGG | | ACGCCG | EAPDGAAFREAMAC |
| | | | | CCTCGACGGCGTTGGTTACGACATCTACAAGCAGTTCGCCGCCCACCTC | | CACTCA | LPAATRAQELLTEAPT |
| | | | | CTGCCAGCACTGCACACAGCGTTCGTGTGCTGCTGGAACCACAAGCGG | | AGATTA | VDEVEDQIQHARASS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTGCCTCAGAGCTGGAAGCTCGGCGTGGTGCGCCTTCTCCACAAGAAA | | TTGAGC | SPGLDGVGYDIYKQF |
| | | | | GGCGATCGACAGGATCCTGCCAACTGGCGGCCGATCTGCTTGCAGCAG | | GTGCGC | AAHLLPALHTAFVCC |
| | | | | ACCATCTACAAGCTCTATGCCGGCATCCTGTCACGCCGGTTCGTGCGCTG | | TCCTCGC | WNHKRVPQSWKLG |
| | | | | GCTGGACGCAAACGCTCGTCACGCAGAGGCGCAGAAAGGATTCCGGGC | | ATCGTC | VVRLLHKKGDRQDP |
| | | | | GATGAACGGCTGCGGGGAGCACAACTTCCTCGCGGCCACGCTCGTCGA | | GGCCGA | ANWRPICLQQTIYKL |
| | | | | CCACGCCCGCCGCAAGCGCAAGGAGCTGCACGTCGTGTGGTACGACCT | | CCAGCA | YAGILSRRFVRWLDA |
| | | | | TGCCAACGCCTTCGGCAGTGTGCCACACGACTTGCTATGGGAAACGCTG | | GGACCG | NARHAEAQKGFRAM |
| | | | | GCGCGCCAAGGCGTACCGCCCACGTTCGTGGACTGCTGCCGCGGGATC | | TGCTGA | NGCGEHNFLAATLV |
| | | | | TACAGTGATGCAGCCTTCACCATCGGGAACGCCGCCGACGGCACCACA | | GCTCCG | DHARRKRKELHVVW |
| | | | | GCGCCCATCAGGCTTCGCGTGGGAGTATTCCAGGGCTGCCCGCTCAGCC | | CGTGAA | YDLANAFGSVPHDLL |
| | | | | CCCACCTCTTCACCGCCGCAATCGCCCCGCTGCTCCATGCGCTGAAGAG | | CCAGAC | WETLARQGVPPTFV |
| | | | | GCTGCCGGTCACTGGAGTGCAACTCACCGGCGTGGACCGTCCCGGAGC | | CGTGCC | DCCRGIYSDAAFTIG |
| | | | | TGCTGCCTACGCGGACGACCTCAAGACGTTCAGTAGCTCCGTGGACGGA | | GTCACTC | NAADGTTAPIRLRVG |
| | | | | ATCAAGAGGCAGCACGAGCTCGTGGCGACCTTCCTACGATGGACCGGC | | GCCGGC | VFQGCPLSPHLFTAAI |
| | | | | ATGGCGGCGAACCTTTCCAAGTGCAGCGCCATGTCGGTCCAGCGCGAC | | CCCGCG | APLLHALKRLPVTGV |
| | | | | AGCCGGGGCGTGCTCAAGACAGGTGACCTATGCCTCAAGCTCAACGAC | | CTACGG | QLTGVDRPGAAAYA |
| | | | | GCAGAGATCCCAGCGCTGAGCATGACGGCCTCCTACGCGTACCTCGGCA | | CCCGAC | DDLKTFSSSVDGIKR |
| | | | | TCGGGGACGGCTTCGACCACGTGCGCCGCCGCCTCGAGCTCGCGCCAAT | | CTTCAGC | QHELVATFLRWTGM |
| | | | | GATGAAGCAGCTCAAGCACGACGCGACGGCGCTGATGCAGTCGGGGCT | | TCTACAA | AANLSKCSAMSVQR |
| | | | | GGCCTCATGGCAAGTGGTGAAGGCGGTGAAGGTATACCTCTACCCCCG | | CCACAC | DSRGVLKTGDLCLKL |
| | | | | CATAGAGTACGCCCTTCGCCACCTTCGCCCGTTCAAACAGCAATTAGAA | | CAAGAA | NDAEIPALSMTASYA |
| | | | | GCTTTCGACGAGCACCTCCGCCGCGGGCTCCGCCACCTGCTGCGACTAC | | GACGGT | YLGIGDGFDHVRRRL |
| | | | | CGACGAACGCCACCAGCGCCTTCTTCTCAGCGCCGACATCGCGCGGCGG | | GGCGGT | ELAPMMKQLKHDAT |
| | | | | GCTGGGCCTTCTGCCGCTGACGGAGCTGCACGCGGCGCTTCAGATCGCC | | GGTCGA | ALMQSGLASWQVVK |
| | | | | CATGGGTGGCAGATACTCAACTCCCCAGACGGCGCCACCCAGAGGATT | | CCTGGC | AVKVYLYPRIEYALRH |
| | | | | GCCCGCGAGCAGCTCCGGGAGATTCCAGACGCGCGCCACCGCCTGGAC | | CGTGGC | LRPFKQQLEAFDEHL |
| | | | | ACTGCCCACTGGAGGAACCGCGACGCAGAGCTGTGCGAGCTGCTGCTC | | GTTGAG | RRGLRHLLRLPTNATS |
| | | | | AACTCGCAGCTCGGACAGTCCAGCCACGCCCCACCCAAGCGGCGCAACT | | GAGCAG | AFFSAPTSRGGLGLLP |
| | | | | GCGACATCGGATCCCTTTGGATCGACATTCGGCGCCAGCTCGGCACGCT | | GCGAGT | LTELHAALQIAHGW |
| | | | | CGGGCTCAAATTCGAGACCGCGCCTGGCCGACGCAGTCACCAACCAGC | | GACGAC | QILNSPDGATQRIAR |
| | | | | CCGCCCAGCCATTGCAGCTTTCGCGTGCCGCACCACGACAAGTGGCTGA | | GCGAGT | EQLREIPDARHRLDT |
| | | | | CGCACCGTGACATAGTGCGGCACGTGAAGATGCACATGAAGCTCCGAC | | AGCTCG | AHWRNRDAELCELLL |
| | | | | ACTGGGCCAAGTGGGCGGCCATGCGCGACCAAGGCAAGACAGCTCGTG | | GCACTG | NSQLGQSSHAPPKRR |
| | | | | CACATGGTGGGGTTGGTAGTGGCTTCCTCACACGGCCGCGAGGCCTGT | | TCCCGG | NCDIGSLWIDIRRQL |
| | | | | GGGAAGCCGACTACCGGTTCGCGGTGGCCGGCCGCTTAAACCAGGTAG | | ATCGCC | GTLGLKFETAPGRRS |
| | | | | ACACGCACAGTGTCCTCAAGCGCCGGCGCCTCCGAGCACATGACAGGT | | AACCAC | HQPARPAIAAFACRT |
| | | | | GCAGACACCCAGGATGCACGCGCTCCGAGACGCTGGCGCATGTGCTTA | | AAGCGA | TTSG (SEQ ID NO: |
| | | | | ACCACTGCGACGGAACCATGGACGCAGTCCGTGGCCGGCCATGACGCC | | GCCAAG | 1450) |
| | | | | GCACTCAAGATTATTGAGCGTGCGCTCCTCGCATCGTCGGCCGACCAGC | | TACGAC | |
| | | | | AGGACCGTGCTGAGCTCCGCGTGAACCAGACCGTGCCGTCACTCGCCG | | CACATC | |
| | | | | GCCCCGCGCTACGGCCCGACCTTCAGCTCTACAACCACACCAAGAAGAC | | AAGCTA | |
| | | | | GGTGGCGGTGGTCGACCTGGCCGTGGCGTTGAGGAGCAGGCGAGTGA | | CACCTC | |
| | | | | CGACGCGAGTAGCTCGGCACTGTCCCGGATCGCCAACCACAAGCGAGC | | GAGCGC | |
| | | | | CAAGTACGACCACATCAAGCTACACCTCGAGCGCCAAGGATGGAAGGT | | CAAGGA | |
| | | | | ACACCTCTCGGCACTCGTGTACGGGTCGCTTGGGGCGGTCGCTAGTGGC | | TGGAAG | |
| | | | | AACTACCAGGTGTACACCACACACCTGGGGCTACTCAAGCGCGATGCAA | | GTACAC | |
| | | | | AGCGGCTGGACCGGCAGCTGTCTGCCTAATGCATCCAGTCCAGCCGCCG | | CTCTCG | |
| | | | | CATCTAGAATCTACACTGCAGCCAGCACCGGACTCGCCAACACCAGGCG | | GCACTC | |
| | | | | AGGCCCAGCCAAGGACCAAGAGGCAGCCGGGCGACGGAGACCGGGGG | | GTGTAC | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GACTCCGTCCCAGACAAGCCGCCGCTAGGCGGAAACCAGGCCCAAGAC<br>GGCCGACAGGGCCCCACCCAGGTAGGGAACCGCCCTAGAAACCCATTT<br>CGGTGGTCGACTCGCAAGCCTTACCTATATTTTAGACGTAGCGACCAAA<br>TTACAAATTTGGTAACGAGTAAGCCAAATGGTAATACACAAAACTTT<br>(SEQ ID NO: 1082) | | GGGTCG<br>CTTGGG<br>GCGGTC<br>GCTAGT<br>GGCAAC<br>TACCAG<br>GTGTAC<br>ACCACA<br>CACCTG<br>GGGCTA<br>CTCAAG<br>CGCGAT<br>GCAAAG<br>CGGCTG<br>GACCGG<br>CAGCTG<br>TCTGCCT<br>AATGCA<br>TCCAGTC<br>CAGCCG<br>CCGCAT<br>CTAGAA<br>TCTACAC<br>TGCAGC<br>CAGCAC<br>CGGACT<br>CGCCAA<br>CACCAG<br>GCGAGG<br>CCCAGC<br>CAAGGA<br>CCAAGA<br>GGCAGC<br>CGGGCG<br>ACGGAG<br>ACCGGG<br>GGGACT<br>CCGTCCC<br>AGACAA<br>GCCGCC<br>GCTAGG<br>CGGAAA<br>CCAGGC<br>CCAAGA<br>CGGCCG<br>ACAGGG<br>CCCCACC<br>CAGGTA<br>GGGAAC | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | CGCCCTAGAAACCCATTTCGGTGGTCGACTCGCAAGCCTTACCTATATTTTAGACGTAGCGACCAAATTACAAATTTGGTAACGAGTAAGCCAAATGGTAATACACAAAACTTT (SEQ ID NO: 1328) | |
| NeSL | Utopia-5_PR | — | *Phytophthora ramorum* | CCAGGCATCACCCCCGCCGCCCCCAAGCGCTCCGCCGCCGAGCGCAGCTGCGGCTGCTGCCGCCCCACTGGTGACGGCAGTCGCAGCTGCCCCTGCCACCTCTCCTGTTGGCCGCGCCGCCGTGGAGCCCCGCGCGCGCGCCGAGCCGCCCCAAGAACAAGCACCCCCAGCTAGCGCGCGCGCGGAGCCCATGTCGGGCGACGTGGTCAGCAGCGACGGCAGCAGCAGGACGACGGACGTGAGCGGCGACGGCGACGACGGCGCCGACGGCGCAGGCAGCAGCGATGCAGCAGGCGATGTCGGCGTCGTCGCCATGGATGTTGACCAAGGTGCCCGCCGACAGCGGCCGCCATGGCAGCGCGTCGGCGGCAAGCGTCGACGTCTCAACGACGTCGACGACGAAGACACCCGCGAGCTGGCAGAGCTCCTGCTCGAGGAGGAGGACGAGGTTGGGGCCCAAGCACCAGCGCTCAGGCTATTCGCGGCCAGCGCTCACCCGGCCTCCGTCCTCTCCGTGTACGCACACAATGCGCAGCGCTTCGTGTGCACGCTGTGCGCGTACACGGCCGCCAGCTTCGCGTCGCTCAAGCGACACCGGGACTCACGACACCGGCGCGTGTCCTTCGTGGACAAGTTCTCGGCGGGCTGCGCGTGCGGCACGCCCTTCGGCTCGAGGCTGGCAGCGGCGAGACATGCGCAAGCGTGCGCCAGCCTCTCGATCCCACGCACGGTAACAGCTCCGGCGGCAGCAGGAGATTTGAGCCCCACTGCCACGGGAGCCAACGCCACCGCCTCGGCGGCCGCAACTTCGCCCGATTTGCCCCGCCCAGCTTCCCCGGAGCTCGCTGCGTCCCCCCCGCAGACGAGCCCCTTTGACGTTGCCATACAGGCAGACGCTGCAGAGCAGACAGCGTGGACGCGCTGGGACCCTCCGCTCACCCGCGCTGCGGTGGCAGCCCGTGTCGCCTCCCGCCTCGCCGTGGTTCCCGCGCCGCGATGGGGGCCGCCGCTGTCAAGGACGCTGGTGGCCTCCAGGATTGCAGCACGCCTGGACGCGCAGACGTCACGATGGGGACCGCCCCTGCCACCGGCGATGGTGGCGTCCCGGATTGCGTCGAGACTCGCCGCCATGCCGGCACCCCGCTGGGGCCCGCCGCTGCTGCGGACCGTGATCGCATCCCGCATCGCCGACCGACTGCTCCCACCGGAGTTGGCGGCCGACGAGGAGACGAAGGATGACGACGTCCACATGGACAACGCGGCCAGCGTGGACGTCGACGAGGAGTCCGAGGTCGCCGACGT | CCAGGCATCACCCCCGCCGCCCCCAAGCGCTCCGCCGCCGAGCGCAGCTGCGGCTGCTGCCGCCCCACTGGTGACGGCAGTCGCAGCTGCCCCTGCCACCTCTCCTGTTGGCCGCGCCGCCGTGGAGCCCCGCGCGCGCGCCGAGCCGCCCCAAGAACAAGCACCCCCAGCTAGCGCGCGCGCGGAGCCC (SEQ ID NO: 1206) | TGATGCCCGCCAACTACAAGGTGCTTACTGAGCACCTTGGGCTGCTCAAGCGTGATGCGAAGCGGCTGGACCGGCAGCTGTCGGTGGCGTGCATCCAGTCCAGCCGCCGCATCTGGAACCTGCACTGCGCGCAGCATCGAGCACGGCAGCACCAGGGCCAAGCG | MSGDVVSSDGSSRTTDVSGDGDDGADGAGSSDAAGDVGVVAMDVDQGARRQRPPWQRVGGKRRRLNDVDDEDTRELAELLLEEEDEVGAQAPALRLFAASAHPASVLSVYAHNAQRFVCTLCAYTAASFASLKRHRDSRHRRVSFVDKFSAGCACGTPFGSRLAAARHAQACASLSIPRTVTAPAAAGDLSPTATGANATASAAATSPDLPRPASPELAASPPQTSPFDVAIQADAAEQTAWTRWDPPLTRAAVAARVASRLAVVPAPRWGPPLSRTLVASRIAARLDAQTSRWGPPLPPAMVASRIASRLAAMPAPRWGPPLLRTVIASRIADRLLPPELAADEETKDDDVHMDNAASVDVDEESEVADVVMTDHDGEWLLRFDGACRANPG |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGTCATGACCGACCACGACGGCGAATGGCTGTTGCGCTTCGACGGCGC | | CCAAGG | PGGAGAALFKPSGPV |
| | | | | CTGTCGTGCCAACCCTGGCCCAGGCGGCGCCGGAGCCGCTCTGTTCAAG | | GGCAGT | VWACSRYMPSSSAT |
| | | | | CCCAGCGGCCCCGTAGTGTGGGCATGCTCGCGCTACATGCCGAGCAGC | | CGGGCG | NNTAEYTALLLGARA |
| | | | | AGCGCGACCAACAACACGGCCGAGTACACGGCGCTGCTGCTCGGCGCT | | GCGGAG | AADHGATHLRVEGD |
| | | | | AGGGCCGCTGCCGACCATGGAGCCACGCACCTGCGAGTGGAAGGCGAC | | ACCGGG | STLVIQQVRGIFAARS |
| | | | | AGTACGCTTGTGATCCAGCAGGTGCGTGGCATCTTCGCAGCGCGCAGCA | | GGGACT | TRMRALRNQVQSEL |
| | | | | CCCGGATGAGGGCGCTGCGCAACCAGGTGCAGTCCGAGCTCGCGCGGG | | CCGCCA | ARVGSFSLHHIDRQD |
| | | | | TGGGCAGCTTCTCGCTCCACCACATCGACAGGCAAGACAACGCACACGC | | CAGAGC | NAHADRLANRALDL |
| | | | | GGACCGCCTTGCCAATCGCGCGCTGGACCTGCGCCGGACCGTGATAGA | | GGCCGC | RRTVIECGIHCDGVG |
| | | | | GTGCGGCATCCACTGTGATGGTGTTGGCTGCACCGCCACCACGACGGA | | CGCTAA | CTATTTEVQSSSAPEI |
| | | | | GGTACAGTCATCATCAGCGCCCGAGATACCGACCCGGCCGGTTGCTGAC | | GCGGAC | PTRPVADDHDEHEV |
| | | | | GACCATGATGAACATGAAGTTGTTGATGTTGTTGATGTTTGTGGAGTTT | | ATCGGG | VDVVDVCGVCGVCG |
| | | | | GTGGAGTTTGTGGCGACCGTGGAACTTGTGGAGTCTGTGACGTTAGTG | | CCCGTA | DRGTCGVCDVSGDI |
| | | | | GAGATATCGATGATGGCGAGGTCTACGCAGCCATGCGTACGGGACCTG | | GCGGCC | DDGEVYAAMRTGPD |
| | | | | ACGCTGTTCCTGCGCGCCGACCACGCCTCCGCTTGCGGAAACTCACTGA | | GACAGG | AVPARRPRLRLRKLT |
| | | | | CGAAGAGCAAGAAGAGGCAGGCACGCTGGCGGAACGGCTTGGAGCGA | | GCCACA | DEEQEEAGTLAERLG |
| | | | | CGCTGGCGGCCAAGATTGCAGACGCACGCGACTGGGAGTCGGCGGAG | | CCCATGT | ATLAAKIADARDWES |
| | | | | GGATACATCACAGCCCTCCCTTATCTACTCTACGACAAATTGTTGCCGTA | | AGGGAA | AEGYITALPYLLYDKLL |
| | | | | CTCCCAGGGCCCAGCTCGCTCCTTGCCGGTCCGCCAGCACCAACGGCAG | | CCGCCCT | PYSQGPARSLPVRQH |
| | | | | CAGCAGCAGCCGGACGGACAATTCCAGCGACCCACCCAGTCCCGATCTG | | CTAAAC | QRQQQPDGQFQR |
| | | | | CGGCTCGTCGACAGCGACGCCAGCGCCACCGGGCACGTCGCCGACCGC | | CCGCCC | PTQSRSAARRQRRQ |
| | | | | CACGCGTGACTCGTCACCACCGTGAACACCGACTAGACGAAGCGCTTGA | | GGTACA | RHRARRRPPRVTRH |
| | | | | CGACCTCCACGCGGTGGAGAGAGCTACGCCCAGCGACCGCCGCTCCATT | | TTATGGT | HREHRLDEALDDLHA |
| | | | | CGCCGAGCCCGCCGCCGGGTCGGCCGCGTTAATTCGGCCGTCGAACAA | | CCGACA | VERATPSDRRSIRRAR |
| | | | | CAACGGCTCCGGCACCACTTCGATACGAACGAGAAGGGCTGCGTGGAG | | CCTATG | RRVGRVNSAVEQQR |
| | | | | ATCCTACTGGCCAAGGCGCGTGCACAGAGGTCGACGACGGTGGCCCGG | | AGGTGC | LRHHFDTNEKGCVEI |
| | | | | ACGGCAGTTGGAGAGCCGAACAGCGGTGCGGCCGAGGACGACGGCAC | | AACCGG | LLAKARAQRSTTVAR |
| | | | | GTGCCCCATCCCGAGCGAGCGCCTTCACCGCCATTTCACCGAGGTGAAC | | TACACA | TAVGEPNSGAAEDD |
| | | | | ACGCCCGGGTCCAGCTTTGATGCGATGGCCCCCGTGGGTGCACCGTTCC | | AGTTAC | GTCPIPSERLHRHFTE |
| | | | | GTGCGGCACTTGCGCACCTCCCCGCGGCCACAGAGGCCTCGGAGCTGCT | | ACACCA | VNTPGSSFDAMAPV |
| | | | | GACAGAGGCGCCGACGCCCGATGAGATCGAGGATCAGCTGCAGCGAG | | CATAGC | GAPFRAALAHLPAAT |
| | | | | CCAAGGGAACGACCAGCCCTGGCCTGGACGGAGTGGGCTACGACGTCT | | GACTAC | EASELLTEAPTPDEIE |
| | | | | ACAAGGCCTTCTCCACCCAGTTACTGCCGGTGCTGCACGCGGCATTCCA | | CAGGTA | DQLQRAKGTTSPGLD |
| | | | | GTGCTGCTGGCAGCACCACCGTGTGCCGCAGAGCAGGAAGCAAGGCAT | | TTTACTA | GVGYDVYKAFSTQLL |
| | | | | CGTGAGGCTCCTGTACAAAAAGGGCCCGCGCGAAGACCCCGCGAACTG | | CCTGGA | PVLHAAFQCCWQHH |
| | | | | GAGACCTATCTGCCTCCAGCAAGTGATCTACAAGACCTACGCCGGGGTC | | AGCCAA | RVPQSRKQGIVRLLY |
| | | | | CTCGCGCGGAGGTTTACGCGCTGGTTGGCTGCAAACGGCCGCCATGCC | | GGATTA | KKGPREDPANWRPI |
| | | | | GACGCCCAGAAGGGGTTCCGCACTGTAAATGGCTGCGGTGAGCACAAT | | ACCGGT | CLQQVIYKTYAGVLA |
| | | | | TTTCTCGCGTCGACGCTGATCGATCATGCGCGCCGCAGCCGCAGAGAGC | | CGGTAA | RRFTRWLAANGRHA |
| | | | | TCCACATGGTCTGGTACGACCTGAAGAACGCCTTCGGCAGCGTGCCCCA | | TACACAT | DAQKGFRTVNGCGE |
| | | | | GGAGTTGCTGTGGGAGGTGCTGCAGCGCATGGGTGTCCCGCCAGCCTT | | AACTTT | HNFLASTLIDHARRSR |
| | | | | TGTGGAGGTCTGCCAGGGGCTGTACCAGGATGCTGCCTTCACCGTCGGC | | (SEQ ID | RELHMVWYDLKNAF |
| | | | | AACGCTGCTGACGGCCCGACCGATCTCGTGCGGCAGCTCGTGGGCGTG | | NO: | GSVPQELLWEVLQR |
| | | | | TTTCAAGGATGCCCGCTGAGCCCCCACCTGTTCACTGCGGCGATCAGCC | | 1329) | MGVPPAFVEVCQGL |
| | | | | CGCTCCTCCACGCGCTGGACCGACTCAAGGACACGGGCGTGCGGCTGT | | | YQDAAFTVGNAADG |
| | | | | CAGCGGACGACCGTCCCGGTGCCTCGGCCTACGCCGACGACCTCAAGAT | | | PTDLVRQLVGVFQG |
| | | | | CTTCAGTGGCACCGCGGACGGCGTTAAGCGACAGCACGCGCTCGTGGC | | | CPLSPHLFTAAISPLLH |
| | | | | CGACTTCCTGCGCTGGACCGGCATGGTGGCGAACCCCAACAAGTGCTGC | | | ALDRLKDTGVRLSAD |
| | | | | ACCATGTCGGTCCAGCGCGACGGACGCGGCGTGCTGAAGGCCTGCGAC | | | DRPGASAYADDLKIF |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTGGAGCTGCAGCTGGACGGAGCCCGGATCCCCTCGCTGATCATGAAC | | | SGTADGVKRQHALV |
| | | | | GCGTCGTACGCGTACCTGGGGACAGGCGACGGCTTTGACCACGTGCGC | | | ADFLRWTGMVANP |
| | | | | CGCCGCATCGAGCTCGTCCCGGCGCTCATGCAGCTCAAGGACGATGCG | | | NKCCTMSVQRDGRG |
| | | | | ACGGCACTGCTCCAGTCGGGGCTGGCGCCGTGTCAGGTGGTGAAGGCG | | | VLKACDLELQLDGARI |
| | | | | GTGAAGACTTACCTCTTCCCGCGGGTGGAGTACGCACTCCGCCACCTCC | | | PSLIMNASYAYLGTG |
| | | | | GCCCCTTTCAGCAGCAACTGGAAGGCTTTAATCGCCACCTCGTTTGCGG | | | DGFDHVRRRIELVPA |
| | | | | CCTTCGCCACCTGCTCCGACTTCCGGTCAGCGCCACGACCAGCTTCTTCT | | | LMQLKDDATALLQS |
| | | | | TCGTGCCGGTGTCGCGCGGCGGGCTAGGCCTGTTGCCACTGACGGAGC | | | GLAPCQVVKAVKTYL |
| | | | | TGCACGCAGCTCCGGCTGATCGCCGACCGGCGCCACCGCCTAGACCCCG | | | FPRVEYALRHLRPFQ |
| | | | | ACCACTGGAAGGAGCGGGAGGAGAAAATATGCGAGCTGCGGATCAAC | | | QQLEGFNRHLVCGLR |
| | | | | TCGCAGCTCGGGACGTCGGCCCACGCCCCACCCAAGCGCCGCAACGGC | | | HLLRLPVSATTSFFFV |
| | | | | GACATCGGCTCGTTGTGGGTCGACGTCCAGCGCCACCTCCGAGGACTCG | | | PVSRGGLGLLPLTELH |
| | | | | GCCTCAAGCTAGAGACCGCGCCGGCGTGCGCGGAGACCGGCACCGCG | | | AAPADRRPAPPPRPR |
| | | | | GAGGCGACGCTGCAGCTTCGCGTGCCGCACCACGAGAAGTGGCTGGAC | | | PLEGAGGENMRAAD |
| | | | | CACCGCACGGTCCTGCGGCAGGTGAAGCTGCACATGAAGAACAAGCAT | | | QLAARDVGPRPTQA |
| | | | | TGGCAGCGGTGGGCCGGGATGAAGGACCAAGGCAAGACCGCCCGCAC | | | PQRRHRLVVGRRPA |
| | | | | CCATGGTGGTGCAGGGAGCGGCTTCCTCACGCGGCCTCGCGGCCTATG | | | PPPRTRPQARDRAG |
| | | | | GGAGACCGACTACCGCTTTGCAGTGGCGGGTCGGCTCAACCAGCTGGA | | | VRGDRHRGGDAAAS |
| | | | | CACGCACAGCGTGCTGAAGCGCCGGCGCCTCCGCGCGCACGACCAGTG | | | RAAPREVAGPPHGP |
| | | | | TCGACAGCCGGGCTGCTCCCGTGCCGAGACACTGGCACACGTGCTGAAT | | | AAGEAAHEEQALAA |
| | | | | CACTGCGCCGGCACCATGGACGCGGTCCGCGGCCGCCACGACGATGCG | | | VGRDEGPRQDRPHP |
| | | | | CTCAAGACCATCGAGCGCGCGCTCATCGCGTCGTCCGGGCGGCCAGGA | | | WWCRERLPHAASRP |
| | | | | CCGCGCCGAGCTCCGGGTCAACCAGACCGTGCCCTCGCTCGCCGGCCCC | | | MGDRLPLCSGGSAQ |
| | | | | GCGCTGCGGCCCGACCTCCAGCTCTTCAACCACACCAAGAAGACGGTGG | | | PAGHAQRAEAPAPP |
| | | | | CGGTGGTCGACCTGGCCGTGGCGTTCGAGGAGCAGGCGAGCGACGAC | | | RARPVSTAGLLPCRD |
| | | | | ACCGAGAGCTCTGCGCTGGCGCGCATCGCCGCGCACAAGCGAGCCAAG | | | TGTRAESLRRHHGRG |
| | | | | TACGCCGGCATCAAGCGGCACCTCGAGCGCCAAGGGTGGAAGGTCCAC | | | PRPPRRCAQDHRAR |
| | | | | CTCTCGGCGCTCGTGTACGGCTCGTTGGGCGCGGTGATGCCCGCCAACT | | | AHRVVRAARTAPSSG |
| | | | | ACAAGGTGCTTACTGAGCACCTTGGGCTGCTCAAGCGTGATGCGAAGC | | | STRPCPRSPAPRCGP |
| | | | | GGCTGGACCGGCAGCTGTCGGTGGCGTGCATCCAGTCCAGCCGCCGCA | | | TSSSSTTPRRRWRWS |
| | | | | TCTGGAACCTGCACTGCGCGCAGCATCGAGCACGGCAGCACCAGGGCC | | | TWPWRSRSRRATTP |
| | | | | AAGCGCCAAGGGGCAGTCGGGCGGCGGAGACCGGGGGGACTCCGCCA | | | RALRWRASPRTSEPS |
| | | | | CAGAGCGGCCGCCGCTAAGCGGACATCGGGCCCGTAGCGGCCGACAG | | | TPASSGTSSAKGGRS |
| | | | | GGCCACACCCATGTAGGGAACCGCCCTCTAAACCCGCCCGGTACATTAT | | | TSRRSCTARWAR |
| | | | | GGTCCGACACCTATGAGGTGCAACCGGTACACAAGTTACACACCACATA | | | (SEQ ID NO: 1451) |
| | | | | GCGACTACCAGGTATTTACTACCTGGAAGCCAAGGATTAACCGGTCGGT | | | |
| | | | | AATACACATAACTTT (SEQ ID NO: 1083) | | | |
| NeSL | YURECi | — | *Ciona* | ATCAACCCACTACTACACCCTCTACAAAGAACCCACTACAGCAAGATCTT | ATCAACCC | TAGCCA | MATSSSSVSSGNVQT |
| | | | *intestinalis* | GGCGACCAACTACACCTGCAGCCTCCCGTCGACTCTTCACCACCTGCGCA | ACTACTAC | AAAGAT | EVRCVYHGKGDLLLE |
| | | | | CCTCCCTCCGACTCCAAGCGGCAGACAGTGGCACCACCAGCACTCCAAG | ACCCTCTA | TTGGTG | CPVAHCPSIHPTVATI |
| | | | | GGTCCACAGCCAGAAGAGTGCACCCCCCACTGCTAGGAAGAGCTAGGC | CAAAGAAC | TTCTTGG | TKHLKKHHTPQFEQI |
| | | | | CATTGCCCGCTGTGGGCCTTGTGCTGGCTGTCTGCCGCTGATTGGCACG | CCACTACA | CGAGCT | TTKNLTITYTCSQCSF |
| | | | | TTAGGGAGTGTGCGCTGAGCACGATAGGGAGGCTGCTGAAGCCGAAG | GCAAGATC | GCAGTC | STTGLTQHHISKHYKT |
| | | | | AACCCGCGCCGGGGACTTTAGGACTTTAACTAAAATCTGTAACACTAAA | TTGGCGAC | CCGGCA | CKGVGAVQEGNKGR |
| | | | | ATTGGAATACTGGATTACTATTGGATTACTACTGGACAATAACCTGATCT | CAACTACA | GAGTAG | FCCPACGTRWALLCK |
| | | | | ACAACAACCAATTGGATTACAGAACCAAATTACAATCTCAACTACAAAC | CCTGCAGC | GCGAGA | ARHHFNNVHFEYDT |
| | | | | AAAAAGTGAGTCCCCGGCCGGGTTTCTATATTACCCAATTACTGTTTTTA | CTCCCGTC | TCGTGA | PPIAAFSGTPYKLKKR |
| | | | | CAATTTTAAAATTTTATAGTATTTTACTAATTTTTCCGCCCCGCTAGCACT | GACTCTTC | GCTCTAC | KFTIINKALTYSCPLPL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TAAATTGGCACCCCCCCCCCCCSTCCAAAAAAAAATAGATAACCCTCCAC | ACCACCTG | ACCGCTT | NQLLCPLWSCSLTILN |
| | | | | CACCTAAACCCCGGTCACCCCCTCAGAACTAATTGGAACCCGGATCTTTT | CGCACCTC | CACGAT | KPLSSVQQETAHGD |
| | | | | CCCTCTATCAAATTTCCGGTTCAGTTTGGCTTAATTACCTAAAACCCGTCT | CCTCCGAC | TTGACG | GSQGQSYVPTQLRQ |
| | | | | TTATTTTATCCCTTTATTGCCCCTTAAACCAAATTATTCAAATTGAAATCC | TCCAAGCG | AGTTCTT | VLRARCHCGNPPIGK |
| | | | | GGCCAAATTGCCTTGCTGAACCACCATTTTTGTTTTTCTTATAAAAGTAA | GCAGACA | CTTGAG | GHWASCQGKRPLSS |
| | | | | ATTTTTCAACAACCCAAAATCATAAAATTAAAACTGTTATCTGATTAGTCT | GTGGCACC | TCGATCC | PKGGRSSPTPPANLT |
| | | | | AAATTCTGTTATTGACAAAAACCTCCATACCAACCTTAATCTTATCATTAT | ACCAGCAC | CCAACG | LHFLNYLPFQLPSQSS |
| | | | | CTTCACCCAGACTGCTCAATCTAGTTCTTTTTTCAATCAATAAGGAGGTG | TCCAAGGG | GCAACG | SPQSSTLDPTACKAR |
| | | | | TTTTCTTTGGTCTGTTGTTTTATAGTTTACCGTTATAATAGTCTGTTGTCCT | TCCACAGC | CACTCCA | VPIPSFLRGDCEVTFFI |
| | | | | ATAGTTTTCCGTGGTGTATTTCTGGTCTACTATAGTTGGTGCCTCTAAAA | CAGAAGA | AATTTAA | IPSVNFYRPYLSYPLR |
| | | | | CATTATTATACCGAAGAGTGCTAGCGATTTCTATTATTAACTCACCCACC | GTGCACCC | CGACCG | MFWRNRTSSGHCSL |
| | | | | AGTACTGCTGTGCATCCACGCAGCACCACGCCTGCCATCACGTACAGTG | CCCACTGC | CATGGC | HRVVRGFVRERLVPH |
| | | | | CGCTTGCTGCCTTGTGTTTTGTTTTGCAGACACCACTGGACGATAGATGG | TAGGAAG | GACGCC | PRSKSPARTPLEFLCE |
| | | | | CGACTTCGTCTTCCTCCGTTTCATCGGGGAATGTTCAGACCGAGGTGCGT | AGCTAGGC | ACTGAT | FRLAGVFPDPGKVAS |
| | | | | TGCGTCTACCACGGAAAAGGAGACTTGTTGCTGGAATGCCCAGTTGCCC | CATTGCCC | CTCCCA | LRPVPAPLTLCLSPPV |
| | | | | ATTGCCCTAGCATACACCCCACAGTTGCCACAATCACAAAACACTTAAAA | GCTGTGG | GTCATCC | AGPMISCEDHSAPPS |
| | | | | AAACATCACACACCTCAATTCGAACAGATAACCACTAAAAATCTCACAAT | GCCTTGTG | GTGCTC | VRSSSPIPNSPASVSS |
| | | | | AACATATACATGCAGTCAATGTAGTTTCTCCACCACCGGTCTCACACAAC | CTGGCTGT | CGAGGG | VEAHLSDLLDKVSSG |
| | | | | ACCACATATCCAAACACTACAAAACATGCAAAGGCGTGGGCGCTGTTCA | CTGCCGCT | CACTTAA | ELRPLSPTLPSSGFFG |
| | | | | GGAAGGCAACAAGGGTCGATTCTGCTGCCCTGCATGCGGTACCAGGTG | GATTGGCA | GGGGAA | PLLPPTPPPRPTPSAE |
| | | | | GGCTCTTTTGTGTAAGGCACGGCACCATTTTAATAATGTCCACTTCGAGT | CGTTAGGG | CCGATTC | KASPSGLSYLPCREVK |
| | | | | ATGACACCCCTCCAATTGCCGCTTTCTCTGGCACACCCTATAAACTAAAA | AGTGTGCG | ACTGAT | IASIARPSPASQRVGC |
| | | | | AAACGGAAATTTACAATTATTAATAAGGCCCTAACATATTCATGCCCTCT | CTGAGCAC | GCTGCA | DADRTGPSLNPNYQ |
| | | | | CCCCCTCAACCAACTACTTTGCCCTTTGTGGTCGTGCTCCCTCACGATCTT | GATAGGG | AGTTGG | QTSPPSTPSFSPIVRP |
| | | | | AAATAAACCTCTTTCAAGCGTGCAGCAGGAAACGGCACATGGCGACGG | AGGCTGCT | CGGGGG | PKFPRSGAKVNSKSK |
| | | | | CTCACAAGGCCAGAGTTATGTTCCAACTCAGTTGCGGCAGGTGCTCAGA | GAAGCCG | CGCACT | PPGVRPRRAKPIEPG |
| | | | | GCCCGTTGCCACTGCGGAAACCCTCCAATTGGAAAGGGCCACTGGGCAT | AAGAACCC | CACCAA | TESASPVDVDTISSSV |
| | | | | CTTGCCAAGGGAAGCGACCACTCTCTTCACCTAAGGGGGGCGCAGTTC | GCGCCGG | TGGAAG | QEPCTPENRTPEFFYE |
| | | | | GCCCACTCCACCTGCTAATCTAACCCTCCACTTCCTTAACTATCTCCCCTT | GGACTTTA | ATGAGG | RKWLVSILNIHEREGS |
| | | | | CCAACTTCCCTCACAAAGCTCCTCCCCCCAAAGTAGCACCCTCGACCCTA | GGACTTTA | GAGCCC | NFFQFNRDLEYWTQ |
| | | | | CGGCCTGTAAAGCTCGAGTCCCCATCCCCTCTTTCCTACGCGGCGACTGT | ACTAAAAT | AACGAT | LLSGSQKGGRAKRAS |
| | | | | GAAGTCACCTTTTTCATCATCCCCTCCGTTAATTTTTATAGACCCTACCTC | CTGTAACA | GCCCCG | YNRGAANQAMKNR |
| | | | | TCCTACCCCCTCAGGATGTTCTGGCGTAACCGAACATCCTCCGGTCACTG | CTAAAATT | AACTAC | DSGRKDFDPRPVAG |
| | | | | TTCCCTACACCGGGTCGTTCGAGGCTTTGTCCGAGAGCGACTCGTCCCCC | GGAATACT | CGCACC | HSSGGGTELGSRPRY |
| | | | | ATCCTCGGTCGAAATCGCCGGCGAGGACTCCCCTTGAATTCCTCTGCGA | GGATTACT | GTCCCC | PKGARLRADFWRD |
| | | | | GTTCCGGCTCGCGGGGGTCTTCCCCGATCCTGGGAAGGTCGCGTCCCTT | ATTGGATT | AGCACC | MKGTVRKLLDGSNG |
| | | | | CGACCCGTACCAGCTCCCCTTACGCTTTGCCTTTCTCCACCAGTCGCTGG | ACTACTGG | GTGTCC | ERRCGIPLDIIERKFRQ |
| | | | | TCCAATGATTTCCTGTGAGGACCACAGCGCCCCCCCTTCCGTTCGCTCGA | ACAATAAC | TTGTGA | VSMPGWIDHRRYAA |
| | | | | GCTCCCCCATTCCTAACTCCCCAGCCTCCGTAAGCTCCGTGGAGGCGCAC | CTGATCTA | GTAATT | GASPSLVTQAETDVA |
| | | | | TTGTCTGACTTGTTAGACAAAGTGTCTTCCGGAGAACTGCGGCCGCTGT | CAACAACC | ATTTTCA | ITSEEVEAVLSGLNVQ |
| | | | | CCCCCACCCTGCCTTCTTCAGGCTTTTTTGGCCCTCTGTTGCCACCCACTC | AATTGGAT | CTAATCC | SAPGSDGLSYRFWK |
| | | | | CCCCTCCCCGACCTACCCCCTCGGCCGAAAAGGCATCTCCTTCAGGCCTT | TACAGAAC | AGGGAC | GLDPSGRLLSCLFEIV |
| | | | | TCCTACCTACCCTGCAGAGAAGTAAAAATCGCGTCCATTGCACGGCCAT | CAAATTAC | GGGGCC | RRHGRIPGAWPTCS |
| | | | | CCCCTGCCTCACAGAGGGTCGGCTGCGACGCGGACCGAACAGGGCCTT | AATCTCAA | ATGAAC | VILLCKDAQGDVQDV |
| | | | | CGCTGAACCCTAATTATCAGCAAACCTCCCCCCCGTCTACTCCGAGTTTC | CTACAAAC | TGAACT | GNWRPITICRTLYKLY |
| | | | | TCCCCCATAGTTAGACCCCCTAAATTCCCCCGGTCGGGCGCCAAAGTAA | AAAAAGTG | ATGTCT | AAVIARRIQTWAKQ |
| | | | | ATTCCAAGTCCAAACCCCCCGGCGTCCGACCACGCCGTGCCAAGCCAAT | AGTCCCCG | GCACGC | GGVLSRLQKGFMPV |
| | | | | TGAGCCAGGGACCGAGTCGGCATCACCCGTTGATGTCGACACTATTAGT | GCCGGGTT | TGCCCC | EGVFEHVFMLDTVLS |
| | | | | AGTTCGGTTCAGGAACCTTGTACTCCAGAAAACAGAACCCCGGAATTTT | TCTATATT | GCCTAG | DAKLRRKNLLAVFLD |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTTATGAGCGAAAGTGGCTCGTGAGTATTTTAAATATTCACGAGCGGGA | ACCCAATT | CCTCGG | VRNAFGSVRHECLLK |
| | | | | GGGATCCAATTTTTTTCAATTTAACCGGGATCTGGAGTATTGGACGCAG | ACTGTTTT | CCACAA | VLRHFDAPHYLVELV |
| | | | | TTGCTTTCAGGCTCCCAGAAGGGAGGACGCGCGAAGCGTGCGTCCTAC | TACAATTT | ATAAAT | RDIYTGATCRVRSSV |
| | | | | AATCGTGGTGCGGCGAACCAAGCGATGAAAAACCGCGATTCCGGCCGT | TAAAATTT | AGTCAA | GETGDIPCDRGVRQ |
| | | | | AAGGATTTCGATCCCCGGCCGGTAGCAGGCCACAGTAGTGGAGGTGGC | TATAGTAT | GCCGGG | GYPLSGILFNLVTEVLI |
| | | | | ACCGAGCTCGGTTCGCGGCCACGATACCCTAAGGGCGCACGTCTTCGTG | TTTACTAA | GCGTAC | PGLSAGNDGYRMAC |
| | | | | CCGACTTCTGGAGGGACATGAAAGGGACGGTCCGTAAGTTACTTGATG | TTTTTCCG | TACCAAT | LGGKLTQVLAYADDL |
| | | | | GTTCGAACGGTGAGCGTCGCTGCGGGATTCCCCTCGATATCATAGAGCG | CCCCGCTA | TGATTC | VVVTENRDQMLRQL |
| | | | | GAAATTCCGGCAAGTATCCATGCCCGGCTGGATAGACCACAGACGGTA | GCACTTAA | GGATTT | GVCEEFGRWAGLAF |
| | | | | CGCGGCCGGCGCGTCCCCGTCCCTAGTAACCCAAGCTGAAACGGATGTT | ATTGGCAC | GGCGGG | NQRKCGLIGWRTLR |
| | | | | GCCATCACCAGTGAGGAAGTTGAGGCGGTCCTCAGTGGCCTAAACGTTC | CCCCCCCC | GCCCAT | GGRRVALEDPLLLNG |
| | | | | AGTCCGCTCCGGGCTCGGATGGCCTCTCCTATCGATTTTGGAAGGGCCT | CCCSTCCA | CACGCG | VEIPLLRPGEHYKYLG |
| | | | | CGATCCTAGTGGTCGATTGTTGTCATGCCTTTTCGAAATCGTTAGGAGGC | AAAAAAAA | CCTCCGC | AMTGVMSVPRTGS |
| | | | | ATGGTCGTATTCCGGGCGCGTGGCCGACTTGTAGCGTCATCCTGCTCTG | TAGATAAC | CCCCAC | QLIKDFRARLQRLFTS |
| | | | | TAAAGATGCTCAGGGTGACGTTCAGGACGTGGGAAACTGGAGACCGAT | CCTCCACC | ACACAA | FLTPHQKLIALKRFLLP |
| | | | | CACCATCTGCCGCACTCTGTACAAATTGTACGCGGCTGTGATCGCCAGA | ACCTAAAC | AAACAC | SLSFHLRVRPIARSELI |
| | | | | CGTATTCAGACTTGGGCGAAACAGGGGGGGGTGCTCTCGCGGCTCCAG | CCCGGTCA | TTTTAAA | ALDRRVRECLRVAFR |
| | | | | AAAGGGTTCATGCCAGTTGAGGGTGTGTTTGAGCACGTCTTCATGTTGG | CCCCCTCA | CTCTTCG | LTKPSCQAVFHTPTD |
| | | | | ATACCGTCCTTTCCGACGCCAAGCTGAGGCGCAAGAATCTTCTTGCCGTC | GAACTAAT | GTTCCCC | MDGLGVPSVCSESSI |
| | | | | TTCCTTGACGTTCGGAATGCGTTCGGAAGCGTCCGGCATGAATGCTTGC | TGGAACCC | AACCAC | LTIAQGFKVLTSPDGT |
| | | | | TCAAAGTTCTTCGGCACTTCGATGCTCCCCATTACCTGGTTGAACTCGTG | GGATCTTT | TACAAC | VSATASARVKLYAAK |
| | | | | AGGGATATTTACACCGGTGCGACCTGCCGTGTTAGATCTTCGGTTGGTG | TCCCTCTA | AAAGCG | FGGLTEAGPSDWAR |
| | | | | AGACCGGTGATATACCCTGTGATCGAGGTGTCAGGCAGGGCTATCCCCT | TCAAATTT | AGCGGC | YLSGDDVNGNSTRKP |
| | | | | GTCTGGCATTCTTTTCAACCTGGTAACGGAGGTGCTAATACCGGGGCTC | CCGGTTCA | CCCTCTT | GANLPSGLWTRVRC |
| | | | | AGTGCCGGGAATGATGGCTACCGGATGGCTTGCTTAGGTGGTAAGCTC | GTTTGGCT | AGATCC | ASRQLGAVWRVCPE |
| | | | | ACTCAAGTCCTGGCCTACGCTGACGATCTGGTGGTAGTCACGGAAAACC | TAATTACC | AATTTTA | NGITVRVRNSVITSRD |
| | | | | GTGATCAGATGCTACGTCAGCTGGGTGTGTGTGAGGAATTCGGCCGTT | TAAAACCC | AAATTTT | RRKLIRSFHDCSNQQ |
| | | | | GGGCAGGCCTTGCATTCAATCAACGGAAGTGTGGCCTGATCGGCTGGA | GTCTTTAT | AAATCA | WKEQWMQHPNQE |
| | | | | GGACGTTGCGGGGAGGGAGGAGGGTCGCACTGGAGGATCCTCTGCTC | TTTATCCCT | GTGCAC | KTAAAHMAYADANR |
| | | | | CTTAACGGAGTAGAGATCCCCCTGTTGCGGCCCGGTGAACACTATAAAT | TTATTGCC | TCAACTT | WVKQPSVMEPHTYF |
| | | | | ACCTTGGCGCCATGACTGGCGTCATGAGTGTTCCCCGCACCGGATCCCA | CCTTAAAC | TTTTACG | FALRARLNLLPTRVSR |
| | | | | GCTGATCAAGGACTTCCGTGCAAGGCTCCAACGACTGTTTACATCGTTCC | CAAATTAT | TGTTGT | AIYSRDQHPDILCRRC |
| | | | | TCACACCACACCAGAAGCTGATCGCTCTGAAACGGTTTCTGCTGCCAAG | TCAAATTG | GTTTTTT | GASVESLPHVLNHCP |
| | | | | TCTCAGCTTTCATCTGAGGGTTCGTCCGATTGCGCGGTCTGAGCTGATCG | AAATCCGG | GTATTTT | PNMSIILGRHNLVLQ |
| | | | | CGCTCGACCGTCGCGTGCGCGAGTGCCTTAGGGTGGCGTTTCGCTTGAC | CCAAATTG | TTCCCAC | EVLNAVDKTQFKEIS |
| | | | | CAAGCCCTCGTGTCAGGCTGTGTTTCATACACCGACTGACATGGATGGT | CCTTGCTG | AGATTTT | VDRTVPEHMSETGE |
| | | | | CTGGGTGTCCCGTCGGTATGCAGTGAGAGCAGCATACTGACGATCGCCC | AACCACCA | GTATTTT | ALRPDIVARRNDGSV |
| | | | | AGGGGTTCAAGGTGTTAACGTCACCCGACGGCACAGTGTCCGCGACGG | TTTTTGTTT | TATATTA | VVVDVACPFDQKAN |
| | | | | CTTCGGCGCGCGTGAAGCTCTACGCCGCTAAATTTGGCGGCCTCACTGA | TTCTTATA | TATTTTA | FDEAAKRKLLKYDKLC |
| | | | | AGCAGGTCCTTCGGACTGGGCGCGTTATCTATCTGGTGATGACGTCAAC | AAAGTAAA | TATACAC | CNIAASTGKPVECHSI |
| | | | | GGGAATAGCACTCGCAAACCCGGCGCTAACCTGCCTTCTGGTCTGTGGA | TTTTTCAA | AACACT | VVGSLGSLAEGLSTSL |
| | | | | CTCGCGTCCGCTGTGCCAGCAGGCAGTTAGGTGCTGTGTGGCGCGTTTG | CAACCCAA | ATTTTTA | RALGITDFARSKLVAC |
| | | | | CCCGGAAAACGGCATCACTGTCCGGGTGCGTAATTCTGTGATTACCTCC | AATCATAA | TACACTA | HQG (SEQ ID NO: |
| | | | | CGAGACCGACGGAAGCTCATCAGATCCTTCCACGATTGCTCTAATCAGC | AATTAAAA | CCTTGCA | 1452) |
| | | | | AGTGGAAGGAGCAGTGGATGCAGCACCCCAACCAGGAGAAGACCGCT | CTGTTATC | CTGTCCC | |
| | | | | GCAGCGCATATGGCTTATGCCGATGCGAACCGCTGGGTGAAGCAGCCG | TGATTAGT | ACTTTTT | |
| | | | | TCGGTTATGGAACCTCATACATACTTTTTTGCATTGAGGGCGCGCTTGAA | CTAAATTC | GTAATT | |
| | | | | CCTGTTACCCACTAGGGTTTCACGAGCTATTTATAGCAGGGACCAACAC | TGTTATTG | ATCACCT | |
| | | | | CCGGACATTTTATGCCGACGTTGTGGTGCGTCAGTTGAGTCCCTCCCGC | ACAAAAAC | TTTACCT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATGTACTAAACCATTGTCCTCCCAATATGAGCATAATACTCGGGAGGCA | CTCCATAC | TTTATGC | |
| | | | | TAATTTGGTACTGCAGGAGGTTCTGAACGCGGTAGACAAAACCCAGTTC | CAACCTTA | CGCTCG | |
| | | | | AAAGAGATATCCGTTGACCGAACGGTCCCCGAGCACATGTCGGAGACA | ATCTTATC | CTGAGC | |
| | | | | GGTGAGGCCTTGCGGCCTGACATAGTGGCACGGCGGAATGACGGTTCC | ATTATCTT | TCCTTGC | |
| | | | | GTCGTGGTCGTCGACGTGGCTTGCCCGTTCGATCAAAAGGCGAACTTTG | CACCCAGA | ACGGAT | |
| | | | | ATGAGGCGGCAAAACGGAAGCTCCTAAAGTACGACAAGCTTTGTTGCA | CTGCTCAA | GACCAG | |
| | | | | ATATCGCTGCCTCCACAGGTAAACCTGTGGAGTGTCATTCGATAGTCGT | TCTAGTTC | ACAAAC | |
| | | | | GGGCTCCTTGGGGAGCCTCGCGGAGGGTCTGTCCACCTCCCTCCGGGCT | TTTTTTCAA | TTTTATA | |
| | | | | TTGGGAATAACCGATTTTGCTCGCTCTAAGCTTGTCGCTTGCCATCAAGG | TCAATAAG | AAATTAT | |
| | | | | GTAGCCAAAAGATTTGGTGTTCTTGGCGAGCTGCAGTCCCGGCAGAGTA | GAGGTGTT | AACATT | |
| | | | | GGCGAGATCGTGAGCTCTACACCGCTTCACGATTTGACGAGTTCTTCTTG | TTCTTTGG | GTTTTAA | |
| | | | | AGTCGATCCCCAACGGCAACGCACTCCAAATTTAACGACCGCATGGCGA | TCTGTTGT | TTGTCG | |
| | | | | CGCCACTGATCTCCCAGTCATCCGTGCTCCGAGGGCACTTAAGGGGAAC | TTTATAGT | CGGGGT | |
| | | | | CGATTCACTGATGCTGCAAGTTGGCGGGGGCGCACTCACCAATGGAAG | TTACCGTT | ATCAGT | |
| | | | | ATGAGGGAGCCCAACGATGCCCCGAACTACCGCACCGTCCCCAGCACCG | ATAATAGT | GGCGCC | |
| | | | | TGTCCTTGTGAGTAATTATTTTCACTAATCCAGGGACGGGGCCATGAACT | CTGTTGTC | CCCTTGC | |
| | | | | GAACTATGTCTGCACGCTGCCCCGCCTAGCCTCGGCCACAAATAAATAG | CTATAGTT | GGCCGT | |
| | | | | TCAAGCCGGGGCGTACTACCAATTGATTCGGATTTGGCGGGGCCCATCA | TTCCGTGG | GAAAGC | |
| | | | | CGCGCCTCCGCCCCCACACACAAAAACACTTTTAAACTCTTCGGTTCCCC | TGTATTTC | CCTTTTC | |
| | | | | AACCACTACAACAAAGCGAGCGGCCCCTCTTAGATCCAATTTTAAAATTT | TGGTCTAC | ACCTTAA | |
| | | | | TAAATCAGTGCACTCAACTTTTTTACGTGTTGTGTTTTTTGTATTTTTTCCC | TATAGTTG | TTCGCCC | |
| | | | | ACAGATTTTGTATTTTTATATTATATTTTATATACACAACACTATTTTTATA | GTGCCTCT | CTTAGTC | |
| | | | | CACTACCTTGCACTGTCCCACTTTTTGTAATTATCACCTTTTACCTTTTATG | AAAACATT | CAAATTT | |
| | | | | CCGCTCGCTGAGCTCCTTGCACGGATGACCAGACAAACTTTTATAAAATT | ATTATACC | TTCCCCA | |
| | | | | ATAACATTGTTTTAATTGTCGCGGGGTATCAGTGGCGCCCCCTTGCGGC | GAAGAGT | TTGCCT | |
| | | | | CGTGAAAGCCCTTTTCACCTTAATTCGCCCCTTAGTCCAAATTTTTCCCCA | GCTAGCGA | GTAAAA | |
| | | | | TTGCCTGTAAAAGTGCGTTGCCGTCGACTCGAACTCGTCCTTTTTACCGC | TTTCTATTA | GTGCGT | |
| | | | | CTCTCTGTTACTGAACTATGACCAGCTTGGCTGTTGAAGTCGGCTTTAAT | TTAACTCA | TGCCGT | |
| | | | | TCGCCGGCTTCACATTATATTTTTTTGTTGGGTAATCTGTTTTTTTTCATAT | CCCACCAG | CGACTC | |
| | | | | ATAAAACCATTCGGCTTAAAATCACCAATCCCCATCATCCACCCTGGTCA | TACTGCTG | GAACTC | |
| | | | | CCCATTGAAACATCTCTTTTTAGTCAATTATTTTTTCAGATTACCCCTCCCA | TGCATCCA | GTCCTTT | |
| | | | | AATTGTCATATAGTTTAACACCCCGTTTGCCAAGTTGGTCTTTTCCCCATC | CGCAGCAC | TTACCGC | |
| | | | | CCCTTCTGTCCTTCCGGTAATCCCATAACATTTTATTCTTTAATTCGGCCC | CACGCCTG | CTCTCTG | |
| | | | | CATAAATAGTGTAATCTTAAGACGAAGTCCCCAGAGGCCCGGTCCCCCC | CCATCACG | TTACTGA | |
| | | | | CTTCTTTGTCATGGACCGGGCCAGCCCCCCTGTTACCACAACAACCCACC | TACAGTGC | ACTATG | |
| | | | | ATTTTATTCTTTCTTTCTTTTTATTAGTATTTATTTATATTGCCGCCCAACT | GCTTGCTG | ACCAGC | |
| | | | | GTCGTGTCGTGGCGCAGGGGGGTTCCCTCTGTCGGCCCAGTGGACGAC | CCTTGTGT | TTGGCT | |
| | | | | CGTCTAAAAAACAGGCACAGGCAGCAGGCACTTATCACCCGGTACCTCC | TTTGTTTT | GTTGAA | |
| | | | | GGGTACCGGAGGCTGGTTTTCAGCGCACTGTACGTGATGGCCAATTTTA | GCAGACAC | GTCGGC | |
| | | | | TTCATTGCATTTTATCCGCGTCGTGGTGTTTGCGTGGATGCATTAATAAA | CACTGGAC | TTTAATT | |
| | | | | AGATGAAATTCC (SEQ ID NO: 1084) | GATAG | CGCCGG | |
| | | | | | (SEQ ID | CTTCACA | |
| | | | | | NO: 1207) | TTATATT | |
| | | | | | | TTTTTGT | |
| | | | | | | TGGGTA | |
| | | | | | | ATCTGTT | |
| | | | | | | TTTTTTC | |
| | | | | | | ATATATA | |
| | | | | | | AACCA | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | TTCGGC | |
| | | | | | | TTAAAAT | |
| | | | | | | CACCAA | |
| | | | | | | TCCCCAT | |
| | | | | | | CATCCAC | |
| | | | | | | CCTGGT | |
| | | | | | | CACCCAT | |
| | | | | | | TGAAAC | |
| | | | | | | ATCTCTT | |
| | | | | | | TTTAGTC | |
| | | | | | | AATTATT | |
| | | | | | | TTTTCAG | |
| | | | | | | ATTACCC | |
| | | | | | | CTCCCAA | |
| | | | | | | ATTGTCA | |
| | | | | | | TATAGTT | |
| | | | | | | TAACAC | |
| | | | | | | CCCGTTT | |
| | | | | | | GCCAAG | |
| | | | | | | TTGGTCT | |
| | | | | | | TTTCCCC | |
| | | | | | | ATCCCCT | |
| | | | | | | TCTGTCC | |
| | | | | | | TTCCGG | |
| | | | | | | TAATCCC | |
| | | | | | | ATAACA | |
| | | | | | | TTTTATT | |
| | | | | | | CTTTAAT | |
| | | | | | | TCGGCC | |
| | | | | | | CCATAA | |
| | | | | | | ATAGTG | |
| | | | | | | TAATCTT | |
| | | | | | | AAGACG | |
| | | | | | | AAGTCC | |
| | | | | | | CCAGAG | |
| | | | | | | GCCCGG | |
| | | | | | | TCCCCCC | |
| | | | | | | CTTCTTT | |
| | | | | | | GTCATG | |
| | | | | | | GACCGG | |
| | | | | | | GCCAGC | |
| | | | | | | CCCCCTG | |
| | | | | | | TTACCAC | |
| | | | | | | AACAAC | |
| | | | | | | CCACCAT | |
| | | | | | | TTTATTC | |
| | | | | | | TTTCTTT | |
| | | | | | | CTTTTTA | |
| | | | | | | TTAGTAT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | TTATTTA<br>TATTGCC<br>GCCCAA<br>CTGTCG<br>TGTCGT<br>GGCGCA<br>GGGGGG<br>TTCCCTC<br>TGTCGG<br>CCCAGT<br>GGACGA<br>CCGTCTA<br>AAAAAC<br>AGGCAC<br>AGGCAG<br>CAGGCA<br>CTTATCA<br>CCCGGT<br>ACCTCC<br>GGGTAC<br>CGGAGG<br>CTGGTTT<br>TCAGCG<br>CACTGT<br>ACGTGA<br>TGGCCA<br>ATTTTAT<br>TCATTGC<br>ATTTTAT<br>CCGCGT<br>CGTGGT<br>GTTTGC<br>GTGGAT<br>GCATTA<br>ATAAAA<br>GATGAA<br>ATTCC<br>(SEQ ID<br>NO:<br>1330) | |
| R2 | PERERE-9 | BN000800 | *Schistosoma mansoni* | ATCTCACGTTTTAATTTATTTTTGAACTACTGCAGTCTGAGTGCTTCTAAC<br>GACCCGAAGGCTCAGAAACTACCCACTTCTTGAACTGCTACTTTTTGCTG<br>TTTATCCACAACAACAGTTGTGATTCTATTCTCCANATATTCCTTGTGCTT<br>TTGTCAACATTATTCTATACCAACTGTACCACCTACTTCTTCATCTCACGT<br>TTTAATTCTGGTCTTATTTTCTCATCATTAGTCACGGAGAGGGCCTATGA<br>ACGGTCCGTGACGCGAAATTCTATCCGCGATTTCGACCTCTCCTGCTAGT<br>GGTCCCCGAAGTACGGTTCCTCTGGCCTGTCAGTTGTGTTAAAACTATAT<br>AATAACGATGCCGGTCTCAACCGGCGCAGAAACTGACATAACCTCTTCT | ATCTCACG<br>TTTTAATTT<br>ATTTTTGA<br>ACTACTGC<br>AGTCTGAG<br>TGCTTCTA<br>ACGACCCG<br>AAGGCTCA | TAACGG<br>CTGAAC<br>GAATAG<br>CCCCCTT<br>CACTCTT<br>AGACAT<br>TCCCCCA<br>CTGTTGT | MPVSTGAETDITSSLP<br>IPASSIVSPNYTLPDSS<br>STCLICFAIFPTHNILLS<br>HATAIHHISCPPTPVQ<br>DGSQQMSCVLCAAA<br>FSSNRGLTQHIRHRHI<br>SEYNELIRQRIAVQPT<br>SRIWSPFDDASLLSIA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTGCCTATTCCTGCATCCTCAATCGTCTCGCCAAACTACACACTCCCTGAT | GAAACTAC | TGCTTAT | NHEAHRFPTKNDLC |
| | | | | TCCTCTTCAACCTGCCTTATATGTTTCGCTATCTTCCCCACCCACAACATA | CCACTTCT | CTTCATG | QHISTILTRRTAEAVK |
| | | | | CTCCTCTCCCATGCCACTGCAATCCACCATATTTCTTGTCCTCCTACTCCA | TGAACTGC | CTCTTGT | RRLLHLQWSRSPTAI |
| | | | | GTGCAAGACGGTTCTCAGCAGATGTCTTGTGTTCTTTGCGCCGCCGCTTT | TACTTTTT | GTTAATT | TTSSNNHTITDIPNTE |
| | | | | TTCATCTAACAGGGGACTAACACAACACATTCGCCACCGGCACATCTCC | GCTGTTTA | GACTGC | ARYIFPVDLDEHPPLS |
| | | | | GAATATAACGAACTAATCAGACAACGAATTGCAGTGCAGCCGACGTCTC | TCCACAAC | TCTCTTC | DATTPNASTHPLPELL |
| | | | | GCATATGGTCACCATTCGATGATGCTTCTTTACTATCCATCGCTAACCAT | AACAGTTG | TGGGTT | VILTPLPSPTRLQNISE |
| | | | | GAAGCCCATAGATTCCCCACGAAGAATGACCTATGCCAACATATCAGCA | TGATTCTA | GACGTC | SQTSHESNKNSMHT |
| | | | | CCATACTAACACGCAGGACGGCAGAAGCCGTCAAACGCCGACTCCTCCA | TTCTCCAN | TGATTGT | PPTYACDPDETLGAT |
| | | | | CCTACAGTGGTCGAGATCACCAACAGCGATTACTACCTCTTCGAATAATC | ATATTCCT | CTCTCTC | PSSTIPSCFHSYQDPL |
| | | | | ACACAATCACAGACATCCCCAATACCGAGGCCCGATATATTTTTCCGGTA | TGTGCTTT | TCTTTCC | AEQRGKLLRASASLL |
| | | | | GACCTAGACGAACATCCACCATTGTCTGATGCCACAACCCCCAACGCATC | TGTCAACA | ATATTGC | QSSCTRIRSSSLLAFL |
| | | | | GACACATCCACTCCCAGAACTCCTTGTCATCTTGACACCGCTTCCATCCCC | TTATTCTAT | TTGCTCT | QNESTLMDEEHVSTF |
| | | | | GACTAGACTACAAAACATATCCGAATCACAGACCTCCCATGAATCTAATA | ACCAACTG | GCCCGC | LNSHAEFVFPRTWTP |
| | | | | AGAACTCAATGCATACACCGCCAACGTATGCCTGCGATCCGGATGAGAC | TACCACCT | TTACTTC | SRPKHPSHAPANVSR |
| | | | | ACTAGGGGCTACTCCCTCATCAACTATTCCCTCATGCTTCCACAGTTATCA | ACTTCTTC | CAATAG | KKRRKIEYAHIQRLFH |
| | | | | GGACCCCCTAGCTGAACAAAGAGGCAAACTCCTGAGGGCATCCGCCAG | ATCTCACG | TTGTCAT | HRPKDASNTVLDGR |
| | | | | CCTACTACAAAGCAGTTGTACTCGCATACGGTCCTCCAGCCTGCTCGCCT | TTTTAATTC | ATTATGT | WRNPYVANHSMIPD |
| | | | | TCCTCCAAAACGAATCCACATTAATGGACGAGGAACACGTGTCCACCTT | TGGTCTTA | CTTTGTT | FDCFWTTVFTKTNSP |
| | | | | CCTCAATAGTCATGCAGAATTCGTCTTCCCTAGAACATGGACCCCATCCC | TTTTCTCAT | TACTTGC | DSREITPIIPMTPSLID |
| | | | | GACCCAAACACCCCTCCCACGCCCCAGCTAATGTTTCTAGGAAGAAAAG | CATTAGTC | CATGTCT | PILPSDVTWALKEMH |
| | | | | GAGGAAAATAGAGTACGCACACATCCAGAGACTCTTCCACCACCGTCCC | ACGGAGA | AACGAC | GTAGGIDRLTSYDLM |
| | | | | AAAGATGCCTCCAACACCGTTCTAGACGGTCGGTGGAGAAACCCCTATG | GGGCCTAT | AATTACT | RFGKNGLAGYLNML |
| | | | | TCGCAAACCATTCAATGATTCCAGACTTCGACTGCTTCTGGACAACAGTC | GAACGGTC | TTATCTA | LALAYLPTNLSTARVT |
| | | | | TTTACTAAAACAAATTCCCCAGACAGCCGGGAGATTACTCCAATCATCCC | CGTGACGC | CCTTAGT | FVPKSSSPVSPEDFRP |
| | | | | TATGACTCCCTCTCTCATTGACCCGATCCTCCCCTCTGACGTCACATGGG | GAAATTCT | TTGTCCT | ISVAPVATRCLHKILA |
| | | | | CGCTGAAAGAAATGCATGGCACGGCCGGTGGGATTGATCGTCTGACAT | ATCCGCGA | CTTGGTT | KRWMPLFPQERLQF |
| | | | | CGTACGATCTGATGAGATTCGGGAAGAATGGTCTTGCTGGATATCTCAA | TTTCGACC | TCGATT | AFLNRDGCFEAVNLL |
| | | | | CATGCTACTCGCTCTTGCATACCTTCCCACTAATCTTTCAACAGCACGGG | TCTCCTGC | GCCTTCA | HSVIRHVHTRHTGAS |
| | | | | TAACTTTCGTCCCCAAGTCATCAAGTCCTGTGTCACCTGAGGACTTCCGT | TAGTGGTC | TATGTTC | FALLDISRAFDTVSHD |
| | | | | CCCATCAGTGTCGCTCCAGTAGCCACTAGGTGCCTGCACAAAATTCTAG | CCCGAAGT | ATGGCG | SIIRAAKRYGAPELLC |
| | | | | CTAAGAGATGGATGCCGCTCTTTCCACAGGAACGACTTCAGTTCGCTTTC | ACGGTTCC | GAATCT | RYLNNYYRRSTSCVN |
| | | | | CTAAACCGAGATGGATGCTTTGAAGCAGTTAATCTTCTGCACTCGGTCAT | TCTGGCCT | GATGTTT | RTELHPTCGVKQGDP |
| | | | | ACGGCACGTCCACACCCGCCATACAGGAGCATCCTTCGCCCTGCTCGAC | GTCAGTTG | ATAATG | LSPLLFIMVLDEVLEG |
| | | | | ATATCACGGGCCTTTGACACTGTATCACATGACTCCATCATCAGAGCGG | TGTTAAAA | ACTATTC | LDPMTHLTVDGESLN |
| | | | | CGAAAAGATATGGGGCACCTGAACTGTTATGCCGCTACCTCAATAACTA | CTATATAA | CTATTAC | YIAYADDLVVFAPNA |
| | | | | TTACCGACGTTCAACCAGCTGCGTCAACCGCACTGAATTGCATCCTACGT | TAACG | CACCACT | ELLQRKLDRISILLHEA |
| | | | | GTGGGGTGAAGCAAGGAGACCCCCTGTCGCCACTCCTCTTCATCATGGT | (SEQ ID | ACAACT | GWSVNPEKSRTLDLI |
| | | | | TCTCGACGAAGTACTGGAAGGTCTAGATCCAATGACCCACCTAACAGTT | NO: 1208) | ACTATTA | SGGHSKITALSQTEFT |
| | | | | GATGGAGAGAGCTTGAACTACATAGCTTATGCTGACGATCTCGTAGTTT | | TTATTTT | IAGMRIPPLSAADTF |
| | | | | TCGCTCCAAATGCGGAACTCCTTCAACGGAAACTCGATCGGATCTCCAT | | CATTACT | DYLGIKFNFKGRCPV |
| | | | | ACTTCTACACGAGGCTGGATGGTCGGTTAACCCTGAAAAAGCCGGACC | | ATTAAC | AHIDLLNNYLTEISCA |
| | | | | CTGGACCTAATCTCTGGTGGCCATTCCAAAATCACAGCGCTCTCTCAGAC | | ATTATTA | PLKPQQRMKILKDNL |
| | | | | AGAATTCACCATCGCGGGGATGCGTATACCACCGCTTTCTGCCGCCGAC | | TAAACA | LPRLLYPLTLGIVHLKT |
| | | | | ACCTTCGACTACCTGGGTATCAAATTCAACTTCAAGGGCCGATGCCCAG | | TTATTAC | LKSMDRNIHTAIRKW |
| | | | | TGGCCCATATTGACTTATTGAACAACTACCTCACGGAAATATCGTGCGCT | | TATTATT | LRLPSDTPLAYFHSPV |
| | | | | CCACTTAAGCCGCAGCAGCGCATGAAGATCTTGAAAGATAATCTACTCC | | ATTATTA | AAGGLGILHLSSSVPF |
| | | | | CTCGACTCCTATACCCCCTGACTCTAGGAATAGTACACCTGAAAACCCTG | | CTATTAT | HRRKRLETLLSSPNRL |
| | | | | AAGTCAATGGACCGAAATATCCACACGGCCATAAGGAAATGGTTGCGG | | TACTTCT | LHKLPTSPTLASYSHL |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTACCCTCCGACACCCCGCTAGCATATTTTCACTCACCCGTCGCTGCCGG | | ACAATT | SQLPVRIGHETVTSRE |
| | | | | AGGCCTAGGGATCCTCCATCTGTCCTCATCGGTTCCATTCCACCGTCGAA | | AATATTA | EASNSWVRRLHSSCD |
| | | | | AACGTCTAGAAACCCTCCTATCTTCACCGAACCGCCTACTGCACAAGTTG | | TGGCTA | GKGLLLAPLSTESHA |
| | | | | CCAACTTCCCCAACACTAGCTTCTTATTCACACCTTAGTCAACTGCCAGTT | | CTCCTCT | WLRYPQSIFPSVYINA |
| | | | | CGAATTGGGCACGAGACCGTAACGTCTAGAGAAGAGGCTTCCAACAGC | | CAGCAC | VKLRGGLLSTKVRRSR |
| | | | | TGGGTGAGACGATTACATTCGTCCTGCGACGGGAAGGGACTACTCCTA | | ACCAAT | GGRVTNGLNCRGGC |
| | | | | GCACCACTAAGCACCGAGTCCCATGCATGGCTGCGCTACCCCCAGTCTA | | AAAATA | AHHETIHHILQHCALT |
| | | | | TTTTTCCATCTGTTTACATCAACGCCGTTAAATTACGAGGTGGCTTACTAT | | TCAATCA | HDIRCKRHNELCNLV |
| | | | | CCACCAAAGTCAGGAGATCTCGCGGAGGTAGAGTGACGAATGGCCTGA | | AACATCT | AKKLRRQKIHFLQEPC |
| | | | | ACTGTCGAGGCGGTTGCGCCCATCATGAAACGATCCACCACATTCTGCA | | CAATTAT | IPLEKTYCKPDFIIIRDS |
| | | | | ACATTGCGCGCTCACCCACGACATCAGATGCAAACGCCATAACGAACTA | | ATCCACC | IAYVLDVTVSDDGNT |
| | | | | TGCAACCTTGTGGCAAAGAAACTGCGTAGGCAAAAAATCCATTTCTTAC | | TATTAAA | HASRLLKISKYGNERT |
| | | | | AGGAGCCCTGCATTCCTCTAGAAAAAACCTACTGCAAACCTGATTTTATA | | CTCTCTC | VASIKRFLTSSGYIITS |
| | | | | ATTATACGTGACTCAATTGCTTATGTTCTAGACGTCACTGTATCGGACGA | | TATTTCC | VRQTPVVLTFRGILDR |
| | | | | CGGAAACACCCACGCCAGCCGCCTGTTAAAAATATCAAAATACGGCAAT | | CCTGAG | ASSQSLRRLCFSSRDL |
| | | | | GAGCGAACCGTCGCGTCGATCAAGCGTTTCCTCACATCCAGTGGATATA | | TTATAAA | GDLCLSAIQGSIKIYN |
| | | | | TCATTACCAGTGTTCGACAAACACCAGTCGTCCTTACATTCAGAGGTATT | | CTTACAA | TYMRGT (SEQ ID |
| | | | | CTGGATAGAGCAAGTTCACAATCCCTACGACGCCTATGTTTTTCATCCCG | | TTCAGTC | NO: 1453) |
| | | | | TGACCTCGGTGACCTTTGCCTGAGTGCGATTCAAGGCTCAATTAAAATAT | | TAACCG | |
| | | | | ATAATACCTATATGAGAGGAACCTAACGGCTGAACGAATAGCCCCCTTC | | AATATCT | |
| | | | | ACTCTTAGACATTCCCCCACTGTTGTTGCTTATCTTCATGCTCTTGTGTTA | | CTCTTTT | |
| | | | | ATTGACTGCTCTCTTCTGGGTTGACGTCTGATTGTCTCTCTCTCTTTCCAT | | ACAAAT | |
| | | | | ATTGCTTGCTCTGCCCGCTTACTTCCAATAGTTGTCATATTATGTCTTTGT | | CTTAAGT | |
| | | | | TTACTTGCCATGTCTAACGACAATTACTTTATCTACCTTAGTTTGTCCTCTT | | ATGTAA | |
| | | | | GGTTTCGATTGCCTTCATATGTTCATGGCGGAATCTGATGTTTATAATGA | | TTTTGTG | |
| | | | | CTATTCCTATTACCACCACTACAACTACTATTATTATTTTCATTACTATTAA | | CCAAAC | |
| | | | | CATTATTATAAACATTATTACTATTATTATTATTACTATTATTACTTCTACA | | CCATTTG | |
| | | | | ATTAATATTATGGCTACTCCTCTCAGCACACCAATAAAATATCAATCAAA | | GGTCTG | |
| | | | | CATCTCAATTATATCCACCTATTAAACTCTCTCTATTTCCCCTGAGTTATA | | TACAATT | |
| | | | | AACTTACAATTCAGTCTAACCGAATATCTCTCTTTTACAAATCTTAAGTAT | | TGATACT | |
| | | | | GTAATTTTGTGCCAAACCCATTTGGGTCTGTACAATTTGATACTTAAAAA | | TAAAAA | |
| | | | | TAAATGTTATTAGCC (SEQ ID NO: 1085) | | TAAATG | |
| | | | | | | TTATTAG | |
| | | | | | | CC (SEQ | |
| | | | | | | ID NO: | |
| | | | | | | 1331) | |
| R2 | R2- | — | *Bombus* | TCAATAGTTACTCGGGGGCAGGCGGGATATTGGTCTTGCCTTGCCCAAG | TCAATAGT | TGAAAA | IAKFDNNTNSASDAA |
| | 1_BTe | | *terrestris* | TCACACTCCTACCTCCTCGTGGTACCGCCGGTAACACGCGCACGTCCACA | TACTCGGG | CACGAT | PLSPGGAVADLSASE |
| | | | | TCAGCGAGGGGCGTACTCCCCCGGATGTGGCGGCGCGTGGCTAAACGG | GGCAGGC | AACGAT | GTTDNDQAMSPAM |
| | | | | AGTGTGGCGACGAAGGAGCGAAAGACTAACAACTATAACGGTCTTCCG | GGGATATT | TATGAA | SLXTVPLVGNRVACP |
| | | | | TAACGGCTACTTGGAGCCGTGAATAATGGAGCCTATATTAAACCCTGGA | GGTCTTGC | TCAAAA | XCEKREANLFFLNLSD |
| | | | | ACTCGTTCCTTCGTTCTGTTGACGACTGGAACGGCAAAGGACATGATTT | CTTGCCCA | TAAGAA | LDRHLTQHHPDAPIX |
| | | | | GGATAACAATTGGAAACTTAATATCGAATTCACAATTAAATTGCAAAATT | AGTCACAC | AGTAAA | WSCIDCAKCFPKLHG |
| | | | | CGATAATAATACGAATAGTGCCTCGGACGCAGCGCCTCTCAGTCCCGGA | TCCTACCT | CATCCCA | ARCHIPKCGGASSQA |
| | | | | GGCGCTGTGGCGGATTTATCCGCTTCAGAGGGGACTACGGATAACGAC | CCTCGTGG | GAAATT | RTGEFQCEACPMSF |
| | | | | CAGGCTATGTCCCCGGCTATGAGTTTGATNACGGTGCCGCTCGTGGGCA | TACCGCCG | GTCTAC | GSRRGLSTHERHAHP |
| | | | | ATCGGGTCGCCTGTCCAGNATGTGAGAAAAGGGAGGCTAACCTTTTCTT | GTAACACG | GTCTTAT | AVRNIKRRGADPPEE |
| | | | | CTTAAATCTGTCGGACCTGGACAGGCACCTAACACAACACCACCCGGAT | CGCACGTC | TTGTTAT | NTKSWKVEXVARLK |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCCCCGATCTNTTGGTCNTGTATCGACTGCGCGAAATGCTTCCCGAAGC | CACATCAG | CTATTTA | GLWEIFKDHKYPNKE |
| | | | | TTCATGGGGCTAGATGCCACATACCTAAGTGTGGTGGCGCTAGCAGCCA | CGAGGGG | TTTGTTT | ISKFLTTKTVDXXKYQ |
| | | | | GGCCAGGACAGGNGAGTTCCAGTGCGAGGCCTGTCCCATGAGCTTCGG | CGTACTCC | A (SEQ | RKKLNLIGXESPQEAT |
| | | | | GTCGCGCAGAGGGCTATCCACCCACGAACGGCATGCGCACCCTGCCGTC | CCCGGATG | ID NO: | SLATEGGCDLVSSGN |
| | | | | AGAAATATTAAAAGAAGGGGAGCGGACCCCCCAGAAGAAAATACAAAA | TGGCGGC | 1332) | ASFGSPVGRNENEEE |
| | | | | TCTTGGAAAGTAGAANNGGTAGCACGCTTGAAGGGGCTATGGGAAATA | GCGTGGCT | | LIHEWKLSLKNEINKP |
| | | | | TTCAAAGACCATAAATATCCCAACAAAGAAATCAGCAAATTCCTCACCAC | AAACGGA | | TEVPPILKEVYNRLML |
| | | | | NAAAACGGTNGATCANATNAAATATCAAAGAAAAAAGCTAAACTTAAT | GTGTGGC | | IWEEHQDDRDSLTES |
| | | | | TGGTGNGGAAAGCCCCCAAGAGGCTACCTCACTGGCAACAGAGGGAG | GACGAAG | | LDHFIRTALYELINKIN |
| | | | | GGTGCGATCTCGTTAGTTCAGGCAATGCCAGTTTTGGCTCGCCTGTAGG | GAGCGAA | | KNQTDLKTKRAAKTK |
| | | | | CCGCAACGAGAACGAAGAAGAGCTCATCCACGAATGGAAGCTCTCGCT | AGACTAAC | | SPKNNRNSRKRFSYA |
| | | | | AAAAAACGAAATAAATAAGCCAACCGAGGTGCCCCCTATTTTAAAGGAG | AACTATAA | | RCQELFHECPRRLAD |
| | | | | GTTTACAATCGGCTGATGTTAATCTGGGAAGAGCACCAAGATGATCGAG | CGGTCTTC | | AVVNNDQAYLEPAR |
| | | | | ACTCTCTAACGGAGAGTCTCGATCACTTTATACGCACAGCTCTATACGAG | CGTAACGG | | QPPGSEEVRGLYEKL |
| | | | | CTTATAAACAAAATAAATAAAAACCAAACGGATTTAAAAACTAAAAGAG | CTACTTGG | | WGQVGSTYVPAPVT |
| | | | | CAGCTAAAACAAAAAGCCCAAAAAATAATAGAAACTCCAGGAAGCGAT | AGCCGTGA | | RVPKLSLSEIFPPIAAE |
| | | | | TCTCATACGCTCGTTGCCAGGAGTTATTTCACGAATGCCCAAGGAGACT | ATAATGGA | | DVGERIGKIRKKAAA |
| | | | | GGCTGATGCCGTGGTCAATAACGATCAGGCATATCTCGAACCAGCCAG | GCCTATAT | | GPDGLQRDHLTIPGL |
| | | | | GCAACCTCCCGGATCAGAGGAAGTGAGGGGGCTCTACGAAAAGCTGTG | TAAACCCT | | PIIMAKIYNILVYCSYF |
| | | | | GGGACAAGTGGGTTCCACGTACGTCCCGGCTCCAGTTACGAGAGTCCCC | GGAACTCG | | PSAWKENRTTLIPKIN |
| | | | | AAACTATCCCTATCCGAGATCTTCCCGCCGATAGCGGCTGAGGATGTGG | TTCCTTCG | | KPCSLVENWRPITISP |
| | | | | GGGAGAGAATCGGCAAAATAAGAAAGAAAGCTGCGGCAGGACCGGAT | TTCTGTTG | | ILGRIFSSIIDGRIRRGT |
| | | | | GGATTACAAAGAGATCACCTAACTATCCCCGGCCTGCCTATCATAATGG | ACGACTGG | | VLNMRQKGFTSENG |
| | | | | CGAAAATCTATAATATACTCGTATATTGTTCTTATTTTCCCTCCGCATGGA | AACGGCAA | | CKINIELLNSALNYSKR |
| | | | | AGGAGAATAGAACAACTCTTATTCCAAAAATAAATAAGCCATGCAGCCT | AGGACATG | | NSGGIFTIVDISKVFD |
| | | | | GGTCGAGAACTGGCGACCAATTACTATTAGTCCGATTCTAGGCCGAATC | ATTTGGAT | | TVPHAALKPCLAKKG |
| | | | | TTCTCCTCCATTATCGACGGGAGGATAAGAAGAGGCACTGTATTAAATA | AACAATTG | | VPALIVDLIDEMYKN |
| | | | | TGAGGCAGAAGGGCTTTACATCTGAAAACGGATGTAAAATTAACATCGA | GAAACTTA | | VKTTIKTKDGGVEIMI |
| | | | | ATTATTAAATTCTGCCTTAAACTATAGTAAAAGAAATAGCGGCGGGATA | ATATCGAA | | RRGVKQGDPLSPLLF |
| | | | | TTCACTATCGTGGATATCTCGAAAGTTTTTGATACAGTGCCTCATGCAGC | TTCACAAT | | NLCLEPLLEEIEEQAS |
| | | | | CTTAAAACCTTGTCTGGCAAAAAAGGGTGTGCCCGCCCTTATCGTCGATT | TAA (SEQ | | GINVSEHRKVSVLAF |
| | | | | TGATCGACGAAATGTATAAAAACGTAAAAACTACTATAAAAACTAAAGA | ID NO: | | ADDIVLLGADAREAQ |
| | | | | TGGCGGGGTCGAGATTATGATCCGCCGAGGAGTTAAGCAAGGCGACCC | 1209) | | HQINVLTDYLQSLM |
| | | | | CCTATCGCCCTTACTCTTCAATTTATGCTTGGAGCCACTGCTGGAAGAGA | | | MNLSIEKCQTFEVVA |
| | | | | TCGAGGAGCAAGCCAGTGGAATAAATGTTAGCGAACATCGTAAAGTAT | | | KKDTWFIKEPGLKIG |
| | | | | CAGTTCTGGCCTTCGCAGACGATATCGTTCTACTTGGAGCGGACGCGAG | | | NQIMPTVDPDEAFKY |
| | | | | GGAAGCGCAACACCAAATAAACGTACTTACCGACTACCTGCAAAGCCTC | | | LGAKIGPWKGVHCG |
| | | | | ATGATGAATCTATCAATTGAAAAATGCCAAACCTTCGAGGTTGTGGCCA | | | VIVPELLSVVKRVRKL |
| | | | | AAAAGGATACCTGGTTCATTAAGGAACCTGGACTTAAAATCGGGAATCA | | | SLKPGQKVELLTKYIF |
| | | | | AATAATGCCTACTGTAGATCCCGACGAGGCTTTCAAATACCTGGGCGCC | | | PRYIYHLLVSPPSDTV |
| | | | | AAAATTGGTCCCTGGAAAGGCGTTCATTGTGGTGTAATTGTTCCAGAAC | | | LKLLDSEVRQEVKTIL |
| | | | | TTCTGAGCGTGGTGAAAAGGGTGAGGAAACTCTCCCTCAAGCCGGGCC | | | HLVPSTATGFFYTPKA |
| | | | | AGAAGGTGGAACTTCTAACTAAATACATCTTCCCCCGCTACATTTACCAT | | | CGGIGIPRFEHIIKLGT |
| | | | | CTACTTGTAAGTCCGCCAAGCGATACCGTCCTTAAACTACTAGACAGCG | | | LKSAIKIANSIDPAVA |
| | | | | AGGTCAGACAAGAAGTTAAAACTATCTTACATCTTGTGCCTTCCACTGCC | | | GLIDDAAIKKLKQTA |
| | | | | ACAGGCTTCTTTTACACTCCAAAGGCCTGTGGAGGAATAGGAATACCGA | | | NSLRINWPASLEDIEK |
| | | | | GGTTTGAACATATAATCAAACTCGGTACCCTTAAAAGTGCAATAAAAAT | | | ARKRLRKEHISQWAD |
| | | | | CGCAAACTCGATCGATCCAGCGGTCGCTGGCCTAATCGATGATGCAGCC | | | LKCQGQGVPDFIKNK |
| | | | | ATAAAAAAGTTAAAGCAAACGGCCAACTCCTTGCGGATCAATTGGCCAG | | | TGNLWLEDHSLLKPS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCTCCTTGGAGGATATTGAAAAAGCTCGTAAACGTCTAAGGAAAGAGCA | | | RLIDALRLRTNTFGTR |
| | | | | TATCAGCCAATGGGCTGATTTAAAATGCCAGGGACAAGGCGTTCCTGAT | | | SVLARADKNIDVTCR |
| | | | | TTTATCAAAAATAAAACTGGCAACCTGTGGCTTGAGGACCATAGTCTAC | | | RCRAQPETLGHILGLC |
| | | | | TCAAGCCATCGAGACTCATCGATGCCCTTCGATTAAGAACAAATACCTTT | | | QHTKGLRIKRHDEVK |
| | | | | GGTACAAGATCGGTGCTGGCACGGGCCGACAAAAATATTGATGTAACA | | | SLLEGRLKSKKNNEVF |
| | | | | TGTCGAAGATGTCGTGCCCAGCCCGAGACCCTTGGACACATACTCGGGC | | | VEPTIKAGGSLFKPDL |
| | | | | TATGTCAGCACACTAAAGGCTTAAGAATCAAAAGGCACGATGAGGTTAA | | | VIKNGERVLVVDVTV |
| | | | | ATCCCTCCTCGAAGGAAGATTAAAAAGTAAAAAGAACAACGAAGTATTT | | | RYENKNYLALAEKEKI |
| | | | | GTAGAGCCGACGATTAAGGCCGGAGGCAGTTTATTTAAACCAGACCTC | | | EKYRPCLRALKEIFNA |
| | | | | GTAATTAAAAACGGGGAAAGGGTTCTCGTGGTCGACGTAACTGTCCGCT | | | KGGEILPVVLGSRGTI |
| | | | | ACGAGAACAAAAACTACCTGGCCTTAGCCGAAAAAGAAAAGATAGAGA | | | TPNTEKVLKRLGIAN |
| | | | | AGTATCGGCCATGCCTAAGGGCATTAAAAGAAATATTTAACGCCAAAGG | | | NDIKTILLNVLRSSIEL |
| | | | | AGGAGAGATTCTTCCGGTGGTCTTGGGTAGTAGAGGCACTATCACGCCT | | | CNIFIDD (SEQ ID |
| | | | | AACACCGAGAAAGTCCTCAAGCGATTGGGAATCGCTAACAATGATATAA | | | NO: 1454) |
| | | | | AGACAATACTCTTAAATGTATTAAGAAGCTCGATAGAGCTGTGTAATAT | | | |
| | | | | ATTCATTGATGACTGAAAACACGATAACGATTATGAATCAAAATAAGAA | | | |
| | | | | AGTAAACATCCCAGAAATTGTCTACGTCTTATTTGTTATCTATTTATTTGT | | | |
| | | | | TTA (SEQ ID NO: 1086) | | | |
| R2 | R2-1_Crp | — | *Crocodylus porosus* | AGGCGTCTCCTTTAAGGGCAACGGTCTGGTTACGCGGTCGCAGCAGKCT | AGGCGTCT | TGAATC | VPPGAEARGRYHHP |
| | | | | TGCKCCAGGTACCTCCWCGTGGTTCCCGCCGGGTGCCGMAGMCCCAG | CCTTTAAG | CCACTCT | RXEXARQGEPPSXRV |
| | | | | GSCTGTCGGTAGCTCGATCCTGGCACAGTAMGGCCAGGGGAGTKCTTC | GGCAACG | GGGGAC | FLVXLPDSNPPCPICG |
| | | | | CTTGCTGCWGGTGCCCCACAAGCGTKTGGCAGSMCMCCTGCTTCWTC | GTCTGGTT | CCCCAA | DHVXXXSVLALHCVE |
| | | | | GCAAMAATMASAGKGTSMTCAGTAGTCGGCCCCGCCGCTAGCCAAAA | ACGCGGTC | AAATTA | GHXWAXVQYQCTH |
| | | | | CTGTTCGCCACSCAGTTACAGATGGTGCCTGTGCTGACCKGKKGCCCCGT | GCAGCAGK | GAAAAA | CGILCHIPRCQGRVXE |
| | | | | GGGCTCGGWGGTGCAGGGGWGGCCGGCCCATGGCTGGGCCAGACST | CTTGCKCC | CCCAAA | XTGKDXXCPECPASF |
| | | | | GGGCCKTGGAGCCCGCTCCCAMCCCAGAGTTCCCCCTCAAMGCCGCCA | AGGTACCT | ACAGTT | DEKAGLSQHKRHTVT |
| | | | | GGKCAGMAMCAKCCGGGGAGKGMCACGGCCCCGGCCGTGAGTCCCC | CCWCGTG | GTGTTTA | XSXERVAGXLLRAXLR |
| | | | | CCCGGTGCWGAGGCCCGGGGCCGATACCACCACCCCCGGTGMGAGM | GTTCCCGC | AGTGTG | HGCWSVEEEETLTRL |
| | | | | GCGCCCGCCAGGGTGAACCACCCTCCAMCAGGGTTTTCCTGGTGASGCT | CGGGTGCC | TTCTTGT | DAMFXGARNINQLIA |
| | | | | GCCTGACTCAAACCCKCCGTGCCCGATTTGCGGGGACCACGTGSGTWA | GMAGMCC | TTGTCCC | AEXVSKMXKQISDK |
| | | | | ACWCTCCGTGCTGGCCCTCCACTGCGTGGAGGGCCACGWGTGGGCGS | CAGGSCTG | TTTGGCT | WRXLXLXPEQTTXGG |
| | | | | ATGTGCAGTACCAGTGCACCCATTGTGGCATCCTCTGCCACATCCCACGT | TCGGTAGC | TCACCTC | XAESASVVXXESMTP |
| | | | | TGCCAGGGGAGGGTGCMKGAGCWGACCGGGAAGGACTKGGMTTGTC | TCGATCCT | CAAGTT | EMEAQSPAXPPGKIR |
| | | | | CTGAGTGCCCTGCCTCCTTCGATGAGAAAGCWGGCCTATCGCAGCACA | GGCACAGT | GCGATC | KIFTGQDGHAGGXA |
| | | | | AGCGGCACACGGTAACACAMAGTGWKGAACGGGTTGCAGGKWACCT | AMGGCCA | CCCCATC | WENQEDFHWTRWA |
| | | | | GTTGAGGGCTKGTTTAAGGCACGGGTGCTGGTCGGTGGAAGAAGAGG | GGGGAGT | TCCCCTG | RRWLKRGQXLSDKV |
| | | | | AAACTCTCACCCGCCTWGACGCGATGTTCCSTGGCGCCCGGAACATCAA | KCTTCCTT | CGCTGT | QEVLGXWVEGQPRI |
| | | | | CCAGCTGATCGCTGCTGAGMTGGTWTCGAAGATGCSTAAGCAGATCAG | GCTGCWG | CTTTCTG | XAWVDXVSLDVLTLF |
| | | | | CGACAAATGGAGGTWGCTCKSTCTGWGTCCTGAGCAGACCACATWGG | GTGCCCCA | AATGAC | LGVPPGPQRAPSKKG |
| | | | | GTGGTGAKGCTGAGTCKGCCTCCGTGGTGSAGGWWGAGTCCATGACT | CAAGCGTK | CAGTGG | PXEGGKPTSWMNKR |
| | | | | CCGGAGATGGAAGCCCAAAGCCCAGCTGAMCCGCCTGGGAAAATCAG | TGGCAGS | TGTTGA | AIKWGTFLRYQHLFG |
| | | | | GAAGATTTTCACTGGACAAGATGGGCACGCCGGTGGCTGAAGAGGGG | MCMCCTG | GGCTGG | ANRKLLAAXILDGAX |
| | | | | GCAGGKTCTGTCAGACAAGGTGCAAGAAGTCCTGGGCKCGTGGGTGGA | CTTCWTCG | TGTGAC | RNQXTLLLEEVXQXY |
| | | | | GGGTCAACCCAGGATTCMTGCCTGGGTCGACKCMGTCTCCCTTGATGT | CAAMAAT | CTCGGT | XGKWEAEPPFEGLG |
| | | | | TTTGACTTTGTTCTTGGGGGTGCCCCCGGGACCGCAGAGGGCTCCGAGC | MASAGKG | CACCTCC | RFGXXRDVDSFAFEA |
| | | | | AAGAAGGGGCCCAMGGAGGGTGGCAAACCWACGTCCTGGATGAACA | TSMTCAGT | AAGGCC | LITXEEAVKHMMXM |
| | | | | AACGTGCCATCAAATGGGGCACATTCCTTCGGTACCAGCACCTGTTTGG | AGTCGGCC | AAGTGC | AXXSAPGPDKLTLRD |
| | | | | TGCCAACAGGAAGCTCCTGGCGGCCMTCATCCTGGATGGTGCTGASCG | CCGCCGCT | CCTGGC | LRRADPEGDALAELF |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TAATCAGTGSACCCTCCTGCTWGAGGAGGTCTTKCAGGMCTACCKAGG | AGCCAAAA | CCCGAG | SLWXITGVVPDRLKE |
| | | | | AAAGTGGGAGGCCGAGCCGCCTTTCGAGGGTCTTGGACGGTTTGGGST | CTGTTCGC | TAGGAC | XQXVLIPKAVDFEKLR |
| | | | | CCAMMGGGATGTGGATAGCTTCGCATTCGAGGCCCTGATCACTCKGGA | CACSCAGT | CAGGTG | QLGNWRPITIXSIVLQ |
| | | | | GGAGGCTGTCAAGCACATGATGGMAATGGCCWMSAAMTCGGCTCCA | TACAGATG | GCCCAG | LXSRVLTARLTAACPI |
| | | | | GGTCCGGATAAGCTCACCCTGAGAGATCTGCGCCGCGCKGACCCCGAG | GTGCCTGT | CTTGCT | XPHQQGFISAPXCAE |
| | | | | GGAGATGCTCTTGCCGAACTGTTCAGCCTGTGGMTGATCACTGGCGTG | GCTGACCK | GGGCAC | NLKXPELIXRKVKXDR |
| | | | | GTCCCGGACAGACTCAAGGAGTKTCAGTSTGTGCTGATACCAAAGGCAG | GKKGCCCC | CCGTCA | RPLGVAFVDXARAFD |
| | | | | TGGACTTTGAGAAGCTGAGGCAGCTGGGCAACTGGCGCCCCATCACTAT | GTGGGCTC | CCGCCC | SVSHDXISWVLKAKG |
| | | | | CGSGTCCATTGTKTTGCAGCTATTMTCACGGGTGCTGACCGCACGGCTC | GGWGGTG | AGGGCA | VDQHIVNLIEDSYQK |
| | | | | ACCGCAGCWTGCCCCATAASCCCCCACCAGCAGGGKTTCATMTCGGCA | CAGGGGW | AATGGA | VTMRVQVFSGSTPPI |
| | | | | CCKKGGTGTGCCGAAAACCTGAAGMTGCCTGAGCTCATCTTSCGSAAGG | GGCCGGCC | AGGGAT | SIKXGVKQGDPMSPL |
| | | | | TGAAGCAMGACAGGCGGCCGCTGGGGGTGGCATTCGTGGATMTAGCS | CATGGCTG | CTATCCT | LFNIAMDPLIXKLKTV |
| | | | | AGGGCSTTCGACTCGGTATCGCACGACMACATTTCWTGGGTCCTAAAG | GGCCAGAC | GACCAC | RQGVKVGSASLTTLA |
| | | | | GCCAAAGGGGTGGACCAACACATCGTGAATCTCATWGAAGATTCATAC | STGGGCCK | TACCAG | FADGLXLLXDSWEG |
| | | | | CAGAAGGTTACCATGAGAGTACAAGTGTTCAGTGGTTCCACCCCWCCC | TGGAGCCC | GCTAAG | MQHNITTSXTPGRAC |
| | | | | ATCAGCATCAAAWCCGGGGTCAAGCAAGGCGACCCGATGTCMCCCCTS | GCTCCCA | TGTGGT | NTTSRHPRGLLQPHG |
| | | | | TTGTTCAACATTGCGATGGACCCCCTGATAGSCAAGCTCAAGACAGTCA | MCCCAGA | GCTGCC | PTSATXKMXGVLLES |
| | | | | GGCAGGGAGTGAAAGTCGGGAGTGCTTCCCTGACCACCCTGGCATTTG | GTTCCCCC | TAGCCT | XMRLLYGEQLRGLED |
| | | | | CGGATGGCCTCGWMCTGCTGAKTGACTCCTGGGAGGGCATGCAACAC | TCAAMGC | GCCGTA | XRPXXHDAXARRAD |
| | | | | AACATCACGACATCCTAGAGGACTTCTGCAACCTCACGGGCCTACGAGT | CGCCAGGK | AGGTCA | TISGLEXRSLGWDXQ |
| | | | | GCAACCCAMAAAATGKCAGGGGTTCTTCTTGAATCCGAMATGCGACTC | CAGMAMC | AGCGCC | TRFGYATXLLAREDG |
| | | | | CTWTACGGTGAACAACTGCGMGGCCTGGAAGATWGCCGGCCGTGMS | AKCCGGG | CTGCTG | DCXAQTNAEALCWX |
| | | | | ATCACGATGCTSGGGCCAGGCGAGCCGACACGATATCTGGGCTTGAAK | GAGKGMC | CCGCTC | SXPFPGCAXRPXYAN |
| | | | | GTCGGTCCCTGGGTTGGGATWGGCAAACCAGATTTGGGTACGCAACTA | ACGGCCCC | GGGTAK | XGWVASEALDSMSR |
| | | | | AKCTCCTGGCTCGAGAGGATGGGGACTGCCWCGCTCAAACCAATGCAG | GGCCGTGA | CAGTCCT | RXVKEWFHLPACTDX |
| | | | | AAGCTCTTTGCTGGTSCAGTATKCCATTCCCAGGCTGCGCTMTCAGGCC | (SEQ ID | CGTTCAC | LLXSRHRDGGLGLLRL |
| | | | | GWTTTATGCGAACMCCGGTTGGGTGGCCTCGGAGGCTCTGGATTCCAT | NO: 1210) | TCGTCCC | ARXXLAAXVRRPIRV |
| | | | | GAGCCGAAGAAAKGTGAAGGAGTGGTTCCACCTACCCGCCTGTACCGA | | TCCTAGT | ATSSDEVTRKVSYAC |
| | | | | CKGCCTCCTCCASTCCCGCCACCGGGATGGGGGCCTKGGGTTGCTGCGC | | ACCCTCC | GISDEVERLXLAXGG |
| | | | | CTGGCGAGAGMCWTTCTGGCAGCGSAAGTGAGGAGGCCGATTCGTGT | | GCMTCT | DXSNVPRFEDPXAPK |
| | | | | AGCCACCTCATCTGATGAAGTCACGCGGAAAGTATCCTACGCATGTGGG | | GCGCTT | SXXVQGPHEAAQET |
| | | | | ATAAGTGATGAAGTGGAGCGKCTCTGKTTGGCMAGWGGGGGAGACAT | | CTGCTAT | PRVVRTQAIPWPSN |
| | | | | STCCAATGTCCCGAGGTTCGAGGATCCTGAWGCCCCGAAGTCTSCAKGG | | CCACTGT | WRAEEHSKWAQLSC |
| | | | | GTGCAGGGCCCCCATGAGGCTGCCCAGGAGACACCACGTGTTGTCCGG | | GGCCGG | QGERVELFCNDPVSN |
| | | | | ACACAGGCGATCCCCTGGCCCTCCAACTGGAGAGCCGAGGAACACTCCA | | WGATGC | GWINSRGQLAERLW |
| | | | | AATGGGCCCAACTCAGCTGTCAGGGAGAGAGGGTGGAGTTATTCTGCA | | CGAGG | IMALKLRSNIYPTREF |
| | | | | ATGATCCAGTCAGCAATGGCTGGATCAACAGTCGGGGACAACTGGCGG | | WTGSW | LGRGQAGTNIGCRH |
| | | | | AACGCCTCTGGATCATGGCCTTAAAACTGCGTTCGAACATTTATCCCACC | | MCAWC | CTHPRETLGHILGICP |
| | | | | AGGGAGTTTCTTGGGAGAGGCCAGGCAGGTACCAACATAGGTTGCCGG | | CTCGAC | AMQEARILRHNKLCK |
| | | | | CACTGTACACACCCTCGTGAAACATTAGGGCATATCCTGGGCATATGTC | | ACCTCCA | ILAAEGKNCEWTVYY |
| | | | | CTGCCATGCAGGAGGCACGGATCCTCCGGCACAACAAGCTGTGCAAGA | | GGGCCA | EPHLHNAAGELRKPD |
| | | | | TCCTGGCAGCTGAGGGCAAAAACTGTGAGTGGACAGTGTATTATGAGC | | AGCGCC | LIFVRDGTALVVDITV |
| | | | | CGCACCTACATAACGCAGCTGGGGAACTGCGTAAACCTGACCTCATTTT | | TTGGCC | WYEGGPATLLSTTAE |
| | | | | TGTCCGAGACGGTACCGCTCTGGTTGTGGATATCACTGTGTGGTATGAA | | MCAGGT | KATKYLDLNTQIQELT |
| | | | | GGGGGCCCCGCAACCCTCCTGTCCACCACTGCAGAAAAGGCCACAAAAT | | AGGACC | GAEQVTYFGFPIGAR |
| | | | | ACCTGGATCTGAACACACAGATCCAGGAGCTCACAGGGGCTGAGCAGG | | TGGCAC | GKWHADNWRVLSEL |
| | | | | TCACCTACTTTGGCTTCCCTATAGGAGCCAGGGGAAAGTGGCATGCTGA | | CTGCCC | GLSNSRKERVTRLLS |
| | | | | CAATTGGCGAGTACTGTCTGAACTGGGATTGTCCAACTCCCGGAAGGAG | | AGGGGG | WRALLGSVDMVNIF |
| | | | | CGGGTCACACGGCTCCTGTCGTGGCGAGCACTGCTCGGGTCAGTGGAC | | CCAGAC | VSKHRQENLLDEHCT |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATGGTGAACATCTTTGTATCTAAACACAGGCAGGAAAACCTATTGGATG<br>AGCACTGCACCCCAGCTGAGCAAGTIGTGAGTTCTTATGCGAGTTGAAT<br>CCCACTCTGGGGACCCCCAAAAATTAGAAAAACCCAAAACAGTTGTGTT<br>TAAGTGTGTTCTTGTTTGTCCCTTTGGCTTCACCTCCAAGTTGCGATCCCC<br>CATCTCCCCTGCGCTGTCTTTCTGAATGACCAGTGGTGTTGAGGCTGGTG<br>TGACCTCGGTCACCTCCAAGGCCAAGTGCCCTGGCCCCGAGTAGGACCA<br>GGTGGCCCAGCTTGCTGGGCACCCGTCACCGCCCAGGGCAAATGGAAG<br>GGATCTATCCTGACCACTACCAGGCTAAGTGTGGTGCTGCCTAGCCTGC<br>CGTAAGGTCAAGCGCCCTGCTGCCGCTCGGGTAKCAGTCCTCGTTCACT<br>CGTCCCTCCTAGTACCCTCCGCMTCTGCGCTTCTGCTATCCACTGTGGCC<br>GGWGATGCCGAGGWTGSWMCAWCCTCGACACCTCCAGGGCCAAGC<br>GCCTTGGCCMCAGGTAGGACCTGGCACCTGCCCAGGGGGCCAGACACT<br>GCCTGCGGCAAGGGAAAGGGAGCCGTCCCTGACCGTTACCGGGCTTGA<br>TGGTGCTGGCTAGCCCGCCGTATGTCAAGCACTCCACAGCTGCTCGAGT<br>TCGCTGGCTTCACCTTCATCCCWCCTAGTGCCTTCCGCCTCTGCGCTATT<br>TTCGTCCCGACTCGTACCTCCCCACCTCTGCGCTACMGCTATCCCTGMA<br>AGGACCAAGTGGGCAGGGGSGTTCGCCCCCCGCCCGCAGGAGGCTCGG<br>CGTATCCGTGGCKTCWTGCCTCCACCGTCTTGTGCCGCTAGAGGGGTAC<br>CTCMGAGACCGGCGCAACACGACCTTGACGSTTAGACAGTAGGGTGM<br>AACAKCCCTGCTGCAGGCSTGAAGGGCCAAACGGCTGTGCCATGAGAG<br>GGGAACCTTGAAGACCGGGSCAGTCAGCCAGTTAGTCAGTTGGGCGAA<br>ACAATCCCAGCTGCAGGCCCAMMAGGGCTGTCAGGTGAGGGGGTATC<br>CCCAWCCACCCCCCGCCGCCGACTACGGAGGCAKGAAGTCCCTAGTGA<br>CTTCKGACCCCCACGTCTTGTGCCGGGAGAGGGGAACCTTGAAGATCG<br>GGGCAAGCCGCACTTGATAGTTAGCCAGTCKGGTGAAACAATCCCAGCT<br>GCGGGTCCGAAAGGGCCGACTWCCAGGCGAGGGGGGCCTGCGGAAA<br>MCCCCCTCCATGGTACGGAGKTCTGGCGTCCTMACCGACWCCTTGCCA<br>CCAACGTCTTGTGCCGGGAGAGGGGAACCTTGAAGATCGGGSCAAGCT<br>GCACTTGATGGTTAGTCAGTCGGGTGAAATAATCCCAGCWGCCCCCGC<br>TGTGACTGCTAAGMCWGGTCCCCAAGGGGCATGAGGCATSTGCGCTG<br>AGCCGGSAGGGGTGACACMCGGCGATCGGCGCAGCACAKASTGAAGG<br>GAGGCACTTGCTGAGACTGCTTCTGAGGCCCCAGACTTGGGGTGGTGC<br>AGCCTTGTCTGGGGTATGGTACAGCACCCTACTGCTCCCTTTGGKCAGC<br>AGAATTCGTCCCGACCTCTTACCCACCCGAGTCTGCGCCTTGTTCCGCTA<br>TCCTGCATCTCCGATCCACCTCGCTGTCTCCCCGCTGCGCTGCTTTTCTCT<br>CAAGTGGGTTAAATCTTGTCATGATTACCTCCCACGTTTCCGCTCAAGGG<br>CAATGCCCAAMATGACGGGGATCGCTGGTGCATGGCAGTCATGAGACC<br>ATCCGGACCCTCCGGTGGTCGCTATAGTCATTTTKTGTTGCATGGGGCAT<br>SCTGAGTCACTTAACCGAAAGACTCWAAATAACTCAAAAGAGGKAMCC<br>TCTGSGGTTCGGTAAA (SEQ ID NO: 1087) | | ACTGCCT<br>GCGGCA<br>AGGGAA<br>AGGGAG<br>CCGTCCC<br>TGACCG<br>TTACCG<br>GGCTTG<br>ATGGTG<br>CTGGCT<br>AGCCCG<br>CCGTAT<br>GTCAAG<br>CACTCCA<br>CAGCTG<br>CTCGAG<br>TTCGCT<br>GGCTTC<br>ACCTTCA<br>TCCCWC<br>CTAGTG<br>CCTTCCG<br>CCTCTGC<br>GCTATTT<br>TCGTCCC<br>GACTCG<br>TACCTCC<br>CCACCTC<br>TGCGCT<br>ACMGCT<br>ATCCCTG<br>MAAGG<br>ACCAAG<br>TGGGCA<br>GGGGSG<br>TTCGCCC<br>CCCGCC<br>CGCAGG<br>AGGCTC<br>GGCGTA<br>TCCGTG<br>GCKTCW<br>TGCCTCC<br>ACCGTCT<br>TGTGCC<br>GCTAGA<br>GGGGTA<br>CCTCMG<br>AGACCG | PAEQVVSSYAS (SEQ ID NO: 1455) |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GCGCAA | |
| | | | | | | CACGAC | |
| | | | | | | CTTGAC | |
| | | | | | | GSTTAG | |
| | | | | | | ACAGTA | |
| | | | | | | GGGTG | |
| | | | | | | MAACAK | |
| | | | | | | CCCTGCT | |
| | | | | | | GCAGGC | |
| | | | | | | STGAAG | |
| | | | | | | GGCCAA | |
| | | | | | | ACGGCT | |
| | | | | | | GTGCCA | |
| | | | | | | TGAGAG | |
| | | | | | | GGGAAC | |
| | | | | | | CTTGAA | |
| | | | | | | GACCGG | |
| | | | | | | GSCAGT | |
| | | | | | | CAGCCA | |
| | | | | | | GTTAGT | |
| | | | | | | CAGTTG | |
| | | | | | | GGCGAA | |
| | | | | | | ACAATC | |
| | | | | | | CCAGCT | |
| | | | | | | GCAGGC | |
| | | | | | | CCAMM | |
| | | | | | | AGGGCT | |
| | | | | | | GTCAGG | |
| | | | | | | TGAGGG | |
| | | | | | | GGTATC | |
| | | | | | | CCCAWC | |
| | | | | | | CACCCCC | |
| | | | | | | CGCCGC | |
| | | | | | | CGACTA | |
| | | | | | | CGGAGG | |
| | | | | | | CAKGAA | |
| | | | | | | GTCCCTA | |
| | | | | | | GTGACT | |
| | | | | | | TCKGAC | |
| | | | | | | CCCCAC | |
| | | | | | | GTCTTGT | |
| | | | | | | GCCGGG | |
| | | | | | | AGAGGG | |
| | | | | | | GAACCT | |
| | | | | | | TGAAGA | |
| | | | | | | TCGGGG | |
| | | | | | | CAAGCC | |
| | | | | | | GCACTT | |
| | | | | | | GATAGT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | TAGCCA | |
| | | | | | | GTCKGG | |
| | | | | | | TGAAAC | |
| | | | | | | AATCCC | |
| | | | | | | AGCTGC | |
| | | | | | | GGGTCC | |
| | | | | | | GAAAGG | |
| | | | | | | GCCGAC | |
| | | | | | | TWCCAG | |
| | | | | | | GCGAGG | |
| | | | | | | GGGGCC | |
| | | | | | | TGCGGA | |
| | | | | | | AAMCCC | |
| | | | | | | CCTCCAT | |
| | | | | | | GGTACG | |
| | | | | | | GAGKTC | |
| | | | | | | TGGCGT | |
| | | | | | | CCTMAC | |
| | | | | | | CGACWC | |
| | | | | | | CTTGCCA | |
| | | | | | | CCAACG | |
| | | | | | | TCTTGTG | |
| | | | | | | CCGGGA | |
| | | | | | | GAGGGG | |
| | | | | | | AACCTT | |
| | | | | | | GAAGAT | |
| | | | | | | CGGGSC | |
| | | | | | | AAGCTG | |
| | | | | | | CACTTG | |
| | | | | | | ATGGTT | |
| | | | | | | AGTCAG | |
| | | | | | | TCGGGT | |
| | | | | | | GAAATA | |
| | | | | | | ATCCCA | |
| | | | | | | GCWGCC | |
| | | | | | | CCCGCT | |
| | | | | | | GTGACT | |
| | | | | | | GCTAAG | |
| | | | | | | MCWGG | |
| | | | | | | TCCCCAA | |
| | | | | | | GGGGCA | |
| | | | | | | TGAGGC | |
| | | | | | | ATSTGC | |
| | | | | | | GCTGAG | |
| | | | | | | CCGGSA | |
| | | | | | | GGGGTG | |
| | | | | | | ACACMC | |
| | | | | | | GGCGAT | |
| | | | | | | CGGCGC | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | AGCACA | |
| | | | | | | KASTGA | |
| | | | | | | AGGGAG | |
| | | | | | | GCACTT | |
| | | | | | | GCTGAG | |
| | | | | | | ACTGCTT | |
| | | | | | | CTGAGG | |
| | | | | | | CCCCAG | |
| | | | | | | ACTTGG | |
| | | | | | | GGTGGT | |
| | | | | | | GCAGCC | |
| | | | | | | TTGTCTG | |
| | | | | | | GGGTAT | |
| | | | | | | GGTACA | |
| | | | | | | GCACCC | |
| | | | | | | TACTGCT | |
| | | | | | | CCCTTTG | |
| | | | | | | GKCAGC | |
| | | | | | | AGAATT | |
| | | | | | | CGTCCC | |
| | | | | | | GACCTCT | |
| | | | | | | TACCCAC | |
| | | | | | | CCGAGT | |
| | | | | | | CTGCGC | |
| | | | | | | CTTGTTC | |
| | | | | | | CGCTATC | |
| | | | | | | CTGCATC | |
| | | | | | | TCCGATC | |
| | | | | | | CACCTC | |
| | | | | | | GCTGTC | |
| | | | | | | TCCCCGC | |
| | | | | | | TGCGCT | |
| | | | | | | GCTTTTC | |
| | | | | | | TCTCAA | |
| | | | | | | GTGGGT | |
| | | | | | | TAAATCT | |
| | | | | | | TGTCAT | |
| | | | | | | GATTAC | |
| | | | | | | CTCCCAC | |
| | | | | | | GTTTCC | |
| | | | | | | GCTCAA | |
| | | | | | | GGGCAA | |
| | | | | | | TGCCCA | |
| | | | | | | AMATGA | |
| | | | | | | CGGGGA | |
| | | | | | | TCGCTG | |
| | | | | | | GTGCAT | |
| | | | | | | GGCAGT | |
| | | | | | | CATGAG | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | ACCATCC<br>GGACCC<br>TCCGGT<br>GGTCGC<br>TATAGTC<br>ATTTTKT<br>GTTGCA<br>TGGGGC<br>ATSCTGA<br>GTCACTT<br>AACCGA<br>AAGACT<br>CWAAAT<br>AACTCA<br>AAAGAG<br>GKAMCC<br>TCTGSG<br>GTTCGG<br>TAAA<br>(SEQ ID<br>NO:<br>1333) | |
| R2 | R2-<br>1_DWi | — | *Drosophila williston*i | GAAGCTGGGTCGGATGAGCGCAGAAGGGGTGTTCTTTGGAACACTGTA<br>ATTCATAAGTCGTAAGTCTGATCAAGTCGACTCGAAACCTCCTCGTGGT<br>GTTTCCTGGGTGCTGTTGAGTTCCTAGTCTCTAGGTTCTTTTCAGTAGCT<br>AATTCGAGCGGCGAAGCAACTCTTGGGGTTACCGGCCCCTTGAGCCAA<br>GAAGCGTTGGTACAGAATCAAATAATAATAGTCCTCGGAGCAATATCAC<br>TATCACTTCAGCGACTTCACGTCCTGGAGACCAACCGAGAGAGGCTATA<br>GCAGTGGTAAATCTCGCGGGAGAGATTCCCTGTGCAGTATGCGGGCGC<br>CTCTTCAATACTAGAAGGGGGCTCGGTGTACACATGTCACATCAACACA<br>AAGACGAACTAGATACGCAACGTCAGCGTGAAGATGTAAAACTCCGAT<br>GGAGCGAGGAAGAAGCGTGGATGATGGCGAGAAAGGAGGTGGAGCT<br>CGAAGCAAGTGGTAATTTGAGATTTCCTAATAAGAAGCTAGCGGAAGTA<br>TTTACTCACCGTAGCTCCGAAGCAATTAAATGTTTTCGGAAGAGGGGTG<br>AATATAAGGCAAAACTGGAGCAGATCAGAGGGCAATCTACTCCCACCCC<br>AGAAGCGTTGGACTCTATTACCTCACAGCCTCGCCCTAGTTTACTCGAGC<br>GAAACCACCAAGTATCATCGTCGGAAGCGCAACCAATCAATCCATCAGA<br>AGAACAGTCGAACTGGGAAATCATGCGGATACTACAGGGCTATCGCCC<br>CGTAGAATGTAGTCCCCGGTGGAGAGCCCAGGTCTTGCAAACTATCGTA<br>GATAGGGCGCAGGCCGTAGGGAAGGAAACCACTCTCCAATGCTTATCC<br>AACTATCTCCTGGAAGTATTTCCATTACCAAACGAACCACACACCATCGG<br>TCGGAGCAATTTGCGAAGACCTCGAACTAGGAGACAGTTAAGACAACA<br>AGAGTACGCACAGGTTCAGCGTCGTTGGGATAAGAATACTGGGAGATG<br>CATTAAATCCTTGCTTGATGGAACAGATGAGTCGGTTATGCCAAACCAA<br>GAGATAATGGAACCCTATTGGAAACAAGTAATGACGAATCCCAGCACAT<br>GCTCTTGCGATAACACAAGATTCCGTATGGAACATTCGCTTGAGACGGT<br>TTGGTCAGCGATAACGCCACGCGACCTGAGGGAAAATAAGTTAAAGTT<br>GTCAAGTGCTCCGGGTCCTGACGGTATCACTCCAAGAACAGCCAGGAGT | GAAGCTG<br>GGTCGGAT<br>GAGCGCA<br>GAAGGGG<br>TGTTCTTT<br>GGAACACT<br>GTAATTCA<br>TAAGTCGT<br>AAGTCTGA<br>TCAAGTCG<br>ACTCGAAA<br>CCTCCTCG<br>TGGTGTTT<br>CCTGGGTG<br>CTGTTGAG<br>TTCCTAGT<br>CTCTAGGT<br>TCTTTTCA<br>GTAGCTAA<br>(SEQ ID<br>NO: 1211) | TAGATG<br>TACTAAC<br>CTCTAGC<br>TTTTCTT<br>ATACTTT<br>TGCCTG<br>CTACCTT<br>GGCATT<br>ACATCTA<br>AAAAGG<br>TACAAA<br>CATCGC<br>ATTGTCA<br>TAAAGA<br>GGTGGT<br>TTTAGTA<br>CGTAGG<br>CGCTGT<br>GGGACT<br>TCATTGT<br>CCCGGT<br>GATGCA<br>GTGAAT<br>CGTGCA<br>TACGAG<br>ATTGTCC | FERRSNSWGYRPLEP<br>RSVGTESNNNSPRSN<br>ITITSATSRPGDQPRE<br>AIAVVNLAGEIPCAVC<br>GRLFNTRRGLGVHM<br>SHQHKDELDTQRQR<br>EDVKLRWSEEEAWM<br>MARKEVELEASGNLR<br>FPNKKLAEVFTHRSSE<br>AIKCFRKRGEYKAKLE<br>QIRGQSTPTPEALDSI<br>TSQPRPSLLERNHQV<br>SSSEAQPINPSEEQSN<br>WEIMRILQGYRPVEC<br>SPRWRAQVLQTIVD<br>RAQAVGKETTLQCLS<br>NYLLEVFPLPNEPHTI<br>GRSNLRRPRTRRQLR<br>QQEYAQVQRRWDK<br>NTGRCIKSLLDGTDES<br>VMPNQEIMEPYWK<br>QVMTNPSTCSCDNT<br>RFRMEHSLETVWSAI<br>TPRDLRENKLKLSSAP<br>GPDGITPRTARSVPL<br>GIMLRIMNLILWCGK |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTACCCTTAGGCATTATGCTACGCATAATGAACCTGATTCTCTGGTGCGG<br>CAAAATACCATTCTCTACCCGACTGGCCAGAACTATCTTCATTCCGAAGA<br>CTGTGACGGCAAATCGACCGCAAGACTTTCGTCCAATAACAGTCCCCTC<br>GGTTTTGGTCAGGCAATTAAACGCTGTTCTGGCTTCTCGATTGGCTTCTA<br>AAGTCAACTGGGATCCAAGGCAGCGCGGTTTCCTACCTACCGATGGGTG<br>TGCTGATAATGCGACGTTGGTTGATCTCATTTTGCGGGAGCACCATAAA<br>CGGTGGAAGTCATGTTACCTTGCGACGGTGGATGTCAGCAAGGCTTTTG<br>ACTCAGTATCACACCAGGCCATTATCAAGACTTTACAGGCCTATGGTGCT<br>CCAACAAACTTTGTCAGCTTCATAGAAGAACAGTATAAGGGCGGCGGA<br>ACCTCCCTCAATGGGGCAGGATGGAGTTCAGAGGTGTTTATACCCGCGC<br>GGGGCGTTAAGCAAGGTGACCCTCTGTCTCCACTATTATTTAATCTTATC<br>ATTGATAGATTACTTAGGTCCTACCCCAGAGAGATTGGTGCCAAAGTCG<br>GAAATACCATGACAAGCGCGGCAGCGTTCGCGGATGATCTGGTGCTATT<br>TGCGGAAACTCCGATGGGGCTTCAAACATTGTTGGATACCACGGTAGGC<br>TTCCTAGCCTCCGTGGGACTCTCCCTTAATGCTGATAAGTGCTTCACTGT<br>CAGTATAAAGGGGCAAGCCAAGCAGAAGTGTACTGTCGTAGAACGACG<br>GAGCTTTTGTGTAGGTGAGCGCGAGTGTCCTTCATTGAAGCGTACTGAA<br>GAGTGGAAGTATTTAGGTATCCGGTTCACTGCGGATGGGCGGGCTCGG<br>TATAGTCCAGCAGACGACCTCGGTCCGAAGCTGTTAAGATTAACAAGAG<br>CCCCTCTGAAACCACAACAGAAGTTATTTGCACTTAGGACTGTCCTTATC<br>CCACAACTCTATCACCAACTAACACTTGGGAGTGTGATGATAGGCGTCC<br>TAAGAAAATGTGACAGATTGGTACGGCAATTCGTAAGGAGATGGTTAG<br>ATCTCCCACTGGATGTACCAGTTGCTTACTTTCACGCCCCCCACACTTGT<br>GGGGGTCTCGGGATTCCGTCAATTAGATGGATAGCACCGATGCTGCGTC<br>TGAAGCGATTGAGCAATATTAAATGGCCCCACCTCGAACAATCCGAGGT<br>AGCTAGCTCTTTCATTGACGACGAATTGCAAAGGGCTCGAGATAGATTA<br>AAGGCGGAAAATGTGCAGCTGTGTTCGCGTCCAGAGATTGACTCGTATT<br>TCGCAAATAGATTGTACATGTCTGTTGATGGTTGCGGTCTCCGTGAAGC<br>AGGTCATTATGGCCCGCAACATGGATGGGTGAGTCAGCCCACGCGCTT<br>GCTAACAGGAAAGGAATATTTGCACGGTGTCAAATTGCGGATAAATGCC<br>CTACCCTCGAAGTCTCGTACGACGAGGGGAAGGCACGAATTGGAGAGA<br>CGGTGTCGTGCAGGATGTGATGCTCCCGAGACAACAAACCACATCTTGC<br>AAAAATGCTATCGTACGCATGGGAGGCGGGTAGCTAGACACAACAGCG<br>TAGTAAATGCCGTCAAGCGGGGACTTGAACGGAAAGGCTGCGTTGTCC<br>ATGTCGAACCAAGTCTGCAATGCGACTCGGGCTTAAATAAACCGGACCT<br>GGTGGGAATCCGACAGAATCACATTTATGTGATAGACGTTCAGGTTGTG<br>ACAGACGGACATTCCTTAGACCAAGCGCACCAGCGCAAGGTCGAAAGG<br>TACGACAGAGCTGACATAAGATCACAAATGCGGCGATTTTTCGGAGCGA<br>CAGGTGAAATCGAGTTTCATTCCGTTACACTCAACTGGAGAGGAATCTG<br>GAGTGGTCAGTCGGTAAAACGATTGATTGCAAAGGATCTCCTCATCGCT<br>GAAGATACCAAACTCATCAGCGTCAGAGCAGTAAATGGCGGAGTGACG<br>TCCTTCAAATATTTCATGTATTGTGCTGGGTATACTCGAAGCTAGATGTA<br>CTAACCTCTAGCTTTTCTTATACTTTTGCCTGCTACCTTGGCATTACATCTA<br>AAAAGGTACAAACATCGCATTGTCATAAAGAGGTGGTTTTAGTACGTAG<br>GCGCTGTGGGACTTCATTGTCCCGGTGATGCAGTGAATCGTGCATACGA<br>GATTGTCCAGTAGTTGGTTGCTCGTATCTTTAGAAGATTTCCTTCCTCGG<br>CGATCAAAAAAAAAAAAAAAAAAAAAAA (SEQ ID NO: 1088) | | AGTAGT<br>TGGTTG<br>CTCGTAT<br>CTTTAGA<br>AGATTTC<br>CTTCCTC<br>GGCGAT<br>CAAAAA<br>AAAAAA<br>AAAAAA<br>AAAAAA<br>(SEQ ID<br>NO:<br>1334) | IPFSTRLARTIFIPKTVT<br>ANRPQDFRPITVPSV<br>LVRQLNAVLASRLAS<br>KVNWDPRQRGFLPT<br>DGCADNATLVDLILR<br>EHHKRWKSCYLATV<br>DVSKAFDSVSHQAIIK<br>TLQAYGAPTNFVSFIE<br>EQYKGGGTSLNGAG<br>WSSEVFIPARGVKQG<br>DPLSPLLFNLIIDRLLR<br>SYPREIGAKVGNTMT<br>SAAAFADDLVLFAET<br>PMGLQTLLDTTVGFL<br>ASVGLSLNADKCFTV<br>SIKGQAKQKCTVVER<br>RSFCVGERECPSLKRT<br>EEWKYLGIRFTADGR<br>ARYSPADDLGPKLLRL<br>TRAPLKPQQKLFALR<br>TVLIPQLYHQLTLGSV<br>MIGVLRKCDRLVRQF<br>VRRWLDLPLDVPVAY<br>FHAPHTCGGLGIPSIR<br>WIAPMLRLKRLSNIK<br>WPHLEQSEVASSFID<br>DELQRARDRLKAENV<br>QLCSRPEIDSYFANRL<br>YMSVDGCGLREAGH<br>YGPQHGWVSQPTRL<br>LTGKEYLHGVKLRINA<br>LPSKSRTTRGRHELER<br>RCRAGCDAPETTNHI<br>LQKCYRTHGRRVAR<br>HNSVVNAVKRGLER<br>KGCVVHVEPSLQCDS<br>GLNKPDLVGIRQNHI<br>YVIDVQVVTDGHSLD<br>QAHQRKVERYDRAD<br>IRSQMRRFFGATGEI<br>EFHSVTLNWRGIWS<br>GQSVKRLIAKDLLIAE<br>DTKLISVRAVNGGVT<br>SFKYFMYCAGYTRS<br>(SEQ ID NO: 1456) |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| R2 | R2-1_Gav | — | *Gavialis gangeticus* | AGGCATCTCCTTKAAGGGTAATGGTCTGGTTACATGGTCATAGCAGGTT | AGGCATCT | TGAGAA | PAAPRAWGAVEAGP |
| | | | | TGTGTCAGGTACCTCCCAGTGGTTCCCGCCGGGTGSCAMAGCCCCAGG | CCTTKAAG | GTTGCG | WPGRTRAVEPAPSP |
| | | | | GCTGTCGGTAGCTCGATCCTGGTACAGTACGGCCAAGGGAGTTCTTCCT | GGTAATGG | AGTTCTT | ESSPSEAARAAPAGE |
| | | | | TGCTGTCGGGTGCCTCGCAAGCACKTGGCAGCCCCAATCGCTTCATTGC | TCTGGTTA | ATGCAA | GHGPGHESPSVQRP |
| | | | | GAAAAACACAAACGTCCTAAGGGGATGATCAGCTAGTCAGTTCTGCCGC | CATGGTCA | GTTGAA | EADTTAPGVSAPTRE |
| | | | | TAGCCAAAACTGTTTGCCACCCAGTTACAGATAGCGTCTGTGCTGACCA | TAGCAGGT | TACCACT | GEPPSTRVFLVRLPDS |
| | | | | GCTGCCCCGCGGGCTTGGGGTGCAGTGGAGGCCGGCCCGTGGCCAGG | TTGTGTCA | CTKGKG | NPPCPICRDHVGKPS |
| | | | | CCGGACACGGGCCGTGGAGCCTGCTCCCAGTCCAGAGAGTTCCCCCTCG | GGTACCTC | ACCCCA | ALALHCVESHAWAD |
| | | | | GAAGCTGCCAGGGCAGCACCAGCCGGGGAGGGCCACGGCCCCGGTCA | CCAGTGGT | AAAAAW | VQYQCTHCKKVSAN |
| | | | | TGAGTCCCCCTCGGTGCAGAGGCCTGAGGCCGATACCACTGCCCCTGGT | TCCCGCCG | WAAACC | KHSILCHIPCCQGRVP |
| | | | | GTGAGCGCGCCCACCAGGGAGGGTGAACCACCCTCCACCAGGGTTTTC | GGTGSCA | CCAAAA | EWTGKDWACPECPA |
| | | | | CTGGTGAGGCTGCCTGATTCAAACCCGCCGTGCCCAATTTGCAGGGACC | MAGCCCC | CAGTTG | SFNKKVGLSQHKRHV |
| | | | | ATGTGGGTAAACCCTCCGCGCTGGCCCTCCACTGCGTGGAGAGCCATGC | AGGGCTGT | TGTTTAA | HPVTRNVERVAGSLS |
| | | | | GTGGGCGGATGTGCAATACCAGTGCACCCATTGCAAAAAGGTCAGTGC | CGGTAGCT | GTGTGT | RAGLRPQTRRGCWS |
| | | | | TAACAAACACAGCATCCTCTGCCACATCCCATGTTGCCAGGGGAGGGTG | CGATCCTG | TCTTGTT | VEEEETLTCLDAMFR |
| | | | | CCCGAGTGGACCGGGAAGGACTGGGCTTGTCCTGAGTGCCCTGCCTCCT | GTACAGTA | CGTCCCT | GARNINQLIAAEMVT |
| | | | | TCAATAAGAAAGTTGGCCTATCGCAGCACAAGCGGCACGTGCATCCGGT | CGGCCAAG | TTGGCTT | KMPKQISDKRRQLGL |
| | | | | AACACGTAATGTGGAACGGGTTGCAGGGAGCCTATCGAGGGCTGGTTT | GGAGTTCT | CACCTCS | CPEQTTLGGDAESTS |
| | | | | AAGGCCCCAGACCAGACGCGGGTGCTGGTCGGTGGAAGAAGAGGAAA | TCCTTGCT | AAGTTG | VVEEESMTPEMETQ |
| | | | | CTCTCACCTGCCTAGACGCGATGTTCCGTGGTGCCCGGAACATCAACCA | GTCGGGT | CGATCC | SPINPPGKIRKILAQR |
| | | | | GCTGATCGCTGCTGAAATGGTAACGAAGATGCCTAAGCAGATCAGTGA | GCCTCGCA | CCCCATC | ARRWLKKGQGLSDK |
| | | | | CAAACGGAGGCAGCTCGGTCTGTGTCCTGAGCAGACCACATTGGGTGG | AGCACKTG | TCCCCTG | VREVLGAWVEGQPR |
| | | | | TGATGCTGAATCGACCTCCGTGGTGGAGGAAGAGTCCATGACTCCGGA | GCAGCCCC | CGCTGC | IHAWVDSVSLDVLTL |
| | | | | GATGGAAACCCAAAGCCCAATTAACCCGCCTGGGAAAATCAGGAAGAT | AATCGCTT | CTTTCAG | FLGVPSGPQRAPNKK |
| | | | | CCTGGCCCAGAGGGCACGCCGGTGGCTGAAGAAGGGGCAGGGTCTGT | CATTGCGA | AACGGC | RPKEGGKPTSWMNK |
| | | | | CGGACAAGGTGCGAGAAGTCCTGGGCGCATGGGTGGAGGGTCAACCC | AAAACACA | CGGTGG | CAVKWGTFLRYQHLF |
| | | | | AGGATTCATGCCTGGGTCGACTCAGTCTCCCTTGATGTTTTGACTTTGTT | AACGTCCT | TGTCGA | GANRKLLVAIVLDGA |
| | | | | CTTGGGGGTGCCCTCAGGACCGCAGAGGGCTCCGAACAAGAAGAGGCC | AAGGGGA | GGCTGG | DRNQCTLLLEEVFQA |
| | | | | CAAGGAGGGTGGCAAACCAACGTCCTGGATGAACAAATGTGCCGTCAA | TGATCAGC | CGCGAC | YREKWGLEEVLRAYR |
| | | | | ATGGGGCACATTCCTTCGGTACCAGCACCTGTTTGGTGCCAACAGGAAG | TAGTCAGT | CTCGGT | GKWEVESSFEGLGRF |
| | | | | CTCCTGGTGGCSATCGTCCTGGACGGCGCTGACCGTAATCAGTGCACCC | TCTGCCGC | CACCTCC | GVRRDADNFAFKALI |
| | | | | TCCTGCTAGAGGAGGTCTTCCAGGCCTACCGAGAAAAGTGGGGGCTAG | TAGCCAAA | AAGGCC | TPEEVVKHMMAMA |
| | | | | AGGAAGTCCTTCGGGCCTACCGAGGAAAGTGGGAGGTAGAGTCATCTT | ACTGTTTG | AAGTGC | SKSAPGPDKLTLRDLR |
| | | | | TTGAGGGTCTCGGACGGTTCGGGGTCCGCCGGGATGCGGATAACTTCG | CCACCCAG | CCTGGC | RADPEGDALAELFSL |
| | | | | CATTCAAGGCCCTGATCACTCCTGAGGAGGTTGTCAAACACATGATGGC | TTACAGAT | CCCGAG | WLITGTVPDGLKECR |
| | | | | AATGGCCTCGAAATCGGCTCCAGGTCCGGATAAGCTCACCCTGAGAGAT | AGCGTCTG | TAGGAC | SVLIPKTVDREKLGQL |
| | | | | CTGCGCCGCGCTGACCCCGAGGGAGATGCTCTTGCCGAACTCTTCAGCC | TGCTGA | TGAGTG | GNWRPITIGSIVLRLF |
| | | | | TGTGGCTGATTACCGGCACGGTCCCGGACGGACTCAAGGAGTGTCGGT | (SEQ ID | GCCCAG | SRVLTARLAAACPINP |
| | | | | CTGTGTTGATACCCAAAACGGTGGACCGGGAGAAGTTGGGCCAGCTGG | NO: 1212) | CTCGCT | RQRGFIAAPGCAENL |
| | | | | GCAACTGGCGCCCTATCACGATTGGGTCCATCGTTTTACGGCTATTCTCA | | GGGCAC | KVLELLLRKRKRDRQP |
| | | | | CGAGTGCTAACCGCACGGCTCGCCGCAGCATGTCCCATCAACCCCCGTC | | CCGTCA | LGVVFVDLARAFDSV |
| | | | | AGAGGGGTTTCATAGCGGCGCCGGGGTGCGCCGAGAACCTGAAGGTG | | CCATCTG | SHDHISWVLKAKGV |
| | | | | CTTGAGCTTCTCTTGCGGAAGAGGAAGCGAGACAGGCAGCCGTTGGGT | | GGGCAA | DEHIVNLIEDSYQKVT |
| | | | | GTGGTATTTGTGGATCTAGCGAGGGCGTTCGATTCGGTGTCACACGATC | | ATGGAA | TRVQVFNGVTPPISIK |
| | | | | ACATTTCTTGGGTCCTAAAGGCCAAAGGGGTGGACGAACACATCGTGA | | GGGATC | TGVKQGDPMSPLLF |
| | | | | ATCTCATCGAAGATTCTTACCAGAAGGTTACCACGAGAGTACAAGTGTT | | TGTCCT | NIAMDPLIAKLETDG |
| | | | | CAATGGCGTCACCCCTCCTATCAGCATCAAAACCGGGGTTAAGCAAGGC | | GACCAC | QGVKVGSASLTTLAF |
| | | | | GACCCGATGTCCCCCCTCTTGTTCAACATTGCGATGGACCCCCTGATAGC | | TACCAG | ADDLVLLSDSWEGM |
| | | | | GAAGCTCGAGACAGACGGACAGGGAGTAAAAGTCGGGAGTGCCTCCCT | | GCTAAG | LKNISILEDFCNLTGLR |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GACCACCCTGGCCTTCGCGGATGATCTCGTCCTGCTTAGCGACTCTTGG | | TGTGGT | VQPKKCQGFFLNPTC |
| | | | | GAGGGCATGCTGAAGAACATCAGCATCCTAGAGGACTTCTGCAACCTCA | | GCGGCC | DSFTVNNCEAWKIA |
| | | | | CGGGCCTACGAGTGCAACCCAAAAAATGTCAGGGGTTCTTCTTGAATCC | | TAGCCT | GREITMLGPGESTRY |
| | | | | GACATGCGACTCCTTTACGGTGAACAACTGCGAGGCCTGGAAGATAGC | | GCCGTA | LGLNVGPWVGIDKP |
| | | | | CGGCCGTGAGATCACGATGCTCGGACCAGGCGAGTCGACACGATATCT | | AGGTCA | DLGTQLSSWLERIGT |
| | | | | GGGCTTGAATGTCGGTCCTTGGGTTGGGATCGACAAACCAGATTTGGGT | | AGCGCC | APLKPMQKLSLLVQY |
| | | | | ACGCAACTAAGCTCCTGGCTCGAGAGGATAGGGACTGCTCCACTCAAAC | | CTGCTG | AIPRLNYQADYAGIG |
| | | | | CGATGCAGAAGCTCTCTTTGCTGGTGCAGTATGCCATACCCAGGCTGAA | | CCACTCA | RVALEALDSMNRRK |
| | | | | CTATCAGGCCGATTACGCGGGCATCGGCAGGGTGGCCTTGGAGGCTCT | | GGTATC | VKEWFHLPACTSDGL |
| | | | | GGATTCTATGAACCGGAGAAAGGTAAAGGAGTGGTTCCATCTTCCCGCC | | AGTCCTC | LHSRHRDGGLGLPRL |
| | | | | TGTACCTCGGACGGTCTCCTCCACTCCCGTCACCGTGACGGGGGTCTTG | | GTTCACT | AKAIPEAQVRRLIRVA |
| | | | | GGTTACCGCGTCTGGCGAAAGCCATTCCGGAAGCGCAAGTGAGGAGGC | | TGTCCCT | TSSDEVTRKVSYACGI |
| | | | | TGATCCGCGTAGCCACTTCATCTGATGAAGTCACGCGGAAAGTATCCTA | | CCTAGT | SDEVERLWLARGGD |
| | | | | CGCGTGTGGGATAAGTGACGAAGTGGAGCGGCTCTGGTTGGCGAGGG | | ACCCTCT | MSSVPRFEDPEAPRS |
| | | | | GTGGGGACATGTCCAGTGTACCGAGGTTCGAGGATCCTGAGGCCCCGA | | GCCTCT | PGVQGPCEAAQEIPS |
| | | | | GGTCTCCGGGGGTGCAGGGCCCCTGCGAGGCTGCCCAGGAGATTCCGA | | GCTCTTT | VVRKLAIPRPSNWRS |
| | | | | GCGTAGTCCGGAAGCTTGCGATCCCCCGGCCCTCCAACTGGAGATCCAA | | TGCTATC | KKHSKWAQLSCQGE |
| | | | | GAAACACTCCAAATGGGCCCAACTCAGCTGTCAGGGAGAGGGGATGGA | | CACTAT | GMELFCNDPVSNG |
| | | | | GTTATTCTGCAATGATCCAGTCAGCAATGGCTGGAACAACAGTCGGGGA | | GGCCAG | WNNSRGQLAEHLQI |
| | | | | CAACTGGCGGAACACCTCCAGATCGTGGCCTTAAAACTGCGTTCAAACA | | TGATGTT | VALKLRSNIYPTREFL |
| | | | | TTTATCCCACCAGGGAGTTTCTTGGGAGAAGCCAGGCAAGTACCAATGT | | GAGGTT | GRSQASTNVGCRHC |
| | | | | AGGTTGCCGGCATTGTACACACCCTCATGAAACACTAGGGCATATCTTG | | GGTGCA | THPHETLGHILGICPA |
| | | | | GGCATATGCCCTGCCGTGCAGGAGGCACGGATCATCCGGCATAACAAG | | TCCTTG | VQEARIIRHNKLCKIL |
| | | | | CTGTGCAAGATCCTAGCAGCTGAGGGCAAAAAGTGTGAGTGGACAGTG | | GTCACCT | AAEGKKCEWTVYYEL |
| | | | | TATTATGAACTGCAACTGCTTAACGCTGCAGGGGAACTGTGTAAACCTG | | CCAGGG | QLLNAAGELCKPDLIF |
| | | | | ACCTCATTTTTGTCCGAGACGGTACCGMTCTGGTTGTGAATGTCACTGT | | CCAAGC | VRDGTXLVVNVTVG |
| | | | | GGGGTACGAAGGGGGCCCCGCAWCCCTCCTATCCACCGCTGCAGAAAA | | GCCTTG | YEGGPAXLLSTAAEK |
| | | | | GGCCACAAAATACCTGGATMTGAACGCACAGATCCAGGAGCTCACAGG | | GCCACA | ATKYLDXNAQIQELT |
| | | | | GGCTGAGCAGGTCACCTACTTTGGCTTCCCTATWGGAGCCAGGGGAAA | | GGTAGG | GAEQVTYFGFPIGAR |
| | | | | GTGGCATGCTGACAACTGKCGAGTACTGTCTGAACTGGGATTGTCCAAC | | ACCTGG | GKWHADNXRVLSEL |
| | | | | TCCCGGAAGGAGCGGGTCGCACGGCTCCTGTMGTGGCGAGCACTGCTC | | CACCTG | GLSNSRKERVARLLX |
| | | | | GGGTCAGTGGACATGGTGAACATCTTTGCATCTAAGCACAGGCAGGAA | | CCCAGG | WRALLGSVDMVNIF |
| | | | | AACCTATCGGATGAMGCACTGAGCCCCAGCTGAGAAGTTGCGAGTTCT | | GGGCCA | ASKHRQENLSDXALS |
| | | | | TATGCAAGTTGAATACCACTCTKGKGACCCCAAAAAAWWAAACCCCAA | | GACACT | PS (SEQ ID NO: |
| | | | | AACAGTTGTGTTTAAGTGTGTTCTTGTTCGTCCCTTTGGCTTCACCTCSAA | | GCCTGT | 1457) |
| | | | | GTTGCGATCCCCCCATCTCCCCTGCGCTGCCTTTCAGAACGGCCGGTGGT | | GGCAAG | |
| | | | | GTCGAGGCTGGCGCGACCTCGGTCACCTCCAAGGCCAAGTGCCCTGGC | | GGAAAG | |
| | | | | CCCGAGTAGGACTGAGTGGCCCAGCTCGCTGGGCACCCGTCACCATCTG | | GGAGCC | |
| | | | | GGGCAAATGGAAGGGATCTGTCCTGACCACTACCAGGCTAAGTGTGGT | | GTCCCT | |
| | | | | GCGGCCTAGCCTGCCGTAAGGTCAAGCGCCCTGCTGCCACTCAGGTATC | | GACCGT | |
| | | | | AGTCCTCGTTCACTTGTCCCTCCTAGTACCCTCTGCCTCTGCTCTTTTGCT | | TACCAG | |
| | | | | ATCCACTATGGCCAGTGATGTTGAGGTTGGTGCATCCTTGGTCACCTCCA | | GCTTGA | |
| | | | | GGGCCAAGCGCCTTGGCCACAGGTAGGACCTGGCACCTGCCCAGGGGG | | GATGGT | |
| | | | | CCAGACACTGCCTGTGGCAAGGGAAAGGGAGCCGTCCCTGACCGTTAC | | GCTGGC | |
| | | | | CAGGCTTGAGATGGTGCTGGCTAGCCCACCATATGTCAAGCACTCCACA | | TAGCCC | |
| | | | | GCTGCTTGAGTTTGTTGGCTTCACCTTCATCCCACCTAGTGTCTTCTGCCT | | ACCATAT | |
| | | | | CTGCACTATTTTCATCCCAACTCGTACCTCCCCATCTCTGCGCTCCTGCTA | | GTCAAG | |
| | | | | TCCCTGCAAGGACCAAGTAGGCAGGGGGGTTCATCCCCCTACCTGCAG | | CACTCCA | |
| | | | | GAGACTCAGCATATCCATGACTTCTTGCCTCCACCGTCTTGTGGCGCTAG | | CAGCTG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGGGGTACCTCAGAGACCGGCACAACATGACCTTGACGGTTAGACAGT | | CTTGAG | |
| | | | | AGGGTCAAACAACCCTGCTGCAGGCCCAAAGGGCCAACAGCTGTGCCA | | TTTGTTG | |
| | | | | CGAGAGGGGAACCTTGAAGACTGGGGCAGTCTGACCATGCTGGTTAGT | | GCTTCAC | |
| | | | | CAGTTGGGTGAAATAATCCCAGCTGCAGGCCCAAAAGGGCTGACAGTC | | CTTCATC | |
| | | | | AGGTGAGGGGGTATCTCCATCTGCTCCCCACTGCCAACTACGGAGGCAT | | CCACCTA | |
| | | | | GAAGTCCGTAGTGACTTCTGACCCCCACGTCTTGTGCCATGAGAAGGGA | | GTGTCTT | |
| | | | | ACCTTGAAGATTGGGACAAACCGCACTTGAAAGTTACTCAGCCGGGTGA | | CTGCCTC | |
| | | | | AAATAAGTCCCAGTTGCGGGCCCCTCGGGGCTGACAGTCAGGTGAGGA | | TGCACT | |
| | | | | GGGCTGCAAAGCCCATCTCCTGACTCCAGAGGCCTGGCGTCCTAACCGA | | ATTTTCA | |
| | | | | CTTCTTGCCACCAATGTCTTGCGCCAGGAGAGGGCAACCTTGAAGATCG | | TCCCAAC | |
| | | | | GGGCAAGCCGCACTTGATAGTTAGCCAGTCGAGTGAAACAATCTCAGCT | | TCGTACC | |
| | | | | GCGGGTCCGAAAGGACTGACTTCCAGGCGAGGGGGGGGCCTGCGGAA | | TCCCCAT | |
| | | | | AACCCCCTCCATGGTACGGAGGTCTGGCATCCTAACCGACACCTTGCCA | | CTCTGC | |
| | | | | CCAATGTCTTGTGCCAGGAGAGGGGAACCTTGAAGACTGGGGCAAGCC | | GCTCCT | |
| | | | | GCAGTTGATGGTTAGTCAGTCGGGTGAAATAATCCCGGCTGCACCCTGC | | GCTATCC | |
| | | | | TGTGACTGCTAAGCCCGGTCCCCAAGGGGCATGAGGCATGTGCGCTGA | | CTGCAA | |
| | | | | GACGGGAGGGGTGACATCTGGCGATCAGCACAGCACAGACTGAAGGG | | GGACCA | |
| | | | | AGGCACTTGCCGAGAATGCTTCTGAGGCCCCAGACTTGGGGTGGTGCA | | AGTAGG | |
| | | | | GCTTTGTCTCGTGTATAGTACAGCACCCTACTGCTCCCTTTGGGCAGCAG | | CAGGGG | |
| | | | | AATTTGTCCTGACCTCTTACCCACCCGAGTCTGCGCTTTTGTTCCACCTCG | | GGTTCA | |
| | | | | CTGTCTCCCTGCTGTGCTGTTTTTCTCTCAAGTGGGTTAAATCTCAACATG | | TCCCCCT | |
| | | | | ATTATCTCCCACGTTTCCGCTCAAGGGCAATGCCCAACATGACGGAGAT | | ACCTGC | |
| | | | | CGTTGGTGCATGGTAGTCACGAGACCATCCGGACCCTCCAGTGGTCGCT | | AGGAGA | |
| | | | | ATAGTCATTTTGTGTTGCATGGGGCATGCTGAGTCACTTAACCGAAAGA | | CTCAGC | |
| | | | | CTGTAAATAACTCAAAAGAGGTACCCTCCGGGGTTCGGTAAA (SEQ ID | | ATATCCA | |
| | | | | NO: 1089) | | TGACTTC | |
| | | | | | | TTGCCTC | |
| | | | | | | CACCGT | |
| | | | | | | CTTGTG | |
| | | | | | | GCGCTA | |
| | | | | | | GAGGGG | |
| | | | | | | TACCTCA | |
| | | | | | | GAGACC | |
| | | | | | | GGCACA | |
| | | | | | | ACATGA | |
| | | | | | | CCTTGAC | |
| | | | | | | GGTTAG | |
| | | | | | | ACAGTA | |
| | | | | | | GGGTCA | |
| | | | | | | AACAAC | |
| | | | | | | CCTGCT | |
| | | | | | | GCAGGC | |
| | | | | | | CCAAAG | |
| | | | | | | GGCCAA | |
| | | | | | | CAGCTG | |
| | | | | | | TGCCAC | |
| | | | | | | GAGAGG | |
| | | | | | | GGAACC | |
| | | | | | | TTGAAG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | ACTGGG<br>GCAGTC<br>TGACCA<br>TGCTGG<br>TTAGTCA<br>GTTGGG<br>TGAAAT<br>AATCCC<br>AGCTGC<br>AGGCCC<br>AAAAGG<br>GCTGAC<br>AGTCAG<br>GTGAGG<br>GGGTAT<br>CTCCATC<br>TGCTCCC<br>CACTGC<br>CAACTA<br>CGGAGG<br>CATGAA<br>GTCCGT<br>AGTGAC<br>TTCTGAC<br>CCCCAC<br>GTCTTGT<br>GCCATG<br>AGAAGG<br>GAACCT<br>TGAAGA<br>TTGGGA<br>CAAACC<br>GCACTT<br>GAAAGT<br>TACTCA<br>GCCGGG<br>TGAAAA<br>TAAGTC<br>CCAGTT<br>GCGGGC<br>CCCTCG<br>GGGCTG<br>ACAGTC<br>AGGTGA<br>GGAGGG<br>CTGCAA<br>AGCCCA<br>TCTCCTG<br>ACTCCA | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GAGGCC<br>TGGCGT<br>CCTAACC<br>GACTTCT<br>TGCCAC<br>CAATGT<br>CTTGCG<br>CCAGGA<br>GAGGGC<br>AACCTT<br>GAAGAT<br>CGGGGC<br>AAGCCG<br>CACTTG<br>ATAGTT<br>AGCCAG<br>TCGAGT<br>GAAACA<br>ATCTCA<br>GCTGCG<br>GGTCCG<br>AAAGGA<br>CTGACTT<br>CCAGGC<br>GAGGGG<br>GGGGCC<br>TGCGGA<br>AAACCC<br>CCTCCAT<br>GGTACG<br>GAGGTC<br>TGGCAT<br>CCTAACC<br>GACACC<br>TTGCCAC<br>CAATGT<br>CTTGTG<br>CCAGGA<br>GAGGGG<br>AACCTT<br>GAAGAC<br>TGGGGC<br>AAGCCG<br>CAGTTG<br>ATGGTT<br>AGTCAG<br>TCGGGT<br>GAAATA<br>ATCCCG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GCTGCA<br>CCCTGCT<br>GTGACT<br>GCTAAG<br>CCCGGT<br>CCCCAA<br>GGGGCA<br>TGAGGC<br>ATGTGC<br>GCTGAG<br>ACGGGA<br>GGGGTG<br>ACATCT<br>GGCGAT<br>CAGCAC<br>AGCACA<br>GACTGA<br>AGGGAG<br>GCACTT<br>GCCGAG<br>AATGCTT<br>CTGAGG<br>CCCCAG<br>ACTTGG<br>GGTGGT<br>GCAGCT<br>TTGTCTC<br>GTGTAT<br>AGTACA<br>GCACCC<br>TACTGCT<br>CCCTTTG<br>GGCAGC<br>AGAATT<br>TGTCCT<br>GACCTCT<br>TACCCAC<br>CCGAGT<br>CTGCGC<br>TTTTGTT<br>CCACCTC<br>GCTGTC<br>TCCCTGC<br>TGTGCT<br>GTTTTTC<br>TCTCAA<br>GTGGGT<br>TAAATCT<br>CAACAT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GATTATC | |
| | | | | | | TCCCAC | |
| | | | | | | GTTTCC | |
| | | | | | | GCTCAA | |
| | | | | | | GGGCAA | |
| | | | | | | TGCCCA | |
| | | | | | | ACATGA | |
| | | | | | | CGGAGA | |
| | | | | | | TCGTTG | |
| | | | | | | GTGCAT | |
| | | | | | | GGTAGT | |
| | | | | | | CACGAG | |
| | | | | | | ACCATCC | |
| | | | | | | GGACCC | |
| | | | | | | TCCAGT | |
| | | | | | | GGTCGC | |
| | | | | | | TATAGTC | |
| | | | | | | ATTTTGT | |
| | | | | | | GTTGCA | |
| | | | | | | TGGGGC | |
| | | | | | | ATGCTG | |
| | | | | | | AGTCAC | |
| | | | | | | TTAACC | |
| | | | | | | GAAAGA | |
| | | | | | | CTGTAA | |
| | | | | | | ATAACTC | |
| | | | | | | AAAAGA | |
| | | | | | | GGTACC | |
| | | | | | | CTCCGG | |
| | | | | | | GGTTCG | |
| | | | | | | GTAAA | |
| | | | | | | (SEQ ID | |
| | | | | | | NO: | |
| | | | | | | 1335) | |
| R2 | R2- | — | *Ixodes* | GTTCCAAAGGAAGGCACTCCTTTGGTTCGTGATGAGATGTTCATGGTGC | GTTCCAAA | TAGTGT | MQCTSRLADAPRFA |
| | 1_IS | | *scapularis* | TTGCCTAGCTGGAGAAATCCGACTCACACCTGCACGTGGTCCCTGCCGC | GGAAGGC | GACGGA | RVGVEGEGVGASGN |
| | | | | CTGCCAGTATGCCGAGGAAACGGGTGCAACTTAATCCGTGGATACTGGT | ACTCCTTT | GTCCTCA | GTDAQLWYGCTGCD |
| | | | | AGCAACGTGAGCAACGGTACGGTCCTTCGCGGACCACCCTGGGCGTTC | GGTTCGTG | AGCCCC | EAFSSLRGLRIHAAQK |
| | | | | GGGTTGCCAGCCCGTTCGCCCGAAATATCTTGGCCCTGAAACTAAAAGA | ATGAGATG | CACAAG | KHGNQDGLLRLPAG |
| | | | | AAAATGCAATGCACCAGCCGACTGGCTGATGCACCAAGATTTGCCCGAG | TTCATGGT | TGCCTG | RPRKRRVGKSTTAGA |
| | | | | TGGGCGTCGAGGGTGAAGGTGTCGGTGCGTCTGGTAACGGCACTGATG | GCTTGCCT | CCAGGT | SDRVTTDPVPAPVPE |
| | | | | CGCAGTTATGGTATGGCTGCACGGGCTGTGACGAAGCCTTCTCGTCCCT | AGCTGGA | GGCAGG | SPGLLPGLPGPSLPGC |
| | | | | GCGAGGACTGAGAATTCATGCGGCCCAAAAGAAACATGGAAACCAAGA | GAAATCCG | AAAGGG | SDLPPGVLPGGWSA |
| | | | | TGGCCTTCTCCGCCTGCCGGCGGGACGGCCCCGAAAACGACGAGTGGG | ACTCACAC | CAACTA | SPGPLSWPPSLDAGP |
| | | | | GAAGAGCACCACAGCGGGTGCTTCGGACCGGGTGACCACGGATCCAGT | CTGCACGT | CTGGTG | LPGPSRVSPGPSRPSP |
| | | | | GCCTGCTCCAGTTCCTGAATCTCCTGGGCTGCTGCCTGGGCTACCTGGAC | GGTCCCTG | AGCGAC | GKPTGPPSLDAGPLP |
| | | | | CATCGCTGCCTGGGTGCTCGGACCTGCCGCCTGGGGTGCTGCCTGGAG | CCGCCTGC | CCAAGC | GPSRVSPGPSRPSPG |
| | | | | GGTGGTCTGCATCACCTGGGCCTCTCTCCTGGCCTCCTTCCCTGGATGCC | CAGTATGC | AAGGCG | KPPGTPEPLPGSPGG |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGGCCTCTGCCTGGACCTTCAAGAGTATCACCTGGACCTTCAAGACCTTC | CGAGGAA | GAGCCA | RRGVSPGQPGSRTD |
| | | | | GCCCGGGAAGCCGACCGGGCCTCCTTCCCTGGATGCCGGGCCTCTGCCT | ACGGGTGC | AGACCA | PSSSAGAGHFVCPQC |
| | | | | GGACCTTCAAGAGTATCACCTGGACCTTCAAGACCTTCGCCCGGGAAGC | AACTTAAT | AGCTGG | SRAFSSKIGMSQHQK |
| | | | | CGCCCGGGACGCCTGAGCCGCTGCCTGGATCTCCTGGCGGTCGGCGCG | CCGTGGAT | AGCCAA | HAHLEEYNAGINITRT |
| | | | | GGGTGTCCCCGGGACAGCCCGGGTCACGGACCGACCCCTCAAGCTCTG | ACTGGTAG | GAGCAA | KARWDPEETYLLARL |
| | | | | CTGGCGCCGGACACTTCGTATGCCCGCAGTGCAGCAGAGCCTTCTCAAG | CAACGTGA | CTCCAG | EATLNPDHKNINQTL |
| | | | | CAAGATTGGCATGTCTCAACACCAAAAACATGCCCACCTCGAAGAATAC | GCAACGGT | GAGGCA | HAALPRGSCRTLESIK |
| | | | | AACGCGGGCATTAACATCACCCGTACCAAAGCCCGGTGGGACCCCGAG | ACGGTCCT | GGGGTG | AHRKQAAYRDLVTSL |
| | | | | GAGACCTATCTTCTGGCCCGCCTGGAGGCCACCCTCAACCCAGACCACA | TCGCGGAC | GATATC | RSARESSEAQHVPDR |
| | | | | AGAACATCAACCAGACGCTGCACGCCGCGCTGCCCCGCGGTTCCTGTCG | CACCCTGG | AAGAGC | PLETPEPQTPANPQR |
| | | | | AACCCTGGAGAGCATCAAGGCCCACCGAAAGCAGGCGGCTTACAGGGA | GCGTTCGG | AACCCC | DSKQAVIEALQSLIGR |
| | | | | CCTGGTGACGAGCCTGCGGTCAGCCAGGGAGAGCAGCGAGGCGCAGC | GTTGCCAG | AAGGGA | APPGSFQGARLWDI |
| | | | | ACGTTCCGGACCGGCCCCTGGAGACCCCGGAGCCCCAGACACCAGCGA | CCCGTTCG | CACAGA | ARQATRGTNILPLLN |
| | | | | ACCCTCAAAGAGACTCGAAGCAGGCAGTCATCGAAGCGCTGCAATCCCT | CCCGAAAT | CCACGG | SYLRDVFTLPTKPTRK |
| | | | | CATCGGCCGAGCACCACCAGGCTCCTTCCAGGGAGCGCGTCTCTGGGAC | ATCTTGGC | GCAACT | KPAVRPARSRRKQKK |
| | | | | ATCGCGAGGCAAGCCACAAGGGGGACGAACATCCTCCCACTCCTGAAC | CCTGAAAC | ACTGGT | QEYARTQDLFRKKQS |
| | | | | AGCTACCTGAGGGATGTTTTCACCCTCCCCACAAAGCCAACAAGAAAGA | TAAAAGAA | GAGCGC | DCARAVLDGPTSSSV |
| | | | | AACCTGCAGTGCGGCCCGCCCGGAGCCGCAGAAAACAAAAGAAACAAG | AA (SEQ ID | CCAAGA | PGTGAFLQTWREIM |
| | | | | AGTATGCCAGAACACAAGATCTATTCAGGAAAAAGCAGTCCGACTGTGC | NO: 1213) | CAGGGG | TGPSPALEAPPLPTR |
| | | | | CAGGGCGGTCCTGGACGGCCCCACGTCGTCATCGGTCCCTGGAACGGG | | TGGATA | GEVDLFFPATAQEIQ |
| | | | | CGCCTTCCTGCAAACCTGGCGAGAGATCATGACGGGGCCCAGCCCTGCA | | TTAAGA | SAEIAVNSAAGPDGF |
| | | | | CTCGAGGCACCGCCTCTACCTACCCGGGGGGAAGTCGACCTGTTCTTCC | | ACAGCC | SARLLKSVPALLLRVM |
| | | | | CGGCGACGGCGCAAGAGATCCAGAGCGCTGAGATAGCCGTCAACTCGG | | CCACAA | VNLLLLVRRVPAALR |
| | | | | CTGCTGGACCCGACGGGTTCTCAGCCCGTCTCCTCAAGTCCGTCCCGGC | | AGTGTT | DARTTFIPKVPDAVD |
| | | | | CCTCCTCCTAAGGGTCATGGTTAACCTTCTGCTCCTCGTCCGACGTGTCC | | ACCTATA | PSQFRPITVASVLQRL |
| | | | | CGGCGGCCCTCCGGGACGCGAGAACGACCTTCATCCCGAAGGTCCCCG | | TTAACA | LHRILAKRALEAIPLNF |
| | | | | ATGCAGTGGACCCCTCCCAATTTCGCCCAATAACGGTGGCCTCCGTTCTC | | ATAAAG | RQRAFQPVDGCAEN |
| | | | | CAGCGCCTACTACATCGCATCCTGGCCAAGAGGGCGCTGGAGGCCATTC | | TTGAAG | IWLLSTALNEARTRR |
| | | | | CCCTCAACTTTCGACAAAGAGCCTTTCAGCCGGTGGATGGCTGTGCCGA | | CCTCAAC | RPLHMASVDLTKAFD |
| | | | | GAATATATGGCTGCTGTCCACCGCGCTCAACGAGGCAAGAACCAGACG | | CACGCA | RVTTDAILRGARRAG |
| | | | | GCGCCCGCTACACATGGCGAGCGTCGACCTAACCAAGGCATTCGACCG | | TTGCGG | LSGEFIGYLKELYTTSR |
| | | | | GGTCACCACGGATGCCATCCTGAGGGGCGCAAGGCGCGCCGGGCTGTC | | GTTAGA | TLLQFQGESLLVEPTT |
| | | | | CGGGGAGTTCATCGGATACCTGAAGGAGCTCTACACAACATCCAGGAC | | TGGCGT | GVRQGDPLSPILFNL |
| | | | | CCTCCTGCAGTTCCAGGGAGAGAGCCTGCTTGTCGAACCCACGACCGGC | | GGCTTG | VLDEYLSSLDPDISFVS |
| | | | | GTGCGACAGGGCGACCCACTGTCGCCCATCCTCTTCAACCTGGTCCTGG | | GCCCGC | GDLRLDAMAFADDLI |
| | | | | ACGAGTACCTCTCCTCCCTGGACCCGGACATCTCCTTCGTCTCGGGCGAC | | CGCCAT | VFASTPAGLQDRLDA |
| | | | | TTGCGCCTCGATGCGATGGCATTCGCTGACGACTTGATCGTCTTTGCCTC | | GATGAG | LVEFFDPRGLRVNVK |
| | | | | AACCCCAGCCGGCCTGCAGGATCGGCTCGATGCCCTCGTCGAGTTCTTC | | CTGGAA | KSFTLSLQPGRDKKV |
| | | | | GACCCAAGGGGGCTCAGGGTGAACGTGAAGAAGAGCTTCACGCTATCG | | CCCTCCA | KVVCDQIFTIGGTPLP |
| | | | | CTGCAGCCGGGACGAGACAAGAAGGTCAAGGTGGTGTGTGACCAGATC | | CCTGGT | ASKVATPWRYLGMT |
| | | | | TTCACCATCGGAGGAACCCCACTCCCAGCCTCCAAGGTCGCAACCCCTT | | GGGCCG | FTPQGSINKGTSEQL |
| | | | | GGCGCTACCTGGGGATGACCTTCACCCCCCAGGGCTCAATCAACAAGG | | CACGAG | DLLLTRTSKAPLKPQQ |
| | | | | GCACCAGCGAGCAGTTGGACCTACTGCTCACGAGAACCAGTAAGGCCC | | ACCACC | RLVVLRNYLLPRLYHR |
| | | | | CCCTCAAGCCACAACAGAGGCTGGTGGTCTTAAGAAACTACCTGCTCCC | | GGCTCT | LVLGPWSAALLLKM |
| | | | | GAGGCTATACCATCGCCTCGTGCTTGGACCTTGGTCGGCCGCCCTCCTAC | | TTCTACT | DTTIRGAIRRWMDLP |
| | | | | TGAAGATGGACACCACCATTCGAGGAGCCATTAGACGCTGGATGGATC | | AAGGCC | HDTPLGFFHAPVTEG |
| | | | | TCCCGCACGACACACCGCTGGGTTTCTTCCACGCCCCAGTAACGGAGGG | | GGTCTC | GLGINSLRASIPAMVL |
| | | | | AGGCCTAGGAATCAACTCCCTGCGAGCATCAATTCCAGCCATGGTGCTC | | CGTGAC | QRLDGLHFSTHPGAE |
| | | | | CAACGGCTGGATGGACTTCACTTCAGCACGCATCCCGGAGCTGAGGTCG | | TGCGGT | VAIQLPFLTGLHRRAE |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCATCCAGCTGCCGTTCCTGACAGGACTCCATCGAAGAGCGGAAGCGG<br>CGGCCCAATACCAGGGACAGAGACTACTGTCCAAAGCGGACGTCCACC<br>GGATGTGGAGCGCAAGACTCCACGGGAGCTGCGACGGAAGACCCCTTC<br>GGGAGTCCAAGAGAGTGCCGGCTGCCCATCGTTGGGCCGCGGAAGGC<br>ACCAGACTACTCTCGGGAAGGGACTTCATCTCGATCACGAAACTCAAGA<br>TAAACGCGCTACCTACACTCGAGCGCACCAGCCGGGGCCAGCACAAGG<br>ACATCCAGTGCAGAGCTGGCTGCCAGGCTGTTGAATCCCTGGGCCACGT<br>CCTACAAGCTTGCCATCGAGGACACCGTGGCCGAATCCGGCGGCATGAT<br>AACATTGCCCGCTACGTCTGCGGCCGACTGACCCAGATTGGCTGGGCGG<br>TGAAGTGGGAGCCCCACTACTCTGTCGCTGGAAGGACCCTCAAACCTGA<br>CATCGTTGCCCATCGTGGAGCCGAGACTGTCGTGCTCGACGCCCAGGTC<br>GTCGGCACCAGCATGCGACTGGGCTTCCACCACGCTCAAAAGAAAGAA<br>AAGTACTCTCTCCCAGACCTCCTCCACCAAGTCTGCGAGGGACGGAGAG<br>ACGCAGCCCGGGTGTCAACAATCACCCTCAATTTTCGAGGTGTTTGGGC<br>ACCTGAGAGCGCCCAGGACCTGAAGTCCCTGGGCCTGACGGACAACGA<br>CCTAAAGCTTCTCACCGTCCGCTGCCTCCAGGGCGGCGCGCAGTGTTTC<br>CGGCTGCACCGCCGAATGACCACCGTGGTGAAGGCCACGGGCGATGAA<br>GCCAACGCCCTCCCCGCCCATTCGGGCTTGCCGCCAACACAGCTTGGTG<br>GCCGAACCCTGGGTCCCTCTGCCCACAATCAGAGTGCAAGAACTACTTA<br>GTGTGACGGAGTCCTCAAGCCCCCACAAGTGCCTGCCAGGTGGCAGGA<br>AAGGGCAACTACTGGTGAGCGACCCAAGCAAGGCGGAGCCAAGACCA<br>AGCTGGAGCCAAGAGCAACTCCAGGAGGCAGGGGTGGATATCAAGAG<br>CAACCCCAAGGGACACAGACCACGGGCAACTACTGGTGAGCGCCCAAG<br>ACAGGGGTGGATATTAAGAACAGCCCCACAAAGTGTTACCTATATTAAC<br>AATAAAGTTGAAGCCTCAACCACGCATTGCGGGTTAGATGGCGTGGCTT<br>GGCCCGCCGCCATGATGAGCTGGAACCCTCCACCTGGTGGGCCGCACG<br>AGACCACCGGCTCTTTCTACTAAGGCCGGTCTCCGTGACTGCGGTTGGG<br>ATAAACTCCAAGCACTGAGCGGTAAAAAAAAAAAAAAAAAAAAAAAAA<br>AA (SEQ ID NO: 1090) | | TGGGAT<br>AAACTC<br>CAAGCA<br>CTGAGC<br>GGTAAA<br>AAAAAA<br>AAAAAA<br>AAAAAA<br>AAAAAA<br>(SEQ ID<br>NO:<br>1336) | AAAQYQGQRLLSKA<br>DVHRMWSARLHGS<br>CDGRPLRESKRVPAA<br>HRWAAEGTRLLSGR<br>DFISITKLKINALPTLE<br>RTSRGQHKDIQCRA<br>GCQAVESLGHVLQA<br>CHRGHRGRIRRHDNI<br>ARYVCGRLTQIGWA<br>VKWEPHYSVAGRTL<br>KPDIVAHRGAETVVL<br>DAQVVGTSMRLGFH<br>HAQKKEKYSLPDLLH<br>QVCEGRRDAARVSTI<br>TLNFRGVWAPESAQ<br>DLKSLGLTDNDLKLLT<br>VRCLQGGAQCFRLH<br>RRMTTVVKATGDEA<br>NALPAHSGLPPTQLG<br>GRTLGPSAHNQSART<br>T (SEQ ID NO: 1458) |
| R2 | R2-<br>1_MLe | — | *Mnemiopsis*<br>*leidyi* | TGGGGGCCCCTTGGACTTGCTCCCTGGGGCAGGACACCAGTGAAAGGA<br>GATCCTCAAGACAGGACAGAGAGACAGGCACACCAACCCTTCGAACCT<br>GAGGAGACACCCAGATCTGGTTACCCCATTCCTGTAACCATGGTTGCTCT<br>CCGTGCGCTGTTAAGGAAACCCAGCCTAGTACCCTCGGGGAAAGGTTG<br>CGTAGTACTTAGCAGTGTGCGGATCAAACCTCTACCGGTCTCTCTAGCG<br>ATGAAAGTTTCTCCGACTGGAACTTGAGGGACTGGCTAGCCCAGCTAGC<br>CTGTAGAGCAATGCGTATACGATGCCTTGGCGACAATGGCGACCGCTGC<br>TTAGCAGACGGAGGTTAGTGAAAGGGCGACTTGCTGTTCATAGTCACGT<br>GAGTCGTCTAGAAACTGCACCGATGCTGCCCTCTGTTCCAGGAGAAGGA<br>CAGTGGAGGACTAAATCGTAGCGCGAGCGGTGTTATGTCGAACACTAG<br>CCACTCGAAACTTAACCTCAAAATGGATAATAAACTCAAGACTAGTCTCG<br>AGACTCCCTCCGGAGTCCGAGCAGATTCGATAATAACGCGGGTGAGGA<br>CCAGCAGTAACCGTGGTGAACACAGCAATGGTGTCACGTATCCCCGGTG<br>CGAACAGGGGGTTGCGCCTCTGGATACGCATGGGGGGATATGTGACGC<br>TCCTCCACAGGTGACGGTTCCCGCCACTGAGACGGATAAACAGAAAAAA<br>TGTGAATACTGCGAGTTCACATACCTGAAACCGAGACAGATAGGAACCC<br>ACATGAGAAAACGGCATCCCCAGGAATGGAACGACATCAAACGGACCA<br>AATTCCTGAGCGAAAAGAGACAAAAACGTTGGCTTGACGAAGACTTCG<br>AGCTTCTCTGCATAGGCCAAGAGGAATACCTTGTGCTATCCTCGATTGG | TGGGGGC<br>CCCTTGGA<br>CTTGCTCC<br>CTGGGGCA<br>GGACACCA<br>GTGAAAG<br>GAGATCCT<br>CAAGACAG<br>GACAGAG<br>AGACAGG<br>CACACCAA<br>CCCTTCGA<br>ACCTGAGG<br>AGACACCC<br>AGATCTGG<br>TTACCCCA<br>TTCCTGTA<br>ACCATGGT<br>TGCTCTCC | TAGTGA<br>CGAGAA<br>AAGTCG<br>CTTTATC<br>CTTACAT<br>AACAGT<br>GTGATA<br>GTCATCC<br>TTATCAC<br>AACTGT<br>CCTGGC<br>GAACAA<br>AATGGC<br>AGAGGG<br>ATAGTA<br>CTCGGT<br>CCAACC<br>AGAAGG<br>AAGCCC | MSNTSHSKLNLKMD<br>NKLKTSLETPSGVRA<br>DSIITRVRTSSNRGEH<br>SNGVTYPRCEQGVA<br>PLDTHGGICDAPPQV<br>TVPATETDKQKKCEY<br>CEFTYLKPRQIGTHM<br>RKRHPQEWNDIKRT<br>KFLSEKRQKRWLDED<br>FELLCIGQEEYLVLSSI<br>GKQGKGINQYIQTKY<br>FPTLSTDAIKSQRKSR<br>RFSEYSEKRSRELQPC<br>NTSSDPEELPNEAVT<br>ENSPLSFDPLDRDVV<br>KKISSKDHGDQILLVQ<br>EHLINGRYQEANTLA<br>KAIFEKLSGKFPNLKT<br>GDHRPGKQQTARKV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAAACAGGGCAAAGGGATCAACCAGTATATTCAAACCAAGTACTTCCCA | GTGCGCTG | ACACGA | GKKRVRGSGKKLSPS |
| | | | | ACCCTTAGTACAGATGCTATTAAATCTCAAAGGAAATCCAGACGGTTTTC | TTAAGGAA | TGCCAA | KQNRRELYAIVQKQ |
| | | | | AGAGTACAGCGAAAAGAGATCACGTGAACTCCAACCTTGCAATACCAGC | ACCCAGCC | ACTTGCT | WRTKKRSKVINQILT |
| | | | | AGCGACCCCGAAGAACTTCCGAATGAAGCGGTCACCGAAAACAGTCCG | TAGTACCC | GTAACC | GNLNKEQSYTHTPD |
| | | | | CTCTCTTTTGATCCACTTGACCGAGATGTTGTAAAGAAAATAAGCTCCAA | TCGGGGA | CACGTG | QLAQFWSTLFGRVSP |
| | | | | AGATCACGGCGATCAGATCCTCTTAGTACAGGAGCACCTCATCAACGGA | AAGGTTGC | AGCGGA | RDDRPINHRRSVIPEL |
| | | | | CGGTATCAAGAAGCGAACACGTTGGCCAAAGCTATATTCGAGAAGCTCT | GTAGTACT | AAACAT | DKPLSVEEVEAALKG |
| | | | | CCGGTAAATTCCCGAACCTGAAGACCGGCGACCATCGGCCTGGTAAACA | TAGCAGTG | CCTCCG | AKDAATGIDGVPISH |
| | | | | ACAAACAGCAAGGAAAGTCGGTAAGAAAAGAGTTAGAGGAAGCGGTA | TGCGGATC | AGTATA | LKHLGSAALTILYNGL |
| | | | | AGAAGCTATCCCCCTCTAAACAGAATAGACGCGAGCTATACGCGATAGT | AAACCTCT | GTATGA | YVTGSIPDPWKRART |
| | | | | ACAAAAGCAGTGGCGCACTAAGAAAAGATCTAAGGTGATCAACCAGAT | ACCGGTCT | TGGAAG | ILIPKSNPPASPGDYR |
| | | | | ACTGACAGGTAATCTAAACAAAGAACAATCTTATACACATACACCCGAT | CTCTAGCG | GATACA | PISISSYFYRIYTSAISK |
| | | | | CAGCTAGCGCAATTCTGGAGTACGCTGTTTGGCAGAGTCAGTCCGAGA | ATGAAAGT | GGATGT | RLASAVSLDDRQKGF |
| | | | | GACGATCGACCGATTAACCACCGGCGGTCAGTTATCCCGGAGCTAGACA | TTCTCCGA | GGACCG | IKEDGIRDNLSLIDTLI |
| | | | | AACCCCTCTCTGTTGAGGAGGTCGAAGCTGCGCTCAAAGGGGCCAAAG | CTGGAACT | CTCTAG | NETKAGSKSLFMTF |
| | | | | ATGCTGCAACAGGCATTGACGGAGTCCCAATCTCCCACCTGAAGCACCT | TGAGGGA | GCGGCG | MDVKKAFDSVSHYAI |
| | | | | AGGCAGTGCAGCTCTAACAATCTTGTACAACGGATTGTATGTGACCGGG | CTGGCTAG | GACGGT | ARSLEWAGVPDGM |
| | | | | TCGATTCCTGACCCCTGGAAAAGAGCAAGAACCATACTGATCCCAAAGT | CCCAGCTA | GTAGAC | RSVIADLYQDCTTDIC |
| | | | | CAAATCCACCAGCTTCACCTGGGGATTATAGACCTATCTCGATCAGCTCG | GCCTGTAG | GGCGAC | GRSVKVTRGVKQGD |
| | | | | TATTTCTATAGAATCTACACGAGCGCGATCAGCAAAAGACTTGCTTCTGC | AGCAATGC | CTTACCA | PLSSTLFNLVIEMVM |
| | | | | CGTCAGCCTTGACGACCGTCAGAAAGGATTCATCAAAGAAGATGGAAT | GTATACGA | TAGCTG | SNVPERLGIQFQGHR |
| | | | | ACGAGACAACTTATCATTGATTGATACTCTCATCAATGAGACGAAAGCA | TGCCTTGG | CGACTG | LFYLAFADDLVLLTRG |
| | | | | GGCTCGAAATCCCTATTCATGACCTTCATGGACGTCAAGAAAGCTTTCG | CGACAATG | CTGTGC | PTANQKLVSLVHEQL |
| | | | | ACTCCGTGTCGCATTACGCAATTGCCAGATCTCTAGAATGGGCTGGCGT | GCGACCGC | GATCCG | ARVGLELHPGKCKSIA |
| | | | | CCCCGATGGAATGAGAAGTGTCATAGCCGATCTATACCAGGACTGCACC | TGCTTAGC | GAACGG | IMADPKRKTTFVDQ |
| | | | | ACTGATATCTGCGGCAGATCCGTCAAAGTGACCAGAGGCGTGAAGCAG | AGACGGA | GCCTTTC | GSSVLIGGEPVSSLGP |
| | | | | GGAGACCCCCTAAGCTCCACTCTGTTCAACCTGGTAATAGAAATGGTGA | GGTTAGTG | TCACTTA | QEWYKYLGIKLGSGG |
| | | | | TGTCAAACGTCCCCGAACGTTTGGGAATTCAATTCCAGGGACACAGACT | AAAGGGC | CCTCAA | MPQGIYRDQLADLLA |
| | | | | GTTCTATCTGGCTTTTGCAGACGACCTAGTCCTCCTGACGAGAGGACCC | GACTTGCT | GCACCG | KTDSAPLKPQQRLYIL |
| | | | | ACAGCTAACCAGAAGCTAGTATCCTTAGTCCATGAACAACTAGCAAGAG | GTTCATAG | TGTCGG | RSHILPKFNHRLMFE |
| | | | | TTGGACTTGAGCTACATCCGGGAAAGTGCAAGTCAATCGCTATCATGGC | TCACGTGA | ATCGCG | RVTCQTLEGLDKLIRT |
| | | | | TGACCCCAAGAGGAAAACCACTTTCGTAGATCAGGGATCCAGTGTTCTC | GTCGTCTA | GGGTGG | HVRKWLKLPKDTPG |
| | | | | ATTGGAGGCGAACCCGTCTCTTCGCTCGGTCCGCAAGAATGGTACAAAT | GAAACTGC | GCGCGG | PAFYADKGSGGLGLI |
| | | | | ACCTTGGGATTAAACTGGGATCAGGAGGCATGCCCCAGGGTATTTACCG | ACCGATGC | GATTCCT | TLRYRVPLLKLRRHKK |
| | | | | AGACCAACTAGCAGACCTTCTAGCGAAGACAGACAGTGCCCCCCTGAAA | TGCCCTCT | GCTGGG | MADSPDPVIRLIPNA |
| | | | | CCCCAACAAAGATTGTATATACTCAGATCGCATATACTACCGAAGTTCAA | GTTCCAGG | AAGTTG | EPTISLLARWTKMCS |
| | | | | CCATAGACTAATGTTCGAGAGAGTAACGTGCCAAACACTAGAGGGTCTT | AGAAGGA | TCTGCAC | LYGKQYQHKSELSKII |
| | | | | GACAAACTGATCAGGACCCACGTCAGAAAGTGGTTGAAATTACCCAAA | CAGTGGA | CCAAGT | RDKYWTMCDGKGLR |
| | | | | GACACGCCTGGTCCAGCCTTCTACGCTGATAAAGGTTCAGGCGGACTCG | GGACTAAA | CGTCAG | TEVPPDTAKKTLSLLF |
| | | | | GACTGATAACTCTCAGATACCGAGTTCCCCTCCTAAAACTTAGGAGACAC | TCGTAGCG | CTAACT | EDRTPLKPGQLIGAIG |
| | | | | AAAAAGATGGCGGACTCACCTGATCCCGTTATCAGGTTGATACCAAACG | CGAGCGGT | GTCGGT | VRLNTLGTPARNNRA |
| | | | | CGGAACCGACCATCTCCTTGTTAGCTAGATGGACCAAGATGTGCTCCCT | GTT (SEQ | ACTTATA | KGYSPEANICDKCPG |
| | | | | CTATGGCAAACAGTACCAGCACAAGTCCGAACTCTCTAAGATAATTAGA | ID NO: | CGCACC | NRQATLGHISQTCPA |
| | | | | GATAAATACTGGACAATGTGCGACGGGAAAGGCTTGAGGACAGAGGT | 1214) | CAGAGC | THGRRVKRHDKIVNR |
| | | | | GCCACCAGATACGGCTAAGAAAACACTAAGCCTGCTATTCGAGGACCG | | CATGCTC | IAKALKERGSVKNILT |
| | | | | GACTCCACTCAAACCAGGACAACTAATTGGAGCTATCGGGGTCCGCCTA | | TTACCA | EPHLRHDKLPLRKPD |
| | | | | AATACCCTTGGTACCCCCGCTCGTAACAATCGAGCTAAAGGCTACAGTC | | GGCCAC | LIVHTEKSVEIIDVQV |
| | | | | CTGAGGCTAATATTTGTGACAAATGTCCAGGCAACAGGCAGGCCACTCT | | TTGACG | VADQGISRHEDEDQ |
| | | | | TGGCCACATCTCGCAAACTTGTCCGGCGACTCACGGGAGGAGAGTCAA | | GCGCTA | QKKIVKYDVDGYKRA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACGACACGACAAGATTGTGAACAGAATCGCAAAAGCTCTAAAAGAACG<br>AGGCTCCGTCAAGAACATACTTACCGAACCCCACCTCAGGCACGATAAA<br>CTGCCCCTACGGAAACCCGACCTAATAGTACATACGGAAAAGTCGGTCG<br>AAATCATTGATGTCCAGGTCGTTGCAGACCAGGGCATCTCGAGGCACGA<br>AGATGAAGACCAACAAAAGAAGATCGTCAAATATGACGTGGATGGATA<br>CAAGAGAGCGGCCTACAAAATGCTAGGGATTGACTACGGGAGCATCCC<br>CTGCAATGTAAGTGCGTTCACTATCACCTGGCGAGGAAACCTTGCCCCC<br>CATTCACTCAAACTGGCGAGTCGTCTCCAGTTTTCACCCGTGCTCAAATA<br>TATCGTGGCTGACTCCCTAGTTGACACATGGGGTGCGTTCCTGATATGG<br>GGAAAGACGTCTTAGTGACGAGAAAAGTCGCTTTATCCTTACATAACAG<br>TGTGATAGTCATCCTTATCACAACTGTCCTGGCGAACAAAATGGCAGAG<br>GGATAGTACTCGGTCCAACCAGAAGGAAGCCCACACGATGCCAAACTT<br>GCTGTAACCCACGTGAGCGGAAAACATCCTCCGAGTATAGTATGATGGA<br>AGGATACAGGATGTGGACCGCTCTAGGCGGCGGACGGTGTAGACGGC<br>GACCTTACCATAGCTGCGACTGCTGTGCGATCCGGAACGGGCCTTTCTC<br>ACTTACCTCAAGCACCGTGTCGGATCGCGGGGTGGGCGCGGGATTCCT<br>GCTGGGAAGTTGTCTGCACCCAAGTCGTCAGCTAACTGTCGGTACTTAT<br>ACGCACCCAGAGCCATGCTCTTACCAGGCCACTTGACGGCGCTACACCG<br>GTCTGTAGGAGGGTATCTCAGCGACTTGGACAAAATGGATCTTGACTGC<br>CTGAGGGCGCTTATCGAGTGACCCAGAGTAAGCTGGTAGGAAGAATCT<br>TGCAGTTGAGAGGGCTAGTAGGGCCAGCCTCTGCTCGTCAACTGTCCTA<br>GGCGTTAACGTGTGCCTCCCTATGAGGTAACCGTGAAGTATTACTTGTTT<br>CCCTGTAGAGACCATATAACTAGCTGAGAAACGCCCTGCGGGTTAATAT<br>ACAGTTACCGCCGTCCTGCATCCCCGAGTTGTGACCAGCGTACAGCCAT<br>GTACCACGGCACTTCCAGCATTCTCTGGTCTAAGAATGTATCAGCTGGCC<br>CGCCGAAAGATAGAGCGACCCCGCCTCTATCACTAGAGTAAGCAGGCA<br>CGCGAAATATATGCAGGACGCCTTGGCTCAGTAGCTCTGGTACTGAGTA<br>TAGCATGGCTGAACGCCCCTTTAAGTTCGGTGGCCCAGAGACTCTCCGA<br>GACTTCCCAGTCCTGGAGAGGGTACACCTTTACCAGAACTTTCTGTGGTC<br>GGTTG (SEQ ID NO: 1091) | | CACCGG<br>TCTGTA<br>GGAGGG<br>TATCTCA<br>GCGACT<br>TGGACA<br>AAATGG<br>ATCTTGA<br>CTGCCT<br>GAGGGC<br>GCTTATC<br>GAGTGA<br>CCCAGA<br>GTAAGC<br>TGGTAG<br>GAAGAA<br>TCTTGCA<br>GTTGAG<br>AGGGCT<br>AGTAGG<br>GCCAGC<br>CTCTGCT<br>CGTCAA<br>CTGTCCT<br>AGGCGT<br>TAACGT<br>GTGCCT<br>CCCTATG<br>AGGTAA<br>CCGTGA<br>AGTATT<br>ACTTGTT<br>TCCCTGT<br>AGAGAC<br>CATATA<br>ACTAGC<br>TGAGAA<br>ACGCCC<br>TGCGGG<br>TTAATAT<br>ACAGTT<br>ACCGCC<br>GTCCTG<br>CATCCCC<br>GAGTTG<br>TGACCA<br>GCGTAC<br>AGCCAT<br>GTACCA | AYKMLGIDYGSIPCN<br>VSAFTITWRGNLAPH<br>SLKLASRLQFSPVLKYI<br>VADSLVDTWGAFLI<br>WGKTS (SEQ ID NO:<br>1459) |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | CGGCAC TTCCAGC ATTCTCT GGTCTA AGAATG TATCAG CTGGCC CGCCGA AAGATA GAGCGA CCCCGC CTCTATC ACTAGA GTAAGC AGGCAC GCGAAA TATATGC AGGACG CCTTGG CTCAGT AGCTCT GGTACT GAGTAT AGCATG GCTGAA CGCCCCT TTAAGTT CGGTGG CCCAGA GACTCTC CGAGAC TTCCCAG TCCTGG AGAGGG TACACCT TTACCA GAACTTT CTGTGG TCGGTT G (SEQ ID NO: 1337) | |
| R2 | R2-1_PM | — | *Petromyzon marinus* | CTATTAATGGGATGAAGAAGGGGGACACGAGTTTGTGTGTGCATCCAG TTTCCATGGTGCATGCAGGAGTGGTGGTTTAAATGGCGAGACTCTACAG GGCTTCCATGGCTACACGGGATGCAAGGCATCAGACATTTTGGCACAG GCAATCCTTTTGGTCTCTACCGCAATCATGTCTTAGACCTCAGTAGCGAC CACTACAACCACAGTGGTGACTGCTGTTGAGTGAAGGACGACTGAGCG CTGGATAACAACTTTCTTGCGTGGCCCAACATCGAAGCAACCACTTCGG | CTATTAAT GGGATGA AGAAGGG GGACACG AGTTTGTG TGTGCATC | TAATTTA AGGTAA AATCGT GGGATT GTTTTGA TGGCAA | MNERLTDELTTEFILS DMFLWDYPCTDQN KCYPCNLVFLDHRTW SSHMARVHPHANKT YKCRICNRTADSIHKI ASHYGRTCKSLIGKTN |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGCTGGCACAAGGCAAGAGGGCAGCCCAAGGTGTGAATCATCTCAACT | CAGTTTCC | TCTGCCT | AITTTIDETLFSCLHCS |
| | | | | TCACTGCAGGAAGAAATGCTGTGCAAGGATGAGTGTGAACGACACCAA | ATGGTGCA | AGTCGC | RGFTTKTGLGVHTRR |
| | | | | CGGGATTGTTGCTGACCAGGAGGTGCCAACCAAATTTGAATGGATTGAC | TGCAGGA | GGCCTT | THPTEHEAILQQNTP |
| | | | | TTTGGGCCTGGTTTCTCCTGCGTGTATTGCACGGAAAAACAAGTGGCTA | GTGGTGGT | CCATTTT | GRKVRWGEEEVEIM |
| | | | | CACGTGTGGCCGTCGTGTCCTGGGGTTTCGCAACACAACTCCACAAGAT | TTAAATGG | GGGTAG | AHKEAQQKDEDINM |
| | | | | CGACAACTATGAGGATGACAATGTACTTAAAGAACAAAGAGACTGACG | CGAGACTC | GCAGCA | NQLIQNSVMPHRTLE |
| | | | | CCAAAGGGGATTTAAACCGCCAAATCGTACATTGGGTCTCACTACAATT | TACAGGGC | GACCCA | AIKGKRRNIKYKELVR |
| | | | | TTTTTACGTGTATTTATTTTCCTAAGTGTCTGTACTTGCCATTCTTCGCTGC | TTCCATGG | TCTATAT | TLKETTYKVENQCLV |
| | | | | TTTTTCTGCATTAATTGCATATCGTATGCAAATAAGCGAATTAACCACCA | CTACACGG | AACAAA | NLVLPTTSEITTTPSE |
| | | | | CCGTGCAACTATATGCAGATGTTACAGCTGAGCCCTCTATCATACCGGT | GATGCAAG | CTACTTT | GDQPAIRAEKEQSPT |
| | | | | GTACTAATCTGGTATGGTGTTGGCATGCTATGCTTGCGTAACGACCTTTG | GCATCAGA | GCCTTTC | AAEDLQVIINDLKSQ |
| | | | | CTGATTGGTTCAGTCGGCTGATGGTGGGTTCAGGCGAAACATTTGTATA | CATTTGG | ATAGGG | NFSHNQALLLLNSHV |
| | | | | TTGGTTTAATCAAACCGAAACACTAAAATTTTGAACACAGTTTTCCATTA | CACAGGCA | GTACCC | EKFLNRSKPIKRKDHV |
| | | | | CACCAGTTGTATTGCTAGAAGTGCAAATCGAAGGAGTCAATTTTGACCG | ATCCTTTT | GACCCT | NQQEIDENRHRRQS |
| | | | | ACGATTAGCTGCCGATGTGCGGTGAAAAAGCTGATCACAATAGCATACA | GGTCTCTA | ACCAAC | KQTKYRRYQYLYHTN |
| | | | | CTTGGGCCGACAACCCCGTGTGCTATAAACGTAAGTCGCGAATTATAAA | CCGCAATC | TTTCGG | KKALLDEITSDRSGPSI |
| | | | | GAAAACAAACCGGACGGACTACTCGGTGACGAACTAACATCGCTCATG | ATGTCTTA | TTTCGG | YPTEESIRGTFVTLFES |
| | | | | AATGAGCGATTAACAGACGAGCTGACTACGGAATTTATCCTTTCGGACA | GACCTCAG | GGAAGT | NSPPDNIPSKLKNDQ |
| | | | | TGTTTTTATGGGACTACCCATGCACAGATCAGAACAAATGTTATCCATGC | TAGCGACC | AAAAGA | SCIDIVKAITLDELIKTL |
| | | | | AATCTTGTTTTCCTAGACCACAGAACTTGGTCATCACATATGGCACGGGT | ACTACAAC | AA (SEQ | AIMKDKSPGQDNITL |
| | | | | ACATCCACATGCAAACAAAACGTATAAATGTCGAATTTGTAATCGCACA | CACAGTGG | ID NO: | SDLRTLPIKYLLDILNII |
| | | | | GCAGATAGCATACACAAGATAGCGTCACACTACGGAAGAACTTGCAAA | TGACTGCT | 1338) | LYIQDIPQIWKQHRT |
| | | | | AGTTTAATAGGTAAAACTAATGCTATAACCACCACAATTGATGAAACACT | GTTGAGTG | | RLIPKTKEELEKPSNW |
| | | | | ATTTAGTTGTTTACATTGCAGCAGAGGTTTTACTACGAAAACAGGTTTAG | AAGGACG | | RPITISSIVIRLLHKILSY |
| | | | | GGGTACATACTAGACGAACTCATCCGACAGAACATGAGGCTATACTACA | ACTGAGCG | | RLGQQLKLNYRQKAF |
| | | | | GCAAAACACACCAGGAAGGAAAGTTAGATGGGGAGAAGAAGAGGTAG | CTGGATAA | | LPVDGCFENSALLHFI |
| | | | | AAATTATGGCCCATAAAGAAGCCCAACAGAAGGATGAGGACATAAACA | CAACTTTC | | IHNARQKHENTQIVSI |
| | | | | TGAATCAACTAATACAGAACTCAGTTATGCCACACAGAACGCTAGAAGC | TTGCGTGG | | DLSKAFDSVSHESIIR |
| | | | | GATTAAAGGGAAGCGGAGAAATATCAAGTATAAGGAATTGGTAAGGAC | CCCAACAT | | ALNRFNLSKESITYLT |
| | | | | TTTGAAAGAAACTACCTATAAGGTAGAAAATCAATGCCTTGTTAACTTAG | CGAAGCAA | | NIYKCNLTDIVFGSTI |
| | | | | TTTTACCGACAACATCGGAAATAACAACTACACCTTCGGAAGGAGATCA | CCACTTCG | | MRNINLKRGVKQGD |
| | | | | GCCAGCAATAAGGGCCGAAAAAGAACAATCACCGACAGCAGCTGAGGA | GAGCTGGC | | PLSPLLFNMIMDELL |
| | | | | TCTTCAGGTCATAATTAACGATCTAAAGAGCCAGAATTTTAGCCACAATC | ACAAGGCA | | DNLPTYIGVNVGNQ |
| | | | | AGGCGTTACTGCTACTCAATTCTCATGTAGAAAAGTTTTTAAATCGAAGT | AGAGGGC | | KVNSMMFADDLILF |
| | | | | AAACCAATTAAAAGGAAAGATCACGTAAACCAACAGGAGATAGATGAG | AGCCCAAG | | AETECGMNKLLDITT |
| | | | | AATAGGCATCGAAGACAATCAAAGCAAACTAAATACAGGAGATATCAA | GTGTGAAT | | KFLDDRHLKININKCN |
| | | | | TATTTATACCATACGAACAAGAAAGCTCTATTAGACGAGATTACTTCAGA | CATCTCAA | | SLRFIKYGKqKTFSVA |
| | | | | TAGATCGGGGCCAAGTATATACCCAACTGAGGAAAGCATACGGGGAAC | CTTCACTG | | TTSSYFINNEPINPVS |
| | | | | ATTCGTTACTTTATTCGAGTCAAACTCTCCTCCAGATAATATACCCTCTAA | CAGGAAG | | YVKGFKYLGIEFDPRG |
| | | | | ATTAAAAAACGACCAATCCTGCATCGATATCGTAAAAGCAATCACCTTA | AAATGCTG | | KRSISCNLLAAMLNKL |
| | | | | GATGAGTTGATTAAGACCCTAGCAATTATGAAGGATAAGTCACCTGGAC | TGCAAGGA | | TRAPLKPEKKVYLINN |
| | | | | AGGACAACATTACTCTTAGCGATCTTAGGACTTTACCAATAAAATATTTA | TGAGTGTG | | NLIPRIIHQLVLGKVT |
| | | | | CTAGATATCTTAAATATCATCCTTTACATACAGGATATACCACAAATATG | AACGACAC | | KGLLMSLDSEIRKTVK |
| | | | | GAAACAGCACAGAACAAGACTTATCCCGAAAACTAAAGAGGAATTAGA | CAACGGG | | LLLRLPHDTPDSFFYT |
| | | | | AAAACCCTCAAATTGGAGACCCATAACCATCTCATCAATTGTAATTAGGC | ATTGTTGC | | SVSNGGMGIRNLCD |
| | | | | TATTACATAAAATTTTAAGTTATCGTCTAGGACAGCAATTAAAGCTTAAT | TGACCAGG | | SVALSIINRHNKLITSD |
| | | | | TACAGGCAGAAAGCATTCCTCCCGGTAGACGGATGTTTCGAAAATAGTG | AGGTGCCA | | DLVIRALSQQSYTIAT |
| | | | | CATTACTACACTTCATCATACACAACGCCAGGCAAAAGCACGAAAACAC | ACCAAATT | | LKQAHIIAGSKFPSKS |
| | | | | GCAAATAGTGTCAATAGACCTCAGTAAGGCATTCGATTCTGTCAGCCAC | TGAATGGA | | LNQNKWSNKLYQTT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAATCGATTATTAGAGCCTTAAACCGATTTAACTTATCAAAGGAATCCAT | TTGACTTT | | DGRGLVYCQSQTEN |
| | | | | AACGTACTTGACCAACATCTATAAGTGTAATCTAACTGATATTGTATTTG | GGGCCTG | | NSWITGNHRTIKSYN |
| | | | | GATCGACAATAATGCGTAACATAAATCTAAAAGAGGCGTAAAGCAAG | GTTTCTCC | | YIDMVKLRINALPTKS |
| | | | | GAGATCCACTTTCACCGTTACTATTTAACATGATTATGGATGAATTATTA | TGCGTGTA | | RCNRGTLETKQCRFK |
| | | | | GATAACTTGCCGACATATATAGGAGTTAATGTAGGAAATCAGAAAGTAA | TTGCACGG | | CRSINNQISEETLAHIL |
| | | | | ATTCTATGATGTTTGCAGACGACCTTATCCTATTTGCAGAAACGGAATGT | AAAAACAA | | QKCDRSHYSRIARHD |
| | | | | GGCATGAATAAACTCTTAGATATAACTACTAAATTCCTCGATGACAGACA | GTGGCTAC | | SLVQFLATAAQKLN |
| | | | | CTTGAAAATAAATATAAACAAATGCAATTCGTTAAGATTTATCAAGTACG | ACGTGTGG | | WEVIKEPTLPSDTNK |
| | | | | GCAAACAGAAGACATTTAGTGTTGCAACGACATCATCGTACTTTATAAAT | CCGTCGTG | | AKPDLILVRDSHVLIV |
| | | | | AACGAACCCATTAATCCGGTATCATATGTAAAGGGATTCAAATATCTAG | TCCTGGGG | | DVAVPWESRSLAHA |
| | | | | GCATTGAATTTGACCCAAGGGGAAAACGATCTATAAGCTGTAACCTGCT | TTTCGCAA | | YDFKVKKYATDKKM |
| | | | | CGCAGCAATGTTAAACAAACTGACCAGAGCACCGTTAAAGCCAGAAAA | CACAACTC | | QAYLKTIYPEKEIRTEA |
| | | | | GAAAGTATATTTAATCAATAACAATTTAATACCTCGTATTATTCATCAATT | CACAAGAT | | LIISARGGWCALNN |
| | | | | GGTCCTCGGAAAAGTTACCAAGGGTTTATTGATGTCACTTGATTCTGAA | CGACAACT | | MVTKKVGLSSAWVK |
| | | | | ATTAGGAAAACAGTAAAGCTTCTGCTCAGGTTGCCACACGATACGCCCG | ATGAGGAT | | LALIKVMEGSVKIWR |
| | | | | ACAGTTTCTTTTATACATCAGTATCCAACGGAGGAATGGGTATAAGAAA | GACAATGT | | SWSKG (SEQ ID NO: |
| | | | | TTTATGCGACTCAGTTGCACTATCTATAATAAACAGACACAACAAATTGA | ACTTAAAG | | 1460) |
| | | | | TAACTTCAGATGATCTAGTAATAAGAGCATTATCACAACAATCATACACT | AACAAAGA | | |
| | | | | ATTGCAACGTTAAAACAGGCCCATATCATTGCAGGCTCCAAATTTCCTTC | GACTGACG | | |
| | | | | GAAATCTTTAAATCAGAACAAATGGTCAAATAAACTATATCAAACAACA | CCAAAGG | | |
| | | | | GATGGTCGGGGGTTGGTATACTGCCAATCTCAAACAGAAAACAATTCAT | GGATTTAA | | |
| | | | | GGATAACAGGGAATCATAGAACAATAAAATCGTATAATTACATAGACAT | ACCGCCAA | | |
| | | | | GGTTAAACTAAGGATTAATGCACTACCGACTAAATCGAGATGCAATCGA | ATCGTACA | | |
| | | | | GGGACGTTAGAGACCAAGCAATGTAGATTTAAATGTCGAAGTATTAACA | TTGGGTCT | | |
| | | | | ACCAAATTTCAGAGGAAACATTGGCACATATCTTGCAAAAGTGTGATCG | CACTACAA | | |
| | | | | CAGTCATTATTCAAGAATCGCAAGGCATGATTCTTTGGTGCAATTTCTGG | TTTTTTTAC | | |
| | | | | CAACGGCCGCACAAAAACTAAACTGGGAAGTGATCAAAGAACCCACTTT | GTGTATTT | | |
| | | | | ACCGAGCGATACAAATAAGGCAAAACCGGACTTAATTTTAGTAAGAGAC | ATTTTCCT | | |
| | | | | TCTCATGTCTTGATAGTAGATGTGGCAGTTCCGTGGGAGTCTCGATCATT | AAGTGTCT | | |
| | | | | GGCACATGCATACGATTTTAAGGTGAAAAAATACGCTACTGACAAAAAA | GTACTTGC | | |
| | | | | ATGCAAGCATATTTAAAAACTATATATCCGGAAAAAGAAATTAGAACGG | CATTCTTC | | |
| | | | | AGGCTTTAATCATATCTGCACGTGGGGGCTGGTGCGCTTTAAATAATAT | GCTGCTTT | | |
| | | | | GGTAACAAAAAAGGTGGGATTGTCAAGTGCATGGGTAAAATTAGCATT | TTCTGCAT | | |
| | | | | GATCAAGGTCATGGAGGGTTCCGTAAAGATATGGCGCTCTTGGAGCAA | TAATTGCA | | |
| | | | | AGGATAATTTAAGGTAAAATCGTGGGATTGTTTTGATGGCAATCTGCCT | TATCGTAT | | |
| | | | | AGTCGCGGCCTTCCATTTTGGGTAGGCAGCAGACCCATCTATATAACAA | GCAAATAA | | |
| | | | | ACTACTTTGCCTTTCATAGGGGTACCCGACCCTACCAACTTTCGGGGAAG | GCGAATTA | | |
| | | | | TAAAAGAAA (SEQ ID NO: 1092) | ACCACCAC | | |
| | | | | | CGTGCAAC | | |
| | | | | | TATATGCA | | |
| | | | | | GATGTTAC | | |
| | | | | | AGCTGAGC | | |
| | | | | | CCTCTATC | | |
| | | | | | ATACCGGT | | |
| | | | | | GTACTAAT | | |
| | | | | | CTGGTATG | | |
| | | | | | GTGTTGGC | | |
| | | | | | ATGCTATG | | |
| | | | | | CTTGCGTA | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | ACGACCTT TGCTGATT GGTTCAGT CGGCTGAT GGTGGGTT CAGGCGA AACATTTG TATATTGG TTTAATCA AACCGAAA CACTAAAA TTTTGAAC ACAGTTTT CCATTACA CCAGTTGT ATTGCTAG AAGTGCAA ATCGAAGG AGTCAATT TTGACCGA CGATTAGC TGCCGATG TGCGGTGA AAAAGCTG ATCACAAT AGCATACA CTTGGGCC GACAACCC CGTGTGCT ATAAACGT AAGTCGCG AATTATAA AGAAAACA AACCGGAC GGACTACT CGGTGACG AACTAACA TCGCTC (SEQ ID NO: 1215) | | |
| R2 | R2-1_SM | — | *Schmidtea mediterranea* | CAGTGCTATTCGAATGTCAATGTGAAGAAATTCAACTAAGCTCTGGTTA ACGGCGGGAGTAACTATGACTCTCTTAAGGAATTAAGAATTTACCTGCC KTAKTAAAARTGAAATCMGTTGTTCATWGCAAGTGGTATTGTACACCTT CCCGCGGTGCTAGTCGTTTAAAACTAAGTTACAAACCACGAGGGGCGTC CTGACGGACTGSAAAAGCATTGAGRGTCMTGAAGAGAGGCTCTTATTG TACGAATCTCTTCAACGATCGAAGTCTGGACCGATATGAGAACTAATAC ATTAGTTGACAGGTGAAAAATACTGTTGATTACTTAGTTCTCAGTCATGT GGTATATTGCCAGTCAATTACTACATWAATATTAGTGTGGCTCTCAAAG | CAGTGCTA TTCGAATG TCAATGTG AAGAAATT CAACTAAG CTCTGGTT AACGGCG GGAGTAAC | GGCCAC GCGCGT CGTCCTT GTTTGAT CACTAG TGGATC AACCTTC GACTCC | MKKVLNNETEKLPGS NLTFMCGFCDREFDT ARGRGVHESRGHLV ERDAAVQSRVKAVV SKKYYYSNEEDVALA KMQLXHADLAKSEXL EAMYLALGKGRTREA IEQHIRKSLRYKGVLE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAACACGATTGRTCGGCAGTCCAATGCGCGACTGGCGGGCTTGTTGTTT | TATGACTC | CCGGAA | EQRKLLETARGNVRQ |
| | | | | GCATTTGTTACCGGCTACTTGAAAAGGTTATATATAGCAGACGCTTAAA | TCTTAAGG | CTGTGG | NNVGVPASNATKNL |
| | | | | GCGCGACTGTAATTTACATYTCATTGCCCAGTATTTGTCTTTTGTCAGATT | AATTAAGA | GAGTGG | QRFLESLPLGTNRREE |
| | | | | TAGCAAAATTTCATATTTTGTTAATTACCTTAACTGGTTAAACGATCCCAT | ATTTACCT | CGGAAG | RLDRIIRSNSIESQRLE |
| | | | | AATTGCTTGCAATTATTATAAAGTAATTCAGGTAAAAATTACATATCTGG | GCCKTAKT | AAAGGC | LIHYCNDMCQDFVQ |
| | | | | CTGATCCTGCCAGTAGTCATTTTACTTCCGCCGCGCTATAAAACAGTTTA | AAAARTGA | CAGAGG | LDCQXNPINAIRRRN |
| | | | | AAAACTGAATAGGAATCAAAAAGAACATGGCAAGCGACTATATGTAAC | AATCMGTT | ATGTCCT | PKRLSKKQLKRAKFSA |
| | | | | TGGGCATTCAACATTCCCTATTACATATGGTGGTGCCTGGGGTCTGTTTT | GTTCATW | GAAACC | LQRLWIRDRKAAQL |
| | | | | ATATAATGGGTACCCGGGAAGTGGATCTGTATCACCAGTCATGGTGCCA | GCAAGTG | ATATATT | VLKDKLDSLLSNKEDS |
| | | | | TATCTTTKGATAAAGATACAGTTTAAAACTGCGATGATACTAATAGAGAT | GTATTGTA | TATTTAT | KDLGSYWQQVFERE |
| | | | | CCTCTTAGACCTTCGTAAAGAAGTGGGGATTGATGACATTAGCATTGGA | CACCTTCC | AGAAGT | SELDRRPIPQVVENEE |
| | | | | AGAATTAAATCTCCAAGGAAATGGAGTAACTTCAATGAAGTCCCACAAC | CGCGGTGC | TTTACTT | LNSPVLEKEVEWAVK |
| | | | | CCCGTTGAAGGGCTGGGTTCGAGTATCGAGAGAAAACTCTAAATTCTCT | TAGTCGTT | CATCCTA | NIKKSTAAGPDGLTA |
| | | | | TCGGTTMTGTCCAACGGAGGGGACATTACTGTAAAATATCCTCTAAAAA | TAAAACTA | TTTACGT | LALKKIPYSELVKLFNII |
| | | | | CAACTATGAAAAAAGTCTTAAATAATGAAACCGAAAAATTACCGGGAAG | AGTTACAA | ATTTCAG | LLVGFLPDVLKNSRTI |
| | | | | TAATCTAACTTTCATGTGCGGGTTCTGTGATCGGGAATTCGACACGGCW | ACCACGAG | TATGAA | LIPEVDNPQGGGDYR |
| | | | | AGGGGCAGAGGAGTGCACGAGAGTAGAGGTCATTTAGTTGAGCGGGA | GGGCGTCC | AATGAG | PISINSVLTRTLNKILA |
| | | | | TGCGGCGGTTCAGAGCAGAGTGAAAGCCGTGGTGAGTAAAAAGTATTA | TGACGGAC | TAAAGT | KRVSEGDFGINGQKG |
| | | | | TTATAGTAACGAAGAGGATGTGGCATTAGCGAAAATGCAGTTASAGCAT | TGSAAAAG | TCTCGAC | FKSVDGCLENLATVE |
| | | | | GCAGATCTGGCCAAAAGCGAACWATTAGAAGCCATGTATCTTGCATTG | CATTGAGR | TCGATG | SILADARMKKNKLAV |
| | | | | GGAAAGGGAAGAACTCGTGAAGCCATAGAGCAACACATAAGGAAATC | GTCMTGA | AGTTGG | VFLDMSKAFDSVNH |
| | | | | GTTACGTTATAAGGGGGTCCTTGAAGAACAGCGAAAGCTCCTTGAGAC | AGAGAGG | GGGCAA | ESIVRAGEIKGYPKLL |
| | | | | AGCAAGGGGAAATGTTCGGCAAAATAACGTGGGTGTGCCAGCTAGCAA | CTCTTATT | CCATTG | MTYVKECYNDATTN |
| | | | | TGCCACTAAAAATCTGCAAAGATTCTTAGAATCGTTACCCTTGGGAACG | GTACGAAT | GGGGTC | VAGVTAKFNRGVKQ |
| | | | | AATAGGCGCGAGGAACGATTGGATAGGATTATCCGATCTAACTCGATC | CTCTTCAA | CTGAAG | GDPLSPALFNNVIDL |
| | | | | GAAAGCCAAAGACTTGAATTGATCCACTATTGTAACGATATGTGTCAAG | CGATCGAA | AGAGGC | AIERVSGTGIGYNMG |
| | | | | ACTTTGTGCAACTAGACTGTCAAARGAACCCCATCAATGCTATAAGGCG | GTCTGGAC | TCTCACT | GKKYSVVAYADDLVL |
| | | | | CAGAAATCCGAAAAGACTATCGAAAAAGCAGTTGAAGAGAGCTAAATT | CGATATGA | GTAAAA | FGESREGLQIALTALL |
| | | | | TAGCGCTCTTCAACGGCTTTGGATAAGGGATCGGAAAGCTGCTGCACAG | GAACTAAT | AATCTCT | EELKLNGLTPNPAKS |
| | | | | TTAGTGTTGAAGGATAAGCTTGATAGTTTGCTCAGCAATAAAGAGGATT | ACATTAGT | TCGTGT | ASLTFERSGPHWFAS |
| | | | | CCAAGGATTTGGGATCGTATTGGCAACAGGTCTTCGAACGTGAGTCCGA | TGACAGGT | CTGTTTA | TDTVTALGDQIPAM |
| | | | | ATTAGACCGCAGACCCATACCACAAGTGGTGGAAAACGAAGAGTTAAA | GAAAAATA | TTCCTAG | GNIETYKYLGIKFNSC |
| | | | | TTCCCCGGTATTAGAGAAGGAAGTAGAGTGGGCTGTCAAAAACATTAA | CTGTTGAT | GCACNT | GVVKGSLPGIYTKKLE |
| | | | | GAAGTCCACTGCCGCAGGACCAGACGGGTTAACGGCACTTGCCTTGAA | TACTTAGT | GCTGCA | LISKAPLKPQQRLAM |
| | | | | GAAAATACCGTATTCCGAGCTAGTCAAACTATTTAATATAATACTGTTGG | TCTCAGTC | TTATGA | LTDFLIPGVLHQAVF |
| | | | | TGGGATTCCTACCTGATGTATTAAAAAATAGTAGAACTATCCTAATACCC | ATGTGGTA | AGCGG | GQTNAGDLRSLDKRT |
| | | | | GAAGTGGATAATCCCCAAGGGGGYGGTGATTATAGACCGATTTCGATC | TATTGCCA | WGAAA | RRAVRSWCHLPSDTS |
| | | | | AATTCAGTGCTCACTAGAACACTAAATAAGATCCTAGCGAAACGAGTCT | GTCAATTA | GTAAAG | TAFIHAKAKDGGMGI |
| | | | | CGGAAGGTGATTTTGGTATCAATGGTCAAAAAGGATTCAAAAGTGTAG | CTACATW | TTAGAG | PSIRAEVQFGKLDRF |
| | | | | ATGGTTGTCTAGAGAATCTAGCAACAGTTGAATCAATTTTGGCCGATGC | AATATTAG | CTGAGA | GKLPNVKDERSKVLA |
| | | | | TAGAATGAAGAAAAAATAAGCTTGCGGTAGTATTCTTGGATATGAGTAAA | TGTGGCTC | GATAGG | DNAHIKKKMLEKLGV |
| | | | | GCTTTTGATTCTGTAAACCACGAGAGTATTGTTAGAGCTGGAGAAATCA | TCAAAGGA | TACTTGC | GIPIKGVRCKNKLEFY |
| | | | | AAGGTTATCCCAAACTATTAATGACGTATGTGAAGGAGTGTTATAACGA | ACACGATT | TGCATTA | NKMREELIKSNDGIG |
| | | | | CGCTACTACGAACGTCGCAGGTGTAACAGCCAAGTTTAACCGGGGAGTT | GRTCGGCA | TGAAGC | LKEASLVPSANTWLK |
| | | | | AAACAAGGTGATCCTCTTTCGCCGGCGTTATTTAATAACGTAATAGACCT | GTCCAATG | GGAGAA | LSDLHMSGRTFVGCL |
| | | | | TGCAATTGAGCGAGTTTCCGGTACTGGAATTGGATATAATATGGGCGGT | CGCGACTG | AGGCCT | KTRGNLMATVTRTSR |
| | | | | AAGAAGTATTCTGTGGTCGCGTATGCTGACGATCTTGTTCTATTCGGTGA | GCGGGCTT | CGAATA | GGQNPGIELNCKKGC |
| | | | | GTCGAGAGAGGGGTTGCAAATAGCCCTGACGGCGCTACTGGAGGAATT | GTTGTTTG | AATAGG | QYQGSLNHIVQKCPV |
| | | | | AAAGCTAAACGGTCTGACACCCAATCCAGCGAAAAGTGCTTCGTTGACA | CATTTGTT | GTGTTA | VKGLRIKRHDEVVKY |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTTGAGAGATCAGGGCCACATTGGTTCGCAAGTACCGATACCGTTACAG | ACCGGCTA | GAGTTA | VEEITKKAGWSATME |
| | | | | CACTAGGAGATCAAATACCGGCCATGGGTAACATCGAAACCTATAAATA | CTTGAAAA | TTGATG | PIIPFEGSHRKPDLVL |
| | | | | CTTAGGAATCAAGTTTAATTCGTGCGGAGTGGTTAAAGGGAGTCTACCC | GGTTATAT | GAGAGT | VRGDLGKVVDIQIVS |
| | | | | GGGATATACACCAAGAAATTGGAGTTAATCTCTAAGGCTCCTTTGAAGC | ATAGCAGA | ATACTA | DHCGLDEKNSCKIGK |
| | | | | CGCAACAGCGGTTAGCTATGCTAACCGATTTCTTGATTCCTGGAGTATTA | CGCTTAAA | GTAAGC | YDNDIIRNYVRGLGP |
| | | | | CACCAAGCCGTGTTTGGACAGACAAATGCAGGGGACCTGCGCAGTCTC | GCGCGACT | TTAAGCT | SRVEVAAITLNWRGV |
| | | | | GATAAACGGACGAGAAGAGCGGTGAGATCTTGGTGTCACCTTCCCTCTG | GTAATTTA | GCGCCT | WSRDSFNLIKRLGMT |
| | | | | ATACGTCAACGGCATTCATCCATGCTAAAGCTAAGGATGGAGGAATGG | CATYTCAT | CGCGCG | EMDAKIISMRVLAST |
| | | | | GAATTCCATCTATAAGAGCCGAAGTCCAATTTGGAAAATTGGATAGATT | TGCCCAGT | GTGCCC | AKMFKTCKKVLEPVC |
| | | | | TGGAAAGTTACCCAATGTCAAAGATGAACGATCKAAAGTTTTGGCCGAT | ATTTGTCT | AAAAAT | RTKTADCDGYGPEET |
| | | | | AATGCTCACATTAAAAAGAAGATGTTAGAGAAATTGGGAGTGGGGATC | TTTGTCAG | ATACTTA | SARPCHELNLKESSGT |
| | | | | CCAATCAAAGGAGTGCGTTGTAAGAACAAACTCGAGTTCTACAACAAGA | ATTTAGCA | ATGAGA | * (SEQ ID NO: 1461) |
| | | | | TGCGTGAAGAGTTGATTAAGTCGAATGATGGCATTGGCTTAAAAGAGG | AAATTTCA | GCAATA | |
| | | | | CATCTTTGGTTCCCTCTGCGAACACTTGGTTAAAACTGAGTGACCTACAT | TATTTTGTT | ACTCAA | |
| | | | | ATGAGCGGTCGCACATTTGTAGGATGTCTTAAAACACGGGGAAACCTTA | AATTACCT | GGNGAG | |
| | | | | TGGCTACCGTAACAAGAACTAGCAGAGGAGGTCAGAACCCGGGTATAG | TAACTGGT | TTTAATT | |
| | | | | AGTTGAACTGTAAAAAGGGATGCCAATATCAGGGAAGTCTGAACCATAT | TAAACGAT | CATATG | |
| | | | | AGTCCAAAAGTGCCCAGTAGTGAAAGGGTTGAGGATAAAACGACATGA | CCCATAAT | CGCATG | |
| | | | | TGAAGTCGTTAAGTATGTGGAAGAGATCACGAAAAAGGCTGGATGGTC | TGCTTGCA | CGGCAC | |
| | | | | TGCAACAATGGAACCAATAATTCCGTTCGAGGGGTCACACCGAAAACCG | ATTATTAT | CAAGGT | |
| | | | | GATTTAGTTCTGGTCCGGGGCGATCTCGGGAAAGTTGTGGATATTCAAA | AAAGTAAT | GCTGAA | |
| | | | | TAGTTTCTGATCACTGCGGTCTGGATGAAAAAAATAGTTGTAAGATCGG | TCAGGTAA | TGGCAT | |
| | | | | TAAGTATGATAATGACATCATACGAAATTATGTAAGGGGGCTAGGACCA | AAATTACA | CGATTA | |
| | | | | TCGAGAGTGGAGGTAGCGGCGATAACCCTTAATTGGCGAGGCGTGTGG | TATCTGGC | AACCTCT | |
| | | | | AGTAGAGACTCATTCAATCTCATTAAGAGATTAGGAATGACAGAAATGG | TGATCCTG | CCTGTT | |
| | | | | ATGCGAAAATCATTTCTATGAGAGTGCTGGCGAGCACTGCGAAGATGTT | CCAGTAGT | GTAGAA | |
| | | | | TAAGACGTGTAAAAAAGTGTTAGAGCCCGTTTGCAGAACCAAGACCGCT | CATTTTAC | GCAGGT | |
| | | | | GATTGTGATGGTTACGGACCGGAGGAAACCTCCGCCCGACCATGTCATG | TTCCGCCG | CATAAA | |
| | | | | AGCTTAACTTGAARGAGAGTTCGGGGACGTAAGGCCACGCGCGTCGTC | CGCTATAA | TGGAGG | |
| | | | | CTTGTTTGATCACTAGTGGATCAACCTTCGACTCCCCGGAACTGTGGGA | AACAGTTT | RGGGCA | |
| | | | | GTGGCGGAAGAAAGGCCAGAGGATGTCCTGAAACCATATATTTATTTAT | AAAAACTG | ACCACT | |
| | | | | AGAAGTTTTACTTCATCCTATTTACGTATTTCAGTATGAAAATGAGTAAA | AATAGGAA | GAAACT | |
| | | | | GTTCTCGACTCGATGAGTTGGGGGCAACCATTGGGGGTCCTGAAGAGA | TCAAAAAG | TATGAG | |
| | | | | GGCTCTCACTGTAAAAAATCTCTTCGTGTCTGTTTATTCCTAGGCACNTG | AACATGGC | CCAGAA | |
| | | | | CTGCATTATGAAGCGGWGAAAGTAAAGTTAGAGCTGAGAGATAGGTA | AAGCGACT | GAAGCT | |
| | | | | CTTGCTGCATTATGAAGCGGAGAAAGGCCTCGAATAAATAGGGTGTTA | ATATGTAA | TAACTAC | |
| | | | | GAGTTATTGATGGAGAGTATACTAGTAAGCTTAAGCTGCGCCTCGCGCG | CTGGGCAT | AWAAGT | |
| | | | | GTGCCCAAAAATATACTTAATGAGAGCAATAACTCAAGGNGAGTTTAAT | TCAACATT | TTTAGG | |
| | | | | TCATATGCGCATGCGGCACCAAGGTGCTGAATGGCATCGATTAAACCTC | CCCTATTA | CAATTAC | |
| | | | | TCCTGTTGTAGAAGCAGGTCATAAATGGAGGRGGGCAACCACTGAAAC | CATATGGT | TGAACG | |
| | | | | TTATGAGCCAGAAGAAGCTTAACTACAWAAGTTTTAGGCAATTACTGAA | GGTGCCTG | GAGTTA | |
| | | | | CGGAGTTAACTGTTAGTTAACACTACCATGTAGTIGTTTATAAAGCAAAT | GGGTCTGT | ACTGTTA | |
| | | | | ATCAGGTTTCAGTCTATATACTAAAAGTATTTTTTGATACCGTGGTATAT | TTTATATA | GTTAAC | |
| | | | | AGGCAACTAGTTAGGAAATAGTAAGGGATGACGCATTGTCTCTCTTTAT | ATGGGTAC | ACTACC | |
| | | | | GGTACTGAGGAAACTTATCGACTCGCGAGGGATGAAACCCGTAAACCG | CCGGGAA | ATGTAG | |
| | | | | ATCGATYTAGCCTATAAGTACCAGCGACAGTTAAACCATCTTACGCGAG | GTGGATCT | TTGTTTA | |
| | | | | GGGTAAAACCTGAGGACCGATTATGGTATAACTTCTCAAGATTAGCACA | GTATCACC | TAAAGC | |
| | | | | AAATGCGAGTGCAACTTGAGGAGGAGGATTTGAGTGTTAATTCATAAT | AGTCATGG | AAATAT | |
| | | | | GTACTAATCTAATTAAACTGTGACGGGAATTGCAGCTTCGGCTGTAATT | TGCCATAT | CAGGTT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACTTTGAGGCCTATCACGGATTGTAAGGAACATATTGACACCGTAAGTC TAACGTGTTCCCGATTTCCAACCAGGTCATATGAAGGGCTGCCCTTGATA AGGCGGATTTGACCCAATTCTTCATATGAGAGGCTTATTCCAGCCTTCCC GTAGTACCGTGAGGTTTTCCCGCCTCGAACGGAACAATGTTGCAGGGTA ATTAAGTACATCGGGCTATATMGCGATATTTAACGTTTTA (SEQ ID NO: 1093) | CTTTKGAT AAAGATAC AGTTTAAA ACTGCGAT GATACTAA TAGAGATC CTCTTAGA CCTTCGTA AAGAAGT GGGGATT GATGACAT TAGCATTG GAAGAATT AAATCTCC AAGGAAAT GGAGTAAC TTCAATGA AGTCCCAC AACCCCGT TGAAGGG CTGGGTTC GAGTATCG AGAGAAA ACTCTAAA TTCTCTTC GGTTMTG TCCAACGG AGGGGAC ATTACTGT AAAATATC CTCTAAAA ACAACT (SEQ ID NO: 1216) | TCAGTCT ATATACT AAAAGT ATTTTTT GATACC GTGGTA TATAGG CAACTA GTTAGG AAATAG TAAGGG ATGACG CATTGTC TCTCTTT ATGGTA CTGAGG AAACTT ATCGAC TCGCGA GGGATG AAACCC GTAAAC CGATCG ATYTAGC CTATAA GTACCA GCGACA GTTAAA CCATCTT ACGCGA GGGGTA AAACCT GAGGAC CGATTAT GGTATA ACTTCTC AAGATT AGCACA AAATGC GAGTGC AACTTG AGGAGG AGGATT TGAGTG TTAATTC ATAATG TACTAAT CTAATTA AACTGT | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GACGGGAATTGCAGCTTCGGCTGTAATTACTTTGAGGCCTATCACGGATTGTAAGGAACATATTGACACCGTAAGTCTAACGTGTTCCCGATTTCCAACCAGGTCATATGAAGGGCTGCCCTTGATAAGGCGGATTTGACCCAATTCTTCATATGAGAGGCTTATTCCAGCCTTCCCGTAGTACCGTGAGGTTTTCCCGCCTCGAACGGAACAATGTTGCAGGGTAATTAAGTACATCGGGCTATATMGCGATATTTAACGTTTTA (SEQ ID NO: 1339) | |
| R2 | R2-1_SP | — | *Strongylocentrotus purpuratus* | TCTCGCGACGCGTTCTTCTGCCTGATGAAGTCACGTCAGGTAATAGACTTAGAAGGTTGATGAGCGTTCCTCTCCTGGACCGGGGGTGAGGATGTGTTCTACTGAATCATCGTTCCGGTTGTGAGGTCCGCTGCAAATAGGCCTTGG | TCTCGCGACGCGTTCTTCTGCCTG | TAAACCTTGCCTCCCCGGGC | MENSFAWEGTSSAEGRTTVEDSPSSSDDFVSNVGFKVAKADPTV |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGTGGTCTACCTCCGGGTCGCTACTCCTTTTGAGCTAGTCGATCCAGGT | ATGAAGTC | CCCCCTC | WEEANMSEDNTIIED |
| | | | | GAGAGTCGGGGAAGCCCACTTAGGTGGGCCAGCTAAGCAGATCACCCC | ACGTCAGG | AGTGAC | PPSSSDDFANNVGFK |
| | | | | CCCAGCACGACAGTGCGCTGTAATATAGCCTGTTGAGAGTGCACCCATT | TAATAGAC | TAAGAC | VTRADPTAWEEASTS |
| | | | | TATACTGTTATAAAAGTATAAATGGTTCTTAGCTAACCTATCCAATGATT | TTAGAAGG | AACTTTC | TETEDLPSSSNFIDNV |
| | | | | TTTATTGTTATGTATAATACTGACCACTTTAGTCTAGTGTCATGTAAGGA | TTGATGAG | ACCGTA | ETQIDMAGPTAWED |
| | | | | TCCGAGACAATAGCCTATGTCTCTAGTCTAGCAATAACACAAGAGGGAT | CGTTCCTC | ATAATC | ADSNEDNIDEGTPN |
| | | | | AATCCACCTCCCTACTCCAGCCACCACCTTTACCTTTCTTATCTTCCATATA | TCCTGGAC | ATATATT | NINNNLAIVRGRADA |
| | | | | GATGCCAACCAGACGGGTCGATGGGCAGTGAGAAACAAGAATGGGGA | CGGGGGT | TGTATAC | YACSCCERNFISLKAI |
| | | | | TAATTTGGAATTTGACATTCTTTCCTAAAGCAGACCTGAAGGGTTAAGA | GAGGATGT | CATGTAT | GTHLKETHNKKVVFE |
| | | | | GTCACAAGCGGAGTCCGGACTGTCTTTATAAACAGACAATATTTTCTTAT | GTTCTACT | TAATCTA | CAKCQHTFVKAHGL |
| | | | | TTTACCACCTATATGGGGATATTTCCCAACTCGTAATATAGGGCCCACTG | GAATCATC | GGTAAC | ACHVPKCKEDADTP |
| | | | | TCAAGTGGCTGGTATAAGTTACCCTGTGGGTAACAAATAAATTCAAACA | GTTCCGGT | AATTGA | MLNRLLHGCGECGL |
| | | | | AAGAATGGAAAACTCCTTTGCGTGGGAGGGTACCAGTTCTGCTGAAGG | TGTGAGGT | AAGTAA | AFNTRRGLSQHERHR |
| | | | | CAGAACAACAGTTGAGGATTCACCCTCAAGCAGTGACGATTTTGTTAGC | CCGCTGCA | CATTGA | HPSACLSTRRRSRLD |
| | | | | AATGTCGGATTCAAAGTAGCTAAGGCGGATCCCACTGTGTGGGAGGAA | AATAGGCC | ACCGTA | GIARKKSLRNRRDIW |
| | | | | GCCAATATGTCAGAAGACAATACAATAATTGAGGACCCACCATCGAGTA | TTGGGGTG | TTCATAC | TNDEIRLLKQLMIQYE |
| | | | | GCGACGACTTTGCTAACAATGTCGGCTTCAAAGTAACTAGGGCAGATCC | GTCTACCT | TTTAATG | HAKKINIKIAEHFNHK |
| | | | | CACTGCGTGGGAGGAAGCCAGTACATCTACAGAGACTGAGGATTTACC | CCGGGTCG | AGTACA | NAKQVMHKRRSLRE |
| | | | | CTCGAGCAGTAATTTTATTGACAATGTCGAGACCCAAATAGATATGGCG | CTACTCCT | ATAGTG | KDMALGAPHDAPPP |
| | | | | GGCCCCACTGCGTGGGAGGACGCCGATAGCAATGAAGATAACATAGAT | TTTGAGCT | AAGGGA | LAEEPIIEVVEGAREEL |
| | | | | GAGGGCACACCCAATAATATTAATAATAATTTAGCAATAGTCAGAGGGA | AGTCGATC | ACTGTAT | EQAPVDVILPDLEALT |
| | | | | GGGCGGATGCCTATGCATGCTCGTGTTGCGAACGGAACTTCATTTCTCT | CAGGTGA | ATTACAT | VNDGRGGGSPVLTE |
| | | | | CAAGGCAATCGGTACTCACCTCAAGGAAACCCATAACAAAAAGGTTGTC | GAGTCGG | ACCTCG | GGESTRDMEENGGT |
| | | | | TTTGAATGTGCCAAATGTCAACACACCTTCGTTAAAGCACACGGACTAG | GGAAGCCC | AGATAG | DTRSPSPREERAGST |
| | | | | CGTGCCACGTCCCCAAATGCAAAGAGGACGCCGACACACCTATGCTTAA | ACTTAGGT | AGGTTTT | PWERGWQPRVDRG |
| | | | | TAGACTGCTCCACGGCTGTGGAGAGTGCGGTCTTGCATTCAATACGAGA | GGGCCAG | TGTACCT | RGEYKGYGGERGDR |
| | | | | AGAGGGCTGTCTCAACACGAGCGCCATAGGCACCCGTCGGCGTGTCTA | CTAAGCAG | TAAGGG | HTVSLSQRGESGVDP |
| | | | | AGTACTAGGAGAAGGTCACGGCTAGATGGTATAGCTAGGAAAAAATCA | ATCACCCC | TTCGTG | LTPGGVVEDYDDSYL |
| | | | | TTGAGGAATAGGAGGGATATTTGGACGAATGATGAGATCCGTCTACTC | CCCAGCAC | AGAATC | EDYFPGWDEDEHM |
| | | | | AAACAACTCATGATACAGTACGAGCATGCTAAAAAGATAAACATTAAGA | GACAGTGC | CATACT | HIIGRLDLSDESEQGE |
| | | | | TAGCGGAACATTTCAACCATAAGAATGCAAAACAAGTCATGCATAAACG | GCTGTAAT | GCATAA | AAVSPRLGSFGDLLEE |
| | | | | TAGATCCTTAAGGGAAAAGGACATGGCCTTAGGTGCTCCACATGATGCA | ATAGCCTG | AGGGGT | VNAMEGKDNLSEAL |
| | | | | CCTCCGCCATTGGCAGAAGAACCGATAATAGAAGTAGTTGAGGGTGCG | TTGAGAGT | TAACTTG | AETLGLVLHEGHRVE |
| | | | | AGAGAAGAGTTAGAACAGGCTCCTGTAGATGTAATCCTTCCAGATCTTG | GCACCCAT | TAACTCA | YIKEKMNINVKQMA |
| | | | | AAGCACTCACGGTTAATGATGGGAGAGGGGGTGGCAGCCCCGTGTTGA | TTATACTG | ACCCCA | TEILAHGANKGNPKR |
| | | | | CCGAGGGAGGGGAGAGTACAAGGGATATGGAGGAGAACGGGGGGAC | TTATAAAA | GGGAGA | RKEAVAAKRNPGTRL |
| | | | | CGACACACGGTCTCCCTCTCCCAGAGAGGAGAGAGCGGGGTCGACCCC | GTATAAAT | CAAGCC | DRAQRDNQAKAKAK |
| | | | | CTGACTCCGGGGGGAGTGGTAGAAGATTATGATGACTCGTACTTAGAA | GGTTCTTA | GACAAA | EKKRIFSETQTQYKKN |
| | | | | GACTACTTCCCTGGGTGGGATGAGGATGAGCACATGCATATTATTGGGA | GCTAACCT | TTCGGC | PHRLVEKLLDGKGDE |
| | | | | GGCTCGACCTAAGTGACGAGTCGGAACAAGGGGAGGCTGCTGTCAGTC | ATCCAATG | ATTACTA | RCSVSLEVIQRTYMN |
| | | | | CAAGACTAGGCTCCTTCGGAGACCTATTAGAAGAAGTTAATGCAATGGA | ATTTTTATT | TGTGAG | RFSRESKEVDIGAYVD |
| | | | | AGGCAAGGATAACCTGTCTGAGGCACTGGCCGAAACCCTGGGCCTTGT | GTTATGTA | GGTCAT | PETVEDNQGIVDPISK |
| | | | | GTTACACGAAGGTCATAGAGTAGAATACATTAAAGAGAAAATGAACAT | TAATACTG | AAGTGT | AEIERAISTTKKGSAP |
| | | | | AAATGTTAAACAAATGGCAACAGAAATATTAGCCCACGGGGCAAATAA | ACCACTTT | TAAAGG | GPDGVTYDALKAYG |
| | | | | GGGAAACCCCAAACGGAGAAAGGAGGCGGTCGCCGCCAAGCGGAATC | AGTCTAGT | ACCCATT | NCQLYLLIMYNTWLA |
| | | | | CCGGTACGAGATTAGATCGAGCCCAGAGGGACAACCAAGCGAAGGCCA | GTCATGTA | GTATAT | MGKVPSEAKTYRSILI |
| | | | | AGGCCAAGGAGAAAAAGAGAATCTTCTCCGAAACACAGACCCAATATA | AGGATCCG | AACTTGT | PKGQGDPMDINNFR |
| | | | | AGAAGAATCCCCACAGACTCGTGGAAAAACTTCTTGATGGGAAGGGTG | AGACAATA | AAATGT | PLTLANVISRLYSKILT |
| | | | | ACGAGCGGTGCTCTGTCAGCCTTGAAGTGATCCAAAGGACCTACATGAA | GCCTATGT | ACAGAG | RRLDGAVSVCPRQR |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAGGTTCTCAAGAGAAAGCAAAGAGGTTGACATAGGAGCCTATGTTGA | CTCTAGTC | AATTCG | GFTHKASIEDNTLILR |
| | | | | CCCCGAGACTGTGGAGGATAACCAAGGGATAGTGGACCCCATCAGCAA | TAGCAATA | AGTTGA | ELIMKSKRNKECLAV |
| | | | | GGCTGAAATAGAAAGGGCCATCTCTACCACGAAAAAGGGATCCGCACC | ACACAAGA | GTTCGA | VLLDLAKAFDTVSHD |
| | | | | TGGACCGGACGGGGTCACCTATGATGCCCTAAAGGCGTATGGAAACTG | GGGATAAT | AGAATA | LIIKALRRHRVHEHLIS |
| | | | | TCAATTATACTTATTAATAATGTACAACACATGGCTGGCCATGGGGAAG | CCACCTCC | AACAAA | VIMDLYEGGTTSFTT |
| | | | | GTCCCATCAGAGGCAAAAACCTACAGGTCAATTCTAATCCCAAAAGGTC | CTACTCCA | CAAAAA | DEGTTCPIAIRSEVKQ |
| | | | | AAGGGGACCCCATGGACATCAACAATTTTCGTCCATTAACACTCGCCAAT | GCCACCAC | AGAAAA | GDSLSPVLFNLALDPL |
| | | | | GTAATCAGCAGATTATATTCCAAAATCTTGACCAGGAGGCTGGACGGG | CTTTACCTT | CAAAGA | LATLEQRGKGVEIGG |
| | | | | GCGGTAAGTGTCTGTCCGAGGCAAAGAGGCTTCACTCACAAAGCTAGT | TCTTATCTT | GAATTC | HTFVSLAYADDTALV |
| | | | | ATTGAAGACAATACACTCATCCTACGGGAACTCATCATGAAGAGTAAGA | CCATATAG | GTTCGT | SSSHLDMTANLDITV |
| | | | | GAAATAAAGAATGCCTTGCAGTGGTACTTCTTGACTTAGCCAAGGCTTT | ATGCCAAC | CCATAG | EYLNATGLSLNVRKC |
| | | | | CGACACCGTTTCCCACGATCTCATCATCAAGGCCCTGAGGAGGCATCGG | CAGACGG | AAGCGG | QGFLLTPINKSFLVNE |
| | | | | GTGCATGAACATCTCATTAGCGTCATAATGGACCTGTACGAAGGGGGA | GTCGATGG | AAAAAG | AESWVVEREAIPWV |
| | | | | ACTACATCTTTCACGACAGATGAGGGCACCACCTGCCCCATCGCGATCC | GCAGTGA | CGCAAA | EPGDTAKYLGVQVG |
| | | | | GGAGCGAAGTTAAGCAAGGAGACTCTTTGTCGCCGGTGTTATTCAACTT | GAAACAA | AAGGCG | PWSRPWPSIQPVIKR |
| | | | | GGCTCTCGACCCGCTACTAGCTACACTCGAGCAAAGAGGGAAAGGTGT | GAATGGG | TCCTAAC | LTAYCESIDKAALKPR |
| | | | | TGAGATCGGGGGACACACGTTCGTCAGCCTGGCCTATGCGGATGACAC | GATAATTT | CTCACG | QRIHILTTYIAPRIAFEI |
| | | | | GGCACTCGTCTCGTCCAGCCACCTGGACATGACCGCAAACCTAGACATA | GGAATTTG | GTCTAA | AEGGYSTLVDCRGGI |
| | | | | ACTGTAGAATACCTCAATGCAACGGGACTGAGTCTCAATGTGAGGAAAT | ACATTCTT | CCCAGA | QYTRIREVDMTIRNY |
| | | | | GTCAAGGCTTCTTACTCACCCCCATCAATAAGTCCTTCTTAGTCAATGAA | TCCTAAAG | AACATTT | VRKWLFLPACLSNSF |
| | | | | GCCGAGAGCTGGGTAGTGGAACGGGAAGCTATCCCGTGGGTTGAACCT | CAGACCTG | AAGGGG | LYTRRGEGGLGLVSF |
| | | | | GGGGACACAGCTAAATATCTGGGGGTACAAGTGGGTCCGTGGTCACGT | AAGGGTTA | GGAAGG | YDYVPTERMRKLVRV |
| | | | | CCGTGGCCATCCATTCAACCAGTAATTAAACGCCTCACAGCCTACTGTGA | AGAGTCAC | AGCTCA | CDSEDPVIAGAAASL |
| | | | | GAGCATCGACAAAGCGGCGTTAAAGCCAAGACAGAGAATACACATTCT | AAGCGGA | TTACTCC | GLRERAAKISAQTGL |
| | | | | AACGACCTATATTGCCCCTAGGATTGCCTTTGAGATTGCAGAGGGGGGA | GTCCGGAC | AATCCA | PVPVKPKGAHNAWR |
| | | | | TACAGTACACTCGTATAAGGGAGGTAGACATGACAATCAGAAACTACGT | TGTCTTTA | AAACCA | KVQKKKWKAQPTQG |
| | | | | CAGGAAATGGCTATTCTTGCCCGCCTGCCTTTCAAACTCCTTCCTTTACAC | TAAACAGA | CGTTCCC | KGVSCYQHRLGNKW |
| | | | | AAGGAGAGGAGAGGGTGGTCTTGGGCTGGTAAGCTTTTACGACTACGT | CAATATTT | TAGCCC | LGAPSFLTENDYIWAI |
| | | | | ACCGACTGAACGTATGAGGAAGCTAGTTAGGGTGTGTGATTCTGAAGA | TCTTATTTT | AAAAGC | KLRTNLVPTREAMGR |
| | | | | TCCGGTTATAGCAGGGGCAGCAGCCTCGCTAGGGTTAAGGGAGAGAGC | ACCACCTA | GCGCTT | GIIGRNQVECRHCHT |
| | | | | TGCGAAGATAAGCGCTCAGACAGGGTTGCCAGTTCCAGTTAAACCCAAA | TATGGGGA | CAATGA | TIETMGHISGYCQMV |
| | | | | GGGGCACACAATGCATGGAGAAAAGTCCAGAAGAAAAAGTGGAAAGC | TATTTCCC | GGGAGC | LDIRLIRHNRICKALIK |
| | | | | TCAACCCACCCAGGGGAAGGGAGTTAGTTGTTACCAACACAGGTTGGG | AACTCGTA | CGATATT | AATATGLRVTEEPRIV |
| | | | | CAACAAATGGTTAGGTGCCCCCAGCTTCCTCACTGAAAATGACTACATTT | ATATAGGG | GGAGGA | GTDGKNYLPDLIFSA |
| | | | | GGGCCATTAAACTGAGGACAAACCTCGTCCCTACTAGGGAAGCTATGG | CCCACTGT | CAGAGT | GAGEPCYVVDPTVV |
| | | | | GGAGAGGTATCATAGGGAGGAATCAAGTGGAGTGCAGACACTGCCATA | CAAGTGGC | TCATCAA | WDDDPKNLREAWR |
| | | | | CAACAATAGAAACAATGGGACACATTTCTGGATACTGCCAGATGGTCCT | TGGTATAA | AAGCCA | GKVRKYTPIIPAVEA |
| | | | | GGATATTCGTTTGATTAGACACAACCGTATATGCAAAGCCCTGATCAAG | GTTACCCT | CCTGTA | MLHPSSVQIFGFVCG |
| | | | | GCTGCTACGGCTACAGGACTCAGAGTTACGGAAGAACCACGAATAGTG | GTGGGTAA | AGTAGG | ARGTWCPMNDDIAK |
| | | | | GGTACGGATGGGAAAAACTATTTGCCAGATCTTATTTTCAGTGCGGGAG | CAAATAAA | CCCATTT | IVGLKNSGISRTLQIVL |
| | | | | CTGGGGAGCCATGTTATGTAGTTGATCCAACAGTGGTGTGGGATGATG | TTCAAACA | CTGCCA | CDTIRMVKAFMAR |
| | | | | ATCCCAAGAACCTGAGGGAGGCCTGGAGGGGCAAGGTGAGGAAATAC | AAGA (SEQ | AGGACA | (SEQ ID NO: 1462) |
| | | | | ACACCAATCATTCCGGCGGTTGAAGCGATGCTTCACCCATCATCAGTTCA | ID NO: | TGCGCA | |
| | | | | AATATTTGGATTTGTATGTGGCGCAAGGGGAACATGGTGCCCAATGAAT | 1217) | AAAGGA | |
| | | | | GATGACATAGCCAAGATTGTCGGTTTAAAGAACTCAGGAATTAGCAGG | | AGCAGA | |
| | | | | ACACTACAAATAGTCCTTTGCGACACCATAAGAATGGTCAAGGCCTTCAT | | TTATCAA | |
| | | | | GGCCAGATAAACCTTGCCTCCCCGGGCCCCCCTCAGTGACTAAGACAAC | | ACCAGT | |
| | | | | TTTCACCGTAATAATCATATATTTGTATACCATGTATTAATCTAGGTAACA | | CAAACA | |
| | | | | ATTGAAAGTAACATTGAACCGTATTCATACTTTAATGAGTACAATAGTGA | | AGCACA | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGGGAACTGTATATTACATACCTCGAGATAGAGGTTTTTGTACCTTAAG<br>GGTTCGTGAGAATCCATACTGCATAAAGGGGTTAACTTGTAACTCAACC<br>CCAGGGAGACAAGCCGACAAATTCGGCATTACTATGTGAGGGTCATAA<br>GTGTTAAAGGACCCATTGTATATAACTTGTAAATGTACAGAGAATTCGA<br>GTTGAGTTCGAAGAATAAACAAACAAAAAAGAAAACAAAGAGAATTCG<br>TTCGTCCATAGAAGCGGAAAAAGCGCAAAAAGGCGTCCTAACCTCACG<br>GTCTAACCCAGAAACATTTAAGGGGGGAAGGAGCTCATTACTCCAATCC<br>AAAACCACGTTCCCTAGCCCAAAAGCGCGCTTCAATGAGGGAGCCGATA<br>TTGGAGGACAGAGTTCATCAAAAGCCACCTGTAAGTAGGCCCATTTCTG<br>CCAAGGACATGCGCAAAAGGAAGCAGATTATCAAACCAGTCAAACAAG<br>CACAAACATTGGGGGGATGGGATAACCCCGGAAAGAGAGGGATCTTTA<br>GATAGTGGATGGAAGGGGTGGGACGTTGAATCCAACCATGCCGTTTTT<br>ATGTTCCCGATAAAGAAGGATAAGGTCACTCCAGCCTGACACACAAAGT<br>GGGGTAAAAGAACTCCGCTCGTACGGACTCCAAATAGAA (SEQ ID NO:<br>1094) | | AACATT<br>GGGGGG<br>ATGGGA<br>TAACCCC<br>GGAAAG<br>AGAGGG<br>ATCTTTA<br>GATAGT<br>GGATGG<br>AAGGGG<br>TGGGAC<br>GTTGAA<br>TCCAACC<br>ATGCCG<br>TTTTTAT<br>GTTCCC<br>GATAAA<br>GAAGGA<br>TAAGGT<br>CACTCCA<br>GCCTGA<br>CACACA<br>AAGTGG<br>GGTAAA<br>AGAACT<br>CCGCTC<br>GTACGG<br>ACTCCA<br>AATAGA<br>A (SEQ<br>ID NO:<br>1340) | |
| R2 | R2-<br>1_SSa | AGKD01072455 | *Salmo salar* | AATCTTTAACCCCGGACTCTTGGGGTTCTTACGACTCTGTATGAGGAACA<br>GTCGAAGAGAGGGCGCTACCAATCCAAGTATATGTCCCAAGAGGGCTG<br>GGACAGGGTGGAAGAGTGCACCTCGCGATCTGGGGCAGGGAAGGAAT<br>GGAGAGAAGTCGAAGAAGGCTTGTAGAGAAGGGGCTCTCCTAGATCCT<br>AACCTGTATGACGCCCGTAAAACGGTGACCCCAGTAGCGAATAAAGGA<br>GGCAGGTGACAATAGAGGGCAGGGCCGACTTCCCAGGTTTACATTGTT<br>GTACTTGTCAACATAAAGAGGTGTCTCAATAGTTTGAATCAACAAGGGA<br>GAGGAATACCGACCTGCTCCCTTGGGGCGGGGGTACTGGTCTTAGCCC<br>GGTTCCCCGCAAGTTTCCTTTGCCTGGGATGTGCCTGACTGGCTCCATCC<br>CCTTTCCCCATTAGGCACGGCTAGATGACGCACCGATGGGCGGGTGTGT<br>AGGTCGCTACCGAAGGGGACTGGGGGTGTCCGGTGAACCAGGACTTCC<br>CAAAATGGTCTCACATTTTTAAGCGGCTTGAGTATCGCCCAGTATCCTCG<br>CGCGGCACTGGGAACCCAGTCAACCGCTCTGTGCCCCGGCGCAGGCGG<br>GGGTTTAATGTCTCCCCGGCTTCACCGGCGCTTCGGCGACGACGCAGAG<br>GAGCACCCGGAGGCCCCCATGAACTTAAACCAACCTATCTTGAAATATG<br>GCCTCTCGTTCGGGTGAAGGGCAGGTGGGAAGAGAGGGCTGCCTCACG | AATCTTTA<br>ACCCCGGA<br>CTCTTGGG<br>GTTCTTAC<br>GACTCTGT<br>ATGAGGA<br>ACAGTCGA<br>AGAGAGG<br>GCGCTACC<br>AATCCAAG<br>TATATGTC<br>CCAAGAG<br>GGCTGGG<br>ACAGGGT<br>GGAAGAG<br>TGCACCTC | TAGATC<br>CGTTTGT<br>TATGATT<br>GGAGGG<br>AGCCTG<br>CCGAGT<br>GGTATG<br>AGCGCT<br>CCAACT<br>ATTGAA<br>CCCATAT<br>GATTCCC<br>GAGGCC<br>TGGCCA<br>GACGCC<br>TAGATG | MSGKRIVEMSGCDE<br>KICQNKHCLKRRWA<br>WISGPKGETSPPRKR<br>GTCENVSFQDKSHAS<br>DPDPLKAPEAREDAG<br>SVAPQWVGEIKTPSL<br>TSRDGVSEVVLPPQP<br>VHAEGVSPASDSKDK<br>ATKITLLISLPVCDLRC<br>GRCERPLETVGKAVR<br>HFAVAHPTVSVVFKC<br>QKCEKSSKNSHSISCH<br>IPKCKGMTETRTDVE<br>GDHGCDHCQEKFTT<br>AMGLTQHKRHRHIV<br>QYCKEKEGEMTARR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATAAACACCTAGTCAATAGCCAGTCGGGAAAAATGTGGAATGTTAGGA | GCGATCTG | CCTGCC | KGEVEAVKWSEWEE |
| | | | | CAGGGAGGTAAGGGAGGCGGCTTTTTCGTAAGGCTCCTTCAACCCCTAC | GGGCAGG | ACAATT | SEVARLSDGLAGLKM |
| | | | | CTGTAGTCCACCTATTGCAGGTGTTGACAACATGCAAGATGACCTGCCT | GAAGGAA | GAACGC | INRRIADSLGTGKTAE |
| | | | | CGTTACGGGTCGCGTATCATTGCTACAGGTCGTGTGCCGCTTCTAAGAG | TGGAGAG | AGCCCT | QVRQKRRRMRPEKV |
| | | | | GATAGTAAGGAGAGGTTATAGGGAGGTCCTGTTAGGGCTTCCTCAACC | AAGTCGAA | AGCTTG | RCDKPKEAKDKSNLIK |
| | | | | CCTCTCTATGCGATTCCTTACAGGAGTGGATCGAGAAGTCCCGGACGTA | GAAGGCTT | CTAGGA | MLSIPSATPTPQTGLK |
| | | | | ATACACCCTGGAGGTAAGGGAGTGGCCTTCTAGTAGGGCTGCTTCAACC | GTAGAGA | GATCCA | GFLLGELNGVATKGE |
| | | | | CCTCTGATGGGAGTGTACCGGGAACCTCGACTTGTAAGCACAGGTTAGT | AGGGGCTC | TAGGAA | VQIGGVTLSLRGVEQ |
| | | | | ATGGGAGCAGAAGGGGGAGCCGTAATGGGCTTCTCTTTCACCTGCTTAC | TCCTAGAT | CTGGCC | DSALLNTSALELQRLL |
| | | | | ATAATACCTGTGGTGCATGTATCTAGGTCTTGGCGGGAGAGTACTGAGA | CCTAACCT | TATGGG | GGRAGSANPLSLQRE |
| | | | | GACAAGGTTGAGACCCCAAGATTGGGTCTCCCTAGCCTCTATAGCTGCG | GTATGACG | GCGTCA | RETTLPSERRKTKQGE |
| | | | | ACTCTTAGCGGGGATATGGAGTAACATGTACCAAGGGAGTGAATAATA | CCCGTAAA | TGACGG | YRRVQKMFRSNEKKI |
| | | | | AAGGAATTGACGGGGTACAAGTGACTGTTGGCCCGAATCCTAGCCACTT | ACGGTGAC | TTGAAG | AKYILDGNGDGEAAS |
| | | | | GATGACCAGGGATATATTACAGACTGAGAGCGAATCTAGAGACGTGAG | CCCAGTAG | TTCCTCC | PPLEIALAFKSRWEEV |
| | | | | AATAAAGTGAGAATTGGTTGAGCGAATACAGAGGAAGATGAGCGGAA | CGAATAAA | ATAGCG | ETFHGLGQFYSRGEA |
| | | | | AGAGAATTGTTGAGATGAGCGGTTGCGATGAGAAAATCTGCCAAAATA | GGAGGCA | TGCTTG | DGVVFRSLISMSEVC |
| | | | | AGCATTGCTTGAAGCGCAGATGGGCGTGGATTTCCGGCCCAAAGGGGG | GGTGACAA | GGAGGG | ENLGAIKNNTAAGPD |
| | | | | AGACATCTCCTCCTCGCAAGAGAGGAACTTGCGAAAACGTATCCTTCCA | TAGAGGG | GACGAC | GITKPALLEWDPTGA |
| | | | | GGATAAATCTCATGCCTCGGACCCAGATCCTCTCAAAGCCCCGGAAGCG | CAGGGCC | AATGAC | KLAAIFSIWLTSGTLP |
| | | | | AGAGAGGACGCGGGTTCGGTGGCGCCTCAGTGGGTTGGCGAAATAAA | GACTTCCC | GAGTCA | GPFKKCRTTLIPKTDD |
| | | | | GACACCTAGCCTAACATCGCGGGATGGGGTTAGTGAAGTCGTGCTGCC | AGGTTTAC | TGACGT | PILLTQVAGWRPLTIG |
| | | | | ACCACAGCCAGTTCATGCAGAGGGAGTATCCCCAGCCAGCGACTCAAA | ATTGTTGT | ACCGAG | SVVLRLYSRILTHRLER |
| | | | | GGACAAGGCTACGAAGATCACCCTGCTGATATCACTCCCCGTCTGTGAT | ACTTGTCA | AGAACC | ACPINPRQRGFISSPG |
| | | | | TTGAGATGCGGACGATGTGAAAGACCATTAGAGACCGTTGGGAAGGCG | ACATAAAG | CCAACC | CSENLMILGGLIKRS |
| | | | | GTGAGACACTTTGCTGTGGCTCATCCGACGGTGTCGGTGGTTTTTAAGT | AGGTGTCT | CAGGTT | WAKGERLAVVLVDF |
| | | | | GTCAAAAGTGTGAGAAGAGCAGCAAGAATAGCCACTCCATCTCCTGTCA | CAATAGTT | GGGGGA | ARAFDSVSHSHILEIL |
| | | | | TATCCCTAAATGTAAGGGAATGACAGAGACCCGGACGGATGTGGAAGG | TGAATCAA | GAGAGC | RQRGLDEHIIGIVGDS |
| | | | | TGATCACGGCTGTGATCATTGCCAGGAGAAGTTTACAACGGCTATGGG | CAAGGGA | CAGCAA | YTDVTTTITVSGEQSP |
| | | | | GCTGACTCAACACAAGAGACACAGACACATCGTCCAGTATTGTAAGGAG | GAGGAAT | GAGCGG | PIDMRVGVKQGDP |
| | | | | AAGGAGGGGGAGATGACAGCAAGAAGGAAGGGTGAAGTCGAAGCAG | ACCGACCT | AGATGC | MSPLLFNLALDPMID |
| | | | | TCAAATGGAGCGAATGGGAAGAAAGTGAGGTGGCAAGGTTGAGCGAT | GCTCCCTT | TTGGTAT | TLERYGLGYRMGEQ |
| | | | | GGACTGGCTGGGCTAAAAATGATCAACAGGCGAATCGCAGATAGCCTG | GGGGCGG | ACCAAG | QITALAFADDLVLVS |
| | | | | GGGACTGGAAAAACTGCGGAACAGGTGAGGCAGAAAAGACGTAGAAT | GGGTACTG | CTAGCA | DSWEGMACNIRILEE |
| | | | | GAGACCTGAGAAGGTACGGTGTGACAAACCTAAGGAGGCAAAAGATA | GTCTTAGC | GAGAGA | FCRLTGLRIQPRKCH |
| | | | | AGAGCAATCTTATCAAAATGCTGTCCATACCGAGTGCAACACCAACACC | CCGGTTCC | GGGTTG | GFLIQKIQRARSVNLC |
| | | | | CCAAACTGGGCTCAAAGGATTCCTCCTTGGAGAACTAAATGGGGTTGCT | CCGCAAGT | AAGAGG | KPWIVCGEELHMVG |
| | | | | ACCAAAGGTGAAGTACAGATTGGGGGAGTTACGTTGTCCCTAAGGGGG | TTCCTTTG | ATGACT | PEESVSYLGMKVSP |
| | | | | GTAGAGCAAGACTCAGCCTTGCTCAATACGTCGGCCCTTGAACTGCAAC | CCTGGGAT | ACTGGG | WHGIMEPDPVERLC |
| | | | | GATTGTTGGGAGGGAGAGCGGGGAGCGCGAATCCGTTAAGCTTACAG | GTGCCTGA | CTCAGA | NWISSIGRSPLKPSQK |
| | | | | AGAGAACGTGAGACCACATTGCCAAGTGAAAGAAGGAAAACGAAACA | CTGGCTCC | GTCATCT | VRMLNVYAAPRMTY |
| | | | | AGGAGAGTACCGGAGGGTACAAAAGATGTTTCGAAGCAATGAAAAGA | ATCCCCTT | CACCCTA | QADHGGLGPIVLNVL |
| | | | | AAATTGCTAAATACATTCTAGATGGCAATGGAGATGGAGAAGCGGCCTC | TCCCCATT | AAAGGC | DGMIRKAVKVWLHL |
| | | | | CCCGCCACTCGAGATCGCTTTGGCGTTCAAAAGTAGGTGGGAGGAAGT | AGGCACG | GGTGGG | PLCTCDGLLYSRCQD |
| | | | | GGAAACATTTCATGGGCTTGGCCAGTTCTACTCGAGGGGGGAAGCGGA | GCTAGATG | GCATCG | GGLGIVKLACQIPSIQ |
| | | | | TGGTGTGGTCTTCCGGTCACTTATCTCAATGAGCGAAGTATGTGAAAAC | ACGCACCG | GTTGAA | ARRVYRLWHSKEAIT |
| | | | | CTGGGGGCAATTAAAAACAACACAGCAGCTGGGCCAGATGGGATAACA | ATGGGCG | CACCTAC | RVVTRRTVEAEEYRG |
| | | | | AAACCGGCATTGCTTGAATGGGATCCCACTGGTGCGAAACTGGCCGCTA | GGTGTGTA | CCATACC | MWLRAGGSEAGLPP |
| | | | | TCTTTTCCATATGGTTGACATCGGGCACCCTGCCTGGGCCTTTTAAGAAG | GGTCGCTA | GGGATG | LEDREEGAVQCTDTA |
| | | | | TGCAGAACAACCTTAATACCCAAGACCGATGACCCGATTTTACTCACCCA | CCGAAGG | GGAGGT | GSVKPKNPVIPDWR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGTGGCTGGGTGGAGGCCTCTCACTATCGGGTCGGTGGTTTTGAGGCT | GGACTGG | GGTAGG | RAEFLKWQNLTAQG |
| | | | | ATACTCTCGCATCCTGACACACAGGCTGGAGCGGGCGTGTCCCATTAAC | GGGTGTCC | CCGAAA | VGVQVFGGDKNSNH |
| | | | | CCGCGCCAGAGAGGATTCATTTCCTCACCTGGGTGTTCGGAAAACTTGA | GGTGAACC | AAGAAC | WMANPETLGSKERH |
| | | | | TGATCTTGGGAGGTCTAATCAAGAGAAGTTGGGCGAAGGGCGAGAGG | AGGACTTC | AGGAAG | YIAGLQLRANVYPTR |
| | | | | CTGGCGGTAGTGTTGGTTGACTTTGCGCGTGCGTTTGACTCTGTGAGCC | CCAAAATG | ATGGTG | EALSRGRPDLPKVCR |
| | | | | ACTCGCACATCTTGGAGATACTCAGACAGAGAGGGCTTGATGAACATAT | GTCTCACA | GAGTAA | QCLAGTESCAHILGQ |
| | | | | CATCGGAATCGTAGGTGACTCGTACACCGATGTAACGACCACAATTACA | TTTTTAAG | GTTGAG | CPAVKDSRIRRHHKL |
| | | | | GTCAGTGGGGAGCAGTCCCCTCCCATTGACATGAGGGTAGGGGTTAAG | CGGCTTGA | AGCGGT | CDLLASEAESAGWTV |
| | | | | CAGGGAGACCCGATGTCTCCGCTACTGTTTAATCTAGCCCTGGACCCAA | GTATCGCC | TGCTCG | IREMCCRTRAGALRR |
| | | | | TGATCGACACCCTTGAACGCTACGGCTTGGGGTACAGGATGGGCGAGC | CAGTATCC | GGAAGT | PDLVFVKTGFALVVD |
| | | | | AGCAGATCACGGCCCTAGCTTTTGCTGACGATCTGGTTCTGGTGAGCGA | TCGCGCGG | TATGTTG | VTVRYEMAYDTLMG |
| | | | | CTCGTGGGAGGGCATGGCGTGCAATATCCGTATTCTGGAAGAATTTTGT | CACTGGGA | TGATAA | AAAEKVARYTPITPYV |
| | | | | CGACTGACTGGGCTGAGGATTCAGCCTAGGAAGTGTCATGGTTTCCTCA | ACCCAGTC | CTCCATT | AMTLKARRVKVFGFP |
| | | | | TACAGAAGATTCAGAGGGCGAGATCGGTAAACCTCTGTAAGCCCTGGA | AACCGCTC | AAGGCC | LGARGKWPGSNDRL |
| | | | | TAGTGTGTGGTGAAGAACTACATATGGTCGGGCCGGAAGAGTCGGTTT | TGTGCCCC | GGTGGG | LKAMGVGGGRRKQL |
| | | | | CCTACCTGGGTATGAAGGTGAGCCCATGGCATGGCATTATGGAGCCAG | GGCGCAG | CATGGT | AKLFSRRALLYSLDVL |
| | | | | ATCCTGTCGAACGACTCTGTAACTGGATCAGTTCGATTGGGCGGTCACC | GCGGGGG | GCGGAT | RDFYRAEGETGDLDD |
| | | | | GCTGAAGCCTTCTCAGAAGGTGAGGATGTTGAATGTTTATGCTGCCCCG | TTTAATGT | AATGGA | ESVDDHL (SEQ ID |
| | | | | AGGATGACTTATCAGGCGGATCATGGGGGCTGGGGCCAATTGTCCTG | CTCCCCGG | AACTAT | NO: 1463) |
| | | | | AATGTACTCGATGGGATGATCAGGAAAGCAGTGAAGGTGTGGCTACAC | CTTCACCG | AAAAAC | |
| | | | | CTTCCGCTGTGTACCTGTGATGGGCTACTTTACTCTAGATGCCAGGACG | GCGCTTCG | AATAAA | |
| | | | | GTGGACTGGGCATAGTAAAATTGGCTTGTCAAATCCCTTCTATCCAAGCT | GCGACGAC | AAGAAA | |
| | | | | AGAAGGGTCTACCGCCTGTGGCATTCTAAGGAAGCCATAACGCGGGTA | GCAGAGG | GACCAA | |
| | | | | GTCACCCGAAGGACGGTCGAAGCGGAAGAGTACCGTGGGATGTGGCT | AGCACCCG | AAAAAT | |
| | | | | GAGAGCCGGTGGGAGTGAGGCAGGTTTGCCTCCCCTGGAAGATAGGG | GAGGCCCC | GTTCTGT | |
| | | | | AAGAAGGTGCTGTACAGTGTACAGACACTGCCGGTTCGGTGAAGCCGA | CATGAACT | TATGAT | |
| | | | | AAAACCCAGTCATTCCCGATTGGAGGCGAGCTGAGTTCCTCAAGTGGCA | TAAACCAA | GCCTTAC | |
| | | | | AAACCTGACAGCGCAAGGGGTTGGAGTGCAGGTCTTTGGCGGTGACAA | CCTATCTT | ACATGT | |
| | | | | AAACAGCAATCACTGGATGGCGAATCCGGAAACGTTGGGATCGAAAGA | GAAATATG | CTGGGA | |
| | | | | GCGCCACTATATTGCAGGTCTACAGTTGAGGGCCAATGTATATCCAACT | GCCTCTCG | GACCCC | |
| | | | | CGCGAGGCACTGTCCAGGGGCAGGCCGGACTTACCTAAAGTCTGCCGG | TTCGGGTG | ATAAGG | |
| | | | | CAATGCCTAGCAGGAACTGAGTCTTGCGCGCATATTCTCGGGCAGTGTC | AAGGGCA | GTCTCCC | |
| | | | | CTGCAGTGAAGGATAGCCGCATCAGGCGGCATCATAAACTGTGTGACCT | GGTGGGA | CTTATAC | |
| | | | | GCTAGCAAGTGAAGCCGAAAGCGCCGGATGGACCGTCATCAGAGAAAT | AGAGAGG | TTCACTG | |
| | | | | GTGTTGCAGAACTCGTGCCGGAGCTTTGCGGCGTCCAGACCTGGTGTTT | GCTGCCTC | GGAAAC | |
| | | | | GTGAAAACCGGTTTTGCTTTGGTGGTGGATGTTACTGTGCGGTACGAGA | ACGATAAA | CCCATA | |
| | | | | TGGCCTATGATACGCTCATGGGTGCGGCTGCCGAGAAAGTTGCTCGGTA | CACCTAGT | AGGGTA | |
| | | | | CACCCCAATTACTCCATATGTTGCGATGACCCTGAAGGCAAGGAGAGTC | CAATAGCC | TCCCCCT | |
| | | | | AAGGTGTTTGGCTTTCCACTGGGAGCCCGAGGCAAATGGCCGGGAAGC | AGTCGGG | ATATTTA | |
| | | | | AACGACCGGCTGCTGAAGGCTATGGGTGTTGGTGGCGGCAGGAGGAA | AAAAATGT | CTGGGA | |
| | | | | ACAGCTGGCCAAGTTGTTTAGCAGGAGGGCGCTCCTGTACTCCTTAGAT | GGAATGTT | GACCCC | |
| | | | | GTCCTTAGGGACTTCTACCGGGCGGAGGGAGAAACGGGGGACTTGGAT | AGGACAG | ATAAGG | |
| | | | | GATGAGAGCGTGGATGATCATCTATAGATCCGTTTGTTATGATTGGAGG | GGAGGTA | GTCTCCC | |
| | | | | GAGCCTGCCGAGTGGTATGAGCGCTCCAACTATTGAACCCATATGATTC | AGGGAGG | CCTATA | |
| | | | | CCGAGGCCTGGCCAGACGCCTAGATGCCTGCCACAATTGAACGCAGCCC | CGGCTTTT | GATGTA | |
| | | | | TAGCTTGCTAGGAGATCCATAGGAACTGGCCTATGGGGCGTCATGACG | TCGTAAGG | GAGCGT | |
| | | | | GTTGAAGTTCCTCCATAGCGTGCTTGGGAGGGGACGACAATGACGAGT | CTCCTTCA | AAGGGG | |
| | | | | CATGACGTACCGAGAGAACCCCAACCCAGGTTGGGGGAGAGAGCCAGC | ACCCCTAC | TCTCCAA | |
| | | | | AAGAGCGGAGATGCTTGGTATACCAAGCTAGCAGAGAGAGGGTTGAA | CTGTAGTC | AGTACC | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAGGATGACTACTGGGCTCAGAGTCATCTCACCCTAAAAGGCGGTGGG | CACCTATT | GGCCGA | |
| | | | | GCATCGGTTGAACACCTACCCATACCGGGATGGGAGGTGGTAGGCCGA | GCAGGTGT | TATGGC | |
| | | | | AAAAGAACAGGAAGATGGTGGAGTAAGTTGAGAGCGGTTGCTCGGGA | TGACAACA | CTTATG | |
| | | | | AGTTATGTTGTGATAACTCCATTAAGGCCGGTGGGCATGGTGCGGATAA | TGCAAGAT | GCAAAC | |
| | | | | TGGAAACTATAAAAACAATAAAAAGAAAGACCAAAAAAATGTTCTGTTA | GACCTGCC | TCTGGT | |
| | | | | TGATGCCTTACACATGTCTGGGAGACCCCATAAGGGTCTCCCCTTATACT | TCGTTACG | GGTAGG | |
| | | | | TCACTGGGAAACCCCATAAGGGTATCCCCCTATATTTACTGGGAGACCC | GGTCGCGT | GACAAG | |
| | | | | CATAAGGGTCTCCCCCTATAGATGTAGAGCGTAAGGGGTCTCCAAAGTA | ATCATTGC | GAGGTA | |
| | | | | CCGGCCGATATGGCCTTATGGCAAACTCTGGTGGTAGGGACAAGGAGG | TACAGGTC | AGGGCA | |
| | | | | TAAGGGCAGTGCCAACCCCTACTTGATCGGGACCATCCAGGGAATGCCA | GTGTGCCG | GTGCCA | |
| | | | | TCCTCCCGCGAAGGTGATGTGGTGAGGTAAGGGGGGAGCCCGTCTTCG | CTTCTAAG | ACCCCTA | |
| | | | | AGTTTCCCCAACCCCTACCCACAGGTGAGAGGAGGAGAAGAGGAATCT | AGGATAGT | CTTGATC | |
| | | | | GTCCCCAACGGGAGGAGGGTGAGGTGTAAGGGGGAGACCTTCTAGTA | AAGGAGA | GGGACC | |
| | | | | GGGTCTTCTCAGTCGCCTGACGTCCTGACTGTGGGGTGGATCAGTACCC | GGTTATAG | ATCCAG | |
| | | | | TACAGGTGAGACCGGTGAGGTAAGGGTGTGGCCCTCTTGAGGGCTGCG | GGAGGTCC | GGAATG | |
| | | | | CCAACCCCTACTCGAGGTAACCTGAGGGAGTGGTGGAATGGCGGCATG | TGTTAGGG | CCATCCT | |
| | | | | TTAGTGCTGGGACTTGATTGCGAGGGTTTAATGAGAGTGGCCTGCTGA | CTTCCTCA | CCCGCG | |
| | | | | GAGCAACACTTGTGGTGCTTAAAGCGGGGCGGCCCATGACCACCGTGA | ACCCCTCT | AAGGTG | |
| | | | | GATAGGACACTGCACAGTGCAGCCATGAGGTTCCTGGAGGATGATGCG | CTATGCGA | ATGTGG | |
| | | | | ATGAGGTGGGGGCCTCATCAGCCCCTCCTGGCAGGGCGTCGGCCAGGG | TTCCTTAC | TGAGGT | |
| | | | | AAACTAAATGTCTCTAGCATGTCAGTGCAGTGAGGTAAGGGGAGAGCA | AGGAGTG | AAGGGG | |
| | | | | CTCTAGTAGGGCTCTTCCAACCCCTACCTGTAGGTCACCTGGTCCAGGTG | GATCGAGA | GGAGCC | |
| | | | | TCGATGATGTGAAAACAAGAGCTACTTTGGTACCGGTCTGTTGCAAAAA | AGTCCCGG | CGTCTTC | |
| | | | | GGGTTCTGCAGAGGACGACGGCTATCCCTATCGGGAGGGAATAGTCGG | ACGTAATA | GAGTTT | |
| | | | | TCCCAGGTAGTGGAAAATGGGGCTTTCCACTGAGCATGAAAATGTGGT | CACCCTGG | CCCCAA | |
| | | | | AGAGGTTGCGTCCAACCCAATGATTTGCAGCAGAGCTCTTGGACACGAA | AGGTAAG | CCCCTAC | |
| | | | | GTCTGTATAGTCCCATGCAGGCAGCCAACCAGAGAATGGTGGCAAGAC | GGAGTGG | CCACAG | |
| | | | | CCCAGCTCCGTATGGGAGGGGAGGGCCAAGATATACGGAACGGCTGCT | CCTTCTAG | GTGAGA | |
| | | | | AAAGCGTTCTGCCGGTGTCAGTCTAATCACAGACAGCTGTGACGAAACA | TAGGGCTG | GGAGGA | |
| | | | | AAGTATGGGTTCCGACATGCTTGGTCAGCTCTTAGCCGCAAGGCTTAAA | CTTCAACC | GAAGAG | |
| | | | | TCGAACGCAGCCCGCCGAGAGTGAACATTAAACGGGGATGGAATGTGT | CCTCTGAT | GAATCT | |
| | | | | CTAGCGGTTACGTACTACCAGGGCTCAGGTTCGCCTGAGCCGAGGCTCT | GGGAGTG | GTCCCC | |
| | | | | ACACGTCATGGTGGGAGTTCTCCCCACGCTCGTGAGGGCATGTAGTGG | TACCGGGA | AACGGG | |
| | | | | GATGGCATGTGGCGGACCATCAGCTGGCACTACCAGGCCTCGGGCTTG | ACCTCGAC | AGGAGG | |
| | | | | CCCGAGTGCGGGACCTCACACATTGTAGGTGTGCTTGTCCCCCCTACGTT | TTGTAAGC | GTGAGG | |
| | | | | CGAAGACTTGAGGCGGAGAATACTCATAGGCCCCACGGCAAAGGGACA | ACAGGTTA | TGTAAG | |
| | | | | CAACACGGAGGCTTGTGTCCGACGAGCCGTGGACTCCTATAGACAGCCC | GTATGGGA | GGGGAG | |
| | | | | GGGATATCACTGGGCACGCTCATACTGAAGAAATTCGATGAACCGGGC | GCAGAAG | ACCTTCT | |
| | | | | CTACCGGAGCAAATGCACTCTAATCGCCTTTGTGGGCGACTGTGGCCCC | GGGGAGC | AGTAGG | |
| | | | | CTCATGCGAGTGAGGAATATCATAAACTGCAATGGTTCAAAAAGTGATT | CGTAATGG | GTCTTCT | |
| | | | | CCTATGGCTCGTCGGGGAGGGCTGACTGGGGCAAGCAAATGATTGAAA | GCTTCTCT | CAGTCG | |
| | | | | GGGGAAGAACCTTTTTCAACTGTTTCTTGCCAAGCCCGGTTGATGGTGG | TTCACCTG | CCTGAC | |
| | | | | CGCTAGTAATTGCGACGGGAAAATGCGGTTTAAGTCTCCGAAGTAGTGC | CTTACATA | GTCCTG | |
| | | | | GTAGCACCGGATGTCGACCGGGTGTAAAAGCCCTTCGTAAAGTCCCTGG | ATACCTGT | ACTGTG | |
| | | | | GGAGGTCAGTCCTGGGGCTACTGATGCGCAGTATGTAATTCGCAGAAT | GGTGCATG | GGGTGG | |
| | | | | AGGGCCATCGATACCGCCTGCGTGACTCGACTGGGTTTCCACTTGAGGA | TATCTAGG | ATCAGT | |
| | | | | TATCCGACCGTAGCGTGCACCCTCTTGTAGTTGCGCCGGAAACGGCTGT | TCTTGGCG | ACCCTAC | |
| | | | | GTTCCCTCACGTATGTGAGGAAACTCAACAATGTGAGTGGGTAAACGGC | GGAGAGT | AGGTGA | |
| | | | | GGGACGAACTATGGCTCTCGT (SEQ ID NO: 1095) | ACTGAGAG | GACCGG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | ACAAGGTT<br>GAGACCCC<br>AAGATTGG<br>GTCTCCCT<br>AGCCTCTA<br>TAGCTGCG<br>ACTCTTAG<br>CGGGGAT<br>ATGGAGTA<br>ACATGTAC<br>CAAGGGA<br>GTGAATAA<br>TAAAGGAA<br>TTGACGGG<br>GTACAAGT<br>GACTGTTG<br>GCCCGAAT<br>CCTAGCCA<br>CTTGATGA<br>CCAGGGAT<br>ATATTACA<br>GACTGAGA<br>GCGAATCT<br>AGAGACGT<br>GAGAATAA<br>AGTGAGA<br>ATTGGTTG<br>AGCGAATA<br>CAGAGGA<br>AG (SEQ ID<br>NO: 1218) | TGAGGT<br>AAGGGT<br>GTGGCC<br>CTCTTGA<br>GGGCTG<br>CGCCAA<br>CCCCTAC<br>TCGAGG<br>TAACCT<br>GAGGGA<br>GTGGTG<br>GAATGG<br>CGGCAT<br>GTTAGT<br>GCTGGG<br>ACTTGAT<br>TGCGAG<br>GGTTTA<br>ATGAGA<br>GTGGCC<br>TGCTGA<br>GAGCAA<br>CACTTGT<br>GGTGCT<br>TAAAGC<br>GGGGCG<br>GCCCAT<br>GACCAC<br>CGTGAG<br>ATAGGA<br>CACTGC<br>ACAGTG<br>CAGCCA<br>TGAGGT<br>TCCTGG<br>AGGATG<br>ATGCGA<br>TGAGGT<br>GGGGGC<br>CTCATCA<br>GCCCCTC<br>CTGGCA<br>GGGCGT<br>CGGCCA<br>GGGAAA<br>CTAAAT<br>GTCTCTA<br>GCATGT<br>CAGTGC | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | AGTGAG | |
| | | | | | | GTAAGG | |
| | | | | | | GGAGAG | |
| | | | | | | CACTCTA | |
| | | | | | | GTAGGG | |
| | | | | | | CTCTTCC | |
| | | | | | | AACCCCT | |
| | | | | | | ACCTGT | |
| | | | | | | AGGTCA | |
| | | | | | | CCTGGT | |
| | | | | | | CCAGGT | |
| | | | | | | GTCGAT | |
| | | | | | | GATGTG | |
| | | | | | | AAAACA | |
| | | | | | | AGAGCT | |
| | | | | | | ACTTTG | |
| | | | | | | GTACCG | |
| | | | | | | GTCTGTT | |
| | | | | | | GCAAAA | |
| | | | | | | AGGGTT | |
| | | | | | | CTGCAG | |
| | | | | | | AGGACG | |
| | | | | | | ACGGCT | |
| | | | | | | ATCCCTA | |
| | | | | | | TCGGGA | |
| | | | | | | GGGAAT | |
| | | | | | | AGTCGG | |
| | | | | | | TCCCAG | |
| | | | | | | GTAGTG | |
| | | | | | | GAAAAT | |
| | | | | | | GGGGCT | |
| | | | | | | TTCCACT | |
| | | | | | | GAGCAT | |
| | | | | | | GAAAAT | |
| | | | | | | GTGGTA | |
| | | | | | | GAGGTT | |
| | | | | | | GCGTCC | |
| | | | | | | AACCCA | |
| | | | | | | ATGATTT | |
| | | | | | | GCAGCA | |
| | | | | | | GAGCTC | |
| | | | | | | TTGGAC | |
| | | | | | | ACGAAG | |
| | | | | | | TCTGTAT | |
| | | | | | | AGTCCC | |
| | | | | | | ATGCAG | |
| | | | | | | GCAGCC | |
| | | | | | | AACCAG | |
| | | | | | | AGAATG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GTGGCA | |
| | | | | | | AGACCC | |
| | | | | | | CAGCTC | |
| | | | | | | CGTATG | |
| | | | | | | GGAGGG | |
| | | | | | | GAGGGC | |
| | | | | | | CAAGAT | |
| | | | | | | ATACGG | |
| | | | | | | AACGGC | |
| | | | | | | TGCTAA | |
| | | | | | | AGCGTT | |
| | | | | | | CTGCCG | |
| | | | | | | GTGTCA | |
| | | | | | | GTCTAAT | |
| | | | | | | CACAGA | |
| | | | | | | CAGCTG | |
| | | | | | | TGACGA | |
| | | | | | | AACAAA | |
| | | | | | | GTATGG | |
| | | | | | | GTTCCG | |
| | | | | | | ACATGC | |
| | | | | | | TTGGTC | |
| | | | | | | AGCTCTT | |
| | | | | | | AGCCGC | |
| | | | | | | AAGGCT | |
| | | | | | | TAAATC | |
| | | | | | | GAACGC | |
| | | | | | | AGCCCG | |
| | | | | | | CCGAGA | |
| | | | | | | GTGAAC | |
| | | | | | | ATTAAA | |
| | | | | | | CGGGGA | |
| | | | | | | TGGAAT | |
| | | | | | | GTGTCT | |
| | | | | | | AGCGGT | |
| | | | | | | TACGTA | |
| | | | | | | CTACCA | |
| | | | | | | GGGCTC | |
| | | | | | | AGGTTC | |
| | | | | | | GCCTGA | |
| | | | | | | GCCGAG | |
| | | | | | | GCTCTAC | |
| | | | | | | ACGTCA | |
| | | | | | | TGGTGG | |
| | | | | | | GAGTTC | |
| | | | | | | TCCCCAC | |
| | | | | | | GCTCGT | |
| | | | | | | GAGGGC | |
| | | | | | | ATGTAG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | TGGGAT | |
| | | | | | | GGCATG | |
| | | | | | | TGGCGG | |
| | | | | | | ACCATC | |
| | | | | | | AGCTGG | |
| | | | | | | CACTACC | |
| | | | | | | AGGCCT | |
| | | | | | | CGGGCT | |
| | | | | | | TGCCCG | |
| | | | | | | AGTGCG | |
| | | | | | | GGACCT | |
| | | | | | | CACACA | |
| | | | | | | TTGTAG | |
| | | | | | | GTGTGC | |
| | | | | | | TTGTCCC | |
| | | | | | | CCCTAC | |
| | | | | | | GTTCGA | |
| | | | | | | AGACTT | |
| | | | | | | GAGGCG | |
| | | | | | | GAGAAT | |
| | | | | | | ACTCATA | |
| | | | | | | GGCCCC | |
| | | | | | | ACGGCA | |
| | | | | | | AAGGGA | |
| | | | | | | CACAAC | |
| | | | | | | ACGGAG | |
| | | | | | | GCTTGT | |
| | | | | | | GTCCGA | |
| | | | | | | CGAGCC | |
| | | | | | | GTGGAC | |
| | | | | | | TCCTATA | |
| | | | | | | GACAGC | |
| | | | | | | CCGGGA | |
| | | | | | | TATCACT | |
| | | | | | | GGGCAC | |
| | | | | | | GCTCAT | |
| | | | | | | ACTGAA | |
| | | | | | | GAAATT | |
| | | | | | | CGATGA | |
| | | | | | | ACCGGG | |
| | | | | | | CCTACC | |
| | | | | | | GGAGCA | |
| | | | | | | AATGCA | |
| | | | | | | CTCTAAT | |
| | | | | | | CGCCTTT | |
| | | | | | | GTGGGC | |
| | | | | | | GACTGT | |
| | | | | | | GGCCCC | |
| | | | | | | CTCATGC | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | GAGTGA | |
| | | | | | | GGAATA | |
| | | | | | | TCATAA | |
| | | | | | | ACTGCA | |
| | | | | | | ATGGTT | |
| | | | | | | CAAAAA | |
| | | | | | | GTGATT | |
| | | | | | | CCTATG | |
| | | | | | | GCTCGT | |
| | | | | | | CGGGGA | |
| | | | | | | GGGCTG | |
| | | | | | | ACTGGG | |
| | | | | | | GCAAGC | |
| | | | | | | AAATGA | |
| | | | | | | TTGAAA | |
| | | | | | | GGGGAA | |
| | | | | | | GAACCT | |
| | | | | | | TTTTCAA | |
| | | | | | | CTGTTTC | |
| | | | | | | TTGCCA | |
| | | | | | | AGCCCG | |
| | | | | | | GTTGAT | |
| | | | | | | GGTGGC | |
| | | | | | | GCTAGT | |
| | | | | | | AATTGC | |
| | | | | | | GACGGG | |
| | | | | | | AAAATG | |
| | | | | | | CGGTTT | |
| | | | | | | AAGTCT | |
| | | | | | | CCGAAG | |
| | | | | | | TAGTGC | |
| | | | | | | GTAGCA | |
| | | | | | | CCGGAT | |
| | | | | | | GTCGAC | |
| | | | | | | CGGGTG | |
| | | | | | | TAAAAG | |
| | | | | | | CCCTTCG | |
| | | | | | | TAAAGT | |
| | | | | | | CCCTGG | |
| | | | | | | GGAGGT | |
| | | | | | | CAGTCCT | |
| | | | | | | GGGGCT | |
| | | | | | | ACTGAT | |
| | | | | | | GCGCAG | |
| | | | | | | TATGTA | |
| | | | | | | ATTCGC | |
| | | | | | | AGAATA | |
| | | | | | | GGGCCA | |
| | | | | | | TCGATA | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | CCGCCT | |
| | | | | | | GCGTGA | |
| | | | | | | CTCGACT | |
| | | | | | | GGGTTT | |
| | | | | | | CCACTTG | |
| | | | | | | AGGATA | |
| | | | | | | TCCGAC | |
| | | | | | | CGTAGC | |
| | | | | | | GTGCAC | |
| | | | | | | CCTCTTG | |
| | | | | | | TAGTTG | |
| | | | | | | CGCCGG | |
| | | | | | | AAACGG | |
| | | | | | | CTGTGTT | |
| | | | | | | CCCTCAC | |
| | | | | | | GTATGT | |
| | | | | | | GAGGAA | |
| | | | | | | ACTCAA | |
| | | | | | | CAATGT | |
| | | | | | | GAGTGG | |
| | | | | | | GTAAAC | |
| | | | | | | GGCGGG | |
| | | | | | | ACGAAC | |
| | | | | | | TATGGC | |
| | | | | | | TCTCGT | |
| | | | | | | (SEQ ID | |
| | | | | | | NO: | |
| | | | | | | 1341) | |
| R2 | R2- | — | *Tribolium* | AGTCATAGAGCCAGAACCTCCTCGTGGTCCCGCTGGGCACAGGGATTAA | AGTCATAG | TGAAAA | MSRRPGKSNEPPVRS |
| | 1_TCas | | *castaneum* | TTTTTCTGTGGCAAATTTGACTGGCTTCAGAGAGCGTTTTTCGAAGTGG | AGCCAGAA | GAGTGG | RAMGLTTLSGTKTSN |
| | | | | WCTGTGTGACTGCGTTCCCCCCTTAGTTGCTATWTCCGCTKMGATTAAC | CCTCCTCG | CAGTTG | SGAQGPSTSAPMQN |
| | | | | ATCTCACCTCGACGTWTAAGATCATTATGTCGAGGCGCCCGGGGAAGT | TGGTCCCG | TGGAGA | MAGGFVCDCGRSYA |
| | | | | CTAATGAGCCCCCGGTTCGTAGTAGGGCTATGGGTTTAACCACTTTATCT | CTGGGCAC | CTTCCTT | LKTSLARHKKECGKN |
| | | | | GGCACCAAGACATCAAATTCTGGTGCCCAGGGGCCCTCTACCAGTGCCC | AGGGATTA | CGGACG | NAECRWCGTRFNTL |
| | | | | CCATGCAGAACATGGCTGGGGGTTTTGTTTGTGACTGCGGCCGGAGCTA | ATTTTTCT | TCGGGT | AGTRQHERKAHFVQ |
| | | | | TGCCTTGAAGACATCTCTGGCCCGACACAAGAAGGAGTGCGGAAAGAA | GTGGCAAA | CGGATT | YQSDLAKALPQPESE |
| | | | | CAATGCGGAGTGTCGATGGTGCGGGACAAGGTTTAACACCTTGGCTGG | TTTGACTG | TTCGGA | LMEKIAIVEARSXNGI |
| | | | | CACTCGTCAGCATGAGCGAAAGGCTCACTTTGTCCAGTATCAGTCTGAT | GCTTCAGA | CGCCAG | FYKEMMASTGLTHQ |
| | | | | CTGGCAAAGGCGCTCCCCCAACCTGAGTCGGAGCTTATGGAGAAAATC | GAGCGTTT | GGTACC | QVRSRREKPEYKGFL |
| | | | | GCCATTGTGGAGGCCAGGTCCAKTAACGGCATCTTCTATAAGGAGATGA | TTCGAAGT | TCCACC | ERARRSLAQTNIRAG |
| | | | | TGGCCTCCACGGGTCTGACCCACCAACAGGTCAGATCAAGGAGAGAGA | GGWCTGT | GCTGGG | SISPASTXAGSLESAS |
| | | | | AACCCGAATATAAGGGCTTCCTGGAGCGAGCACGCAGGAGCCTGGCCC | GTGACTGC | TTCACAA | PKAGCSSSASPGPTT |
| | | | | AGACCAATATCAGGGCTGGCTCCATCTCACCAGCGAGTACGAWCGCAG | GTTCCCCC | ACTAGG | RSRAPTKGVPXRSSN |
| | | | | GCTCTTTGGAGTCTGCGTCTCCGAAAGCGGGGTGTAGTAGCAGTGCCTC | CTTAGTTG | CGAACA | SARIVVEAQVHTRAP |
| | | | | GCCCGGACCGACCACCAGGTCCAGGGCACCTACCAAGGGTGTGCCCCW | CTATWTCC | TCTGCC | PNTGETEVALRESRR |
| | | | | ACGAAGCTCTAATTCGGCGAGAATTGTGGTGGAGGCCCAAGTCCATACC | GCTKMGA | GATACC | TVPRLGXNPSRPCGIS |
| | | | | CGGGCGCCACCCAATACCGGGGAAACGGAAGTGGCTCTTCGTGAGTCA | TTAACATC | CTCTTTA | PLMAIAIDEDSVLGG |
| | | | | CGCCGAACCGTGCCCCGGCTCGGGCMTAATCCATCTAGGCCCTGTGGT | TCACCTCG | GGTCAT | LRVQAGPSPTAVHSV |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATCTCTCCTTTGATGGCGATTGCCATAGATGAAGACTCTGTGTTGGGCG | ACGTWTA | AGGACC | EAFPGTSSMTPMET |
| | | | | GGCTACGAGTGCAGGCCGGGCCAAGTCCCACCGCGGTGCACTCCGTCG | AGATCATT | ACATGT | DRVHNKSGIDPILEH |
| | | | | AAGCTTTCCCCGGAACGTCCTCGATGACCCCGATGGAGACCGATCGGGT | (SEQ ID | CTCTGCA | NGTRQVRREESSTRE |
| | | | | ACATAATAAGTCCGGTATAGACCCCATTCTCGAACATAATGGGACACGG | NO: 1219) | CGAGAT | DPVEQWSPNYPKTP |
| | | | | CAGGTTCGAAGGGAGGAGTCTTCCACACGGGAAGACCCCGTCGAGCAA | | TAACCC | VTMPNITTTADAXXT |
| | | | | TGGTCTCCCAACTATCCTAAAACGCCTGTCACTATGCCCAACATTACAAC | | A (SEQ | SYNRTPQTLPGNRRR |
| | | | | TACTGCTGATGCTWCGTKCACCTCGTACAACCGAACACCTCAGACACTC | | ID NO: | RSRSLPPVQRKSASD |
| | | | | CCTGGAAACCGGAGGCGACGCAGTCGCAGTCTACCACCAGTGCAACGG | | 1342) | XLESVDSLGPWAVFL |
| | | | | AAATCCGCTTCCGACGAWCTCGAGTCCGTTGATTCGCTGGGGCCCTGG | | | QDQVDAGSLSGNDS |
| | | | | GCGGTCTTCTTGCAAGATCAAGTAGACGCCGGGTCACTAAGCGGCAAC | | | LADLVRVALTKSDRG |
| | | | | GACTCGCTGGCGGATCTGGTGAGGGTGGCTCTCACTAAGTCCGATCGC | | | VLNDAVNRYLAQRA |
| | | | | GGTGTCCTTAATGATGCCGTGAATCGGTATCTGGCCCAAAGGGCGGAG | | | ESLRIRKRGSKGKRKS |
| | | | | AGCTTGAGGATACGTAAGCGAGGCAGTAAGGGCAAAAGAAAGAGTAA | | | KTGRHYGQTTSGSG |
| | | | | GACTGGTCGCCACTATGGCCAAACAACATCTGGCAGTGGTCAAAGAGCT | | | QRAALFKKHQDLFLK |
| | | | | GCGCTCTTTAAAAAGCACCAGGACCTCTTTCTGAAAAACAGGCGAGGAT | | | NRRGLAETILSGKEDF |
| | | | | TGGCGGAGACTATCTTGTCGGGGAAGGAGGATTTTGGTCCTAGACCTG | | | GPRPEPPVTSVEEFY |
| | | | | AACCTCCCGTAACAAGTGTGGAAGAGTTCTACGGCGGCATTTTCGAGTC | | | GGIFESPSPPDNEPFE |
| | | | | GCCTTCTCCTCCCGATAACGAACCCTTCGAAGTCCGTGCTACTGGCGTCG | | | VRATGVEDPPPLTSP |
| | | | | AAGACCCCCCCCCACTTACATCACCATGGACGAAATAAAGGCGGCAAGA | | | WTKRTLRSPCYWRR |
| | | | | GCCGGTTGGCAGATTTCAGCGCCTGGATCTGACCAAATACCGGTCGCGG | | | RPPPTYITMDEIKAAR |
| | | | | CCGTCAAAACTATGTCCGAGCTGGAACTGGCGATACTGTTCAATATTAT | | | AGWQISAPGSDQIPV |
| | | | | ATTGTTCAGAAACGTCCAGCCTTCAGCCTGGGGGGTACTTCGTACGACG | | | AAVKTMSELELAILFN |
| | | | | CTGGTTCCCAAAGATGGGGATCTTAGAAATCCGGCCAACTGGCGGCCCA | | | IILFRNVQPSAWGVL |
| | | | | TTACWATCAGTTCTGCCCTGCAGCGTCTTTTGCATAGAGTATTGGCGGC | | | RTTLVPKDGDLRNPA |
| | | | | CCGTCTTTCGAAGTTGGTCTCGTTGAGTTCGTCTCAGCGGGGCTTTACCG | | | NWRPITISSALQRLLH |
| | | | | AGATTGACGGTACTCTAGCGAATGCGCTGATACTGCATGAATATTTGCA | | | RVLAARLSKLVSLSSS |
| | | | | GTATCGCAGGCAGACTGGCCGCACCTACCASGTCGTGTCTCTGGACGTC | | | QRGFTEIDGTLANALI |
| | | | | AGAAAGGCGTTTGACACGGTTTCCCACTGCTCTGTTAGTAGAGCCCTGG | | | LHEYLQYRRQTGRTY |
| | | | | GTCGTTTTGGTATCCCCTCTGTTATCAGGGAATACATCCTGGCCACATTT | | | XVVSLDVRKAFDTVS |
| | | | | GGCGCACAGACGACCATAAAATGTGGGAGCGTTACGACAAGACCGATA | | | HCSVSRALGRFGIPSV |
| | | | | AGGATGCTCCGTGGAGTGAGACAGGGTGACCCTCTTAGCCCGGTCCTAT | | | IREYILATFGAQTTIKC |
| | | | | TCAATCTTGTGATGGATGAGCTTCTGGAAAAGGTCAATGAGAAATACGA | | | GSVTTRPIRMLRGVR |
| | | | | GGGCGGCTCACTGCAAAGCGGCGAACGCTGTGCCATCATGGCGTTTGC | | | QGDPLSPVLFNLVM |
| | | | | TGACGACCTCATCCTGATTGCTGACCGAGATCAGGATGTACCCGCAATG | | | DELLEKVNEKYEGGSL |
| | | | | TTCGATGATGTTTCGACATTTCTCGAGCGGCGCGGGATGTCTGTCAACC | | | QSGERCAIMAFADDL |
| | | | | CTGCCAAGTGCAGAGCGTTGATTGCGGGCGCGGTGAGCGGGAGAAGT | | | ILIADRDQDVPAMFD |
| | | | | GTTGTGAGGACAGGCAGCTCTTATAAGATCCATAACACGCCGATTCCAA | | | DVSTFLERRGMSVNP |
| | | | | ATGTCGACGCCCTAGATGCATTTAAGTATCTGGGGCTAGAATTTGGCCA | | | AKCRALIAGAVSGRS |
| | | | | CAAAGGCGTAGAGCGCCCCACAATCCACAACCTCTCCGTCTGGCTTAAC | | | VVRTGSSYKIHNTPIP |
| | | | | AACCTCAGACGAGCCCCTCTCAAACCGGACCAAAAATGCTTATTCATCCG | | | NVDALDAFKYLGLEF |
| | | | | GCAATATGTCATCCCTCGATTGCTCTACGGCATGCAAAATCCTCAAGTTA | | | GHKGVERPTIHNLSV |
| | | | | CCTCTAGGGTACTTCGAGAAGCTGACCGTCTGATAAGGAGACACTTAAA | | | WLNNLRRAPLKPDQ |
| | | | | GACATACTACCATCTTAATGTCCATACTCCAGATTCTCTTATTCACGCGA | | | KCLFIRQYVIPRLLYG |
| | | | | GTGTGAGTGACGGAGGTCTGGGTATAATGGAATTGCGTAAAGCAATTC | | | MQNPQVTSRVLREA |
| | | | | CAAGAATTTTCCTAGGACGGCTAGTTAAGCTTCTCAACAAAAACAAAGA | | | DRLIRRHLKTYYHLNV |
| | | | | TTCGGTCTTAAGTTCGGTCCTGCAGTCTAACCGTGTGAGAACACTAATG | | | HTPDSLIHASVSDGG |
| | | | | GGCAAATTATCAACCATGGCGGGTGAAGTACCGGAGTCGACGTTTTGG | | | LGIMELRKAIPRIFLG |
| | | | | AGAAATCAGATTGCCTCGGGTCCCCTTTCGAAGGGTCTCGAACAGGCGG | | | RLVKLLNKNKDSVLSS |
| | | | | CCGAGGACTCCGCAAGTCGACTCTGGATCAGCGAGAAACCTTCCGGTTG | | | VLQSNRVRTLMGKLS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTCGGGTAGAGATCATGTCCGTGCAGTCCAACTTCGCACGGGCAACCTC | | | TMAGEVPESTFWRN |
| | | | | CCGACCAAAGCCATTCCATCGGTGCCGGTTGGTCAGAGACGCTGCAGAC | | | QIASGPLSKGLEQAA |
| | | | | ACGGATGTGCCTGCGATGAATCGATATCGCATGTGCTGCAGATGTGCCC | | | EDSASRLWISEKPSG |
| | | | | CCTGACGCACGCTGATCGGATTCGCAGGCACGATGAAGTGGTTAAGAA | | | WSGRDHVRAVQLRT |
| | | | | AGTAGCCCGCCATTGCACCTCACGCGGTTGGACGGTGGAAGTCGAGCC | | | GNLPTKAIPSVPVGQ |
| | | | | ACACATTCGCTCTAGGTGTGGTAGGCTTTTTAAGCCTGACCTGGCAGTCC | | | RRCRHGCACDESISH |
| | | | | ATCAGCCAGGCGGCGCCATTGTGATAGCGGATGTCCAGGTATCATGGG | | | VLQMCPLTHADRIRR |
| | | | | ATTCCGAAAGCTTGACGGTACCTTACGAACGCAAGCGAGCTAAGTACGA | | | HDEVVKKVARHCTSR |
| | | | | CGTGCCCCAATTCCATCAGGCGGCACAACATGCATGGCCGGGTAAGGC | | | GWTVEVEPHIRSRCG |
| | | | | ACTTACGTTTGCCCCTGTAATAGTGGGCGCCCGGGGCATATGGCCCCGG | | | RLFKPDLAVHQPGGA |
| | | | | ATAAACAACGACCGCTCTGCGGCGTTGCAGATTCCTCCGGTCGTGCGAC | | | IVIADVQVSWDSESL |
| | | | | GAGCTTGCGTAAATTCGGTTGTCAAGTGGGGGTCGTCGATCCATGCTAC | | | TVPYERKRAKYDVPQ |
| | | | | CTTTATGAGGTCAGTATGGGCAAATCGACTCAACCCCCGACCCTTAAGG | | | FHQAAQHAWPGKA |
| | | | | GCTTGAAAAGAGTGGCAGTTGTGGAGACTTCCTTCGGACGTCGGGTCG | | | LTFAPVIVGARGIWP |
| | | | | GATTTTCGGACGCCAGGGTACCTCCACCGCTGGGTTCACAAACTAGGCG | | | RINNDRSAALQIPPV |
| | | | | AACATCTGCCGATACCCTCTTTAGGTCATAGGACCACATGTCTCTGCACG | | | VRRACVNSVVKWGS |
| | | | | AGATTAACCCA (SEQ ID NO: 1096) | | | SIHATFMRSVWANR |
| | | | | | | | LNPRPLRA (SEQ ID NO: 1464) |
| R2 | R2-1_TGut | — | *Tinamus guttatus* | CTGGGGACCGTGGTTACAACCCGGGCTTAGCTGCAGAGACAGTACCTCC | CTGGGGAC | TAGGGG | MGSWIVNFVSVATQ |
| | | | | CCGTGGTTCCCGCCGGACCCCGTAACATCGGGTGACTGAATCTGTCTCT | CGTGGTTA | GCTTGG | TGEFPVDTARRAPVP |
| | | | | GCCCCGGGAGTAGTTCCTCCTTGCCCTATTGACCAGCGGTCGCCGGCTG | CAACCCGG | CATTTCT | VTSYPESECHXPLPLT |
| | | | | CTCAATAGTATTCTAGGCGTGAAATATAGCGATAGTCCTAGTGGTTGTCT | GCTTAGCT | CATTGCC | FCNSDVTIWGGVRPE |
| | | | | TACTGGGCCATAGCCCCTTGCTTCAGGGGTCATTCGCGAAGTCTCTCAG | GCAGAGA | TGCTCCT | PVDCLGDLPEXYDAL |
| | | | | GAGAACTGGGGGTGGTGTTCTTCTGGGTATAGCTAAACCCCCTAGACTG | CAGTACCT | GAAAGG | PGVAGPREXVGGSP |
| | | | | TGTCCGATCCATGGGGTCCTGGATCGTGAATTTCGTTTCGGTGGCGACT | CCCCGTGG | ATATGG | PGEGVRSPGIASPSG |
| | | | | CAGACGGGAGAATTCCCTGTGGATACGGCCAGGAGGGCACCTGTGCCG | TTCCCGCC | GTCCTG | TAVQHDFGSPILVPG |
| | | | | GTAACATCATACCCTGAGTCGGAATGCCACNTACCGTTGCCCCTGACATT | GGACCCCG | CGTCGC | AEAAEVSTPVVKVPQ |
| | | | | TTGTAACTCGGATGTGACTATTTGGGGAGGGGTTCGCCCTGAACCGGTG | TAACATCG | GTGGTA | DHPACPCCGTRVVK |
| | | | | GACTGCTTGGGWGATCTTCCRGAGGYGTATGATGCACTCCCAGGGGTG | GGTGACTG | GGCAGA | VTALSEHLRRAHGRK |
| | | | | GCTGGGCCTCGGGAAYCGGTGGGTGGGAGCCCGCCGGGRGAAGGGGT | AATCTGTC | CCCATTC | RVLFQCSRCGRMNE |
| | | | | CAGGTCGCCAGGGATTGCGTCRCCCTCTGGTACTGCGGTCCAACATGAT | TCTGCCCC | GTCCGA | KHHSIACHFPKCRGP |
| | | | | TTTGGGAGTCCCATCCTCGTACCGGGAGCCGAAGCCGCCGAGGTNTCTA | GGGAGTA | GTAGGG | PVEEGPLGAPEWCCE |
| | | | | CCCCGGTAGTGAAGGTTCCNCAAGACCATCCAGCATGTCCNTGCTGTGG | GTTCCTCC | GGCTTG | ECGQKFNTKSGLSQH |
| | | | | TACGAGGGTGGTGAAAGTAACGGCGTTGTCAGAACATCTTAGGAGGGC | TTGCCCTA | GCAGTN | KRSVHPLTRNVERIEA |
| | | | | CCACGGTCGGAAACGGGTCCTATTTCAGTGCTCCCGATGCGGGAGGAT | TTGACCAG | TCCATTG | ARPKGKGKRGAHKG |
| | | | | GAATGAGAAACATCATAGCATCGCGTGCCATTTCCCGAAGTGCCGGGG | CGGTCGCC | CCTGTG | CWTEAEVAQLIELEG |
| | | | | GCCCCCAGTTGAGGAGGGTCCCCTGGGTGCACCCGAGTGGTGCTGTGA | GGCTGCTC | CCCGAA | RFKNQRFINKLIAEHL |
| | | | | GGAGTGCGGGCAGAAATTTAACACCAAAAGCGGCCTGTCTCAGCACAA | AATAGTAT | AGGACG | PSKSAKQISDKRRQL |
| | | | | AAGATCTGTGCACCCACTTACGAGGAATGTGGAACGGATAGAGGCAGC | TCTAGGCG | TGGGTC | AAATKTSSPEKRVTSS |
| | | | | TCGTCCGAAAGGAAAAGGGAAGCGTGGTGCCCACAAAGGCTGTTGGAC | TGAAATAT | ATCTGG | TSGESSPEVEKVEGIK |
| | | | | CGAGGCGGAGGTGGCCCAGCTGATTGAACTGGAGGGGAGATTCAAGA | AGCGATAG | TCTGTCT | REYRRRVGEWLCAG |
| | | | | ACCAGCGATTTATCAACAAGCTGATCGCGGAGCATTTGCCATCGAAATC | TCCTAGTG | GCCTAC | SLXDQTSFQKILEDVE |
| | | | | GGCGAAGCAGATCAGCGATAAGAGAAGGCAGCTGGCGGCAGCGACCA | GTTGTCTT | ACCTCTC | SGSEIVTGPLEELASF |
| | | | | AGACATCGTCGCCCGAGAAGAGGGTAACGTCATCAACGAGTGGGGAGT | ACTGGGCC | TAGACTT | ARGKLAAARVRHHR |
| | | | | CCTCCCCTGAAGTGGAAAAGGTGGAGGGTATCAAGAGAGAATATAGAA | ATAGCCCC | GTAACA | KHPAEAVPAREEQR |
| | | | | GGCGTGTTGGAGAGTGGTTGTGCGCTGGGTCCCTGMAGGACCAGACN | TTGCTTCA | TCTAGTC | WMKRRVGRRGLYLR |
| | | | | TCGTTCCAGAAGATCTTGGAAGATGTGGAGAGCGGCTCCGAGATTGTC | GGGGTCAT | TGTCAA | FQRLFALDRRKLAGII |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACCGGTCCGCTGGAGGAACTGGCCTCCTTTGCGAGGGGGAAGCTCGCG | TCGCGAAG | CAAGAT | LDDVESIKCPLPMEE |
| | | | | GCAGCTAGAGTGCGACATCATCGTAAGCACCCAGCTGAGGCCGTGCCT | TCTCTCAG | CAAAAT | VADVFRRRWEEVAP |
| | | | | GCGCGAGAGGAGCAGAGGTGGATGAAGCGCAGGGTGGGTCGTCGGG | GAGAACTG | TCTTCAC | FTGSGSFRSLGKADN |
| | | | | GCTTGTACCTCAGGTTCCAGCGGCTTTTTGCNTTGGATCGCAGRAAGCTT | GGGGTGG | ACAGAC | GAFKPMISAKEVMK |
| | | | | GCTGGGATCATCCTCGACGATGTCGAGTCCATCAAGTGCCCCCTTCCGA | TGTTCTTCT | GACCGA | NVXEMSRRSAXGPD |
| | | | | TGGAAGAAGTCGCTGACGTCTTCAGGAGAAGGTGGGAGGAGGTCGCC | GGGTATAG | GCTTGC | GLSLRDLMKIDPQGS |
| | | | | CCCTTTACCGGCTCGGGCTCATTCCGAAGTTTGGGGAAGGCTGACAACG | CTAAACCC | TCAGTCT | RMAELFNLWLLAGR |
| | | | | GTGCCTTCAAGCCCATGATCTCCGCYAAGGAGGTCATGAAGAACGTCRC | CCTAGACT | TCCTGTA | VPDQVKAGRTVLIPK |
| | | | | GGAGATGTCTCGACGCTCCGCGCYGGGWCCCGAYGGCCTCTCCCTGCG | GTGTCCGA | CCCGCA | SADPGKIGNIDNWR |
| | | | | GGATCTGATGAAGATTGATCCCCAGGGCAGCCGCATGGCTGAATTGTTC | TCC (SEQ | GAATTTT | PITIGSVXLRMFSRILS |
| | | | | AACCTGTGGCTGTTGGCAGGACGGGTCCCGGACCAAGTGAAGGCGGGC | ID NO: | GCTCTT | ARLRRACPINRRQRG |
| | | | | CGAACGGTCCTGATCCCNAAGTCGGCCGATCCCGGGAAGATCGGGAAC | 1220) | GCTCTCC | FIAAPGCSENLKLLQA |
| | | | | ATTGACAACTGGCGGCCCATCACCATCGGGTCCGTTATNCTCAGAATGT | | TTTGGCT | LIKSAKRDHRTLGVVF |
| | | | | TCTCTCGGATTTTGAGCGCTAGACTGCGGCGAGCATGCCCCATTAATAG | | GTGTCC | VDLAKAFDSVNHQHI |
| | | | | AAGGCAAAGGGGGTTTATAGCAGCCCCTGGCTGCTCGGAAAATCTGAA | | TGGACG | FQVLVQKGVDGHIID |
| | | | | GCTTCTCCAGGCGCTCATCAAGAGCGCGAAACGAGATCATAGGACCCTT | | TGGGAC | ILRDLYTNAGTYLESG |
| | | | | GGAGTCGTGTTTGTCGATTTGGCTAAGGCCTTCGACTCCGTGAACCACC | | TATTCCA | SQRSGFIKILRGVKQG |
| | | | | AGCATATCTTCCAAGTCCTGGTCCAGAAGGGTGTCGATGGGCATATTAT | | TCTCGTC | DPLSPILFNLALDPLLC |
| | | | | CGACATCCTAAGAGACCTGTATACCAACGCTGGAACGTATCTGGAGTCA | | CCAAAT | RLEDRGLGYKYGDQ |
| | | | | GGTTCCCAGCGATCGGGATTTATTAAGATCCTCAGGGGAGTGAAACAR | | GCCGCG | QIXSLAFADDLALLSD |
| | | | | GGGGACCCACTCTCTCCCATCCTGTTCAATCTTGCATTAGATCCTTTGCTG | | TCCAATT | SWEGMQQSIRVVEE |
| | | | | TGCCGCCTGGAAGATCGGGGCCTCGGTTATAAGTATGGAGACCAACAA | | ATACCG | FCQRTGLRVQAPKC |
| | | | | ATAWCATCGTTGGCATTTGCGGATGATCTCGCCCTGCTCAGCGACTCTT | | GATTTG | HGFLIRPTKESYTIND |
| | | | | GGGAGGGCATGCAGCAGAGTATTCGGGTGGTAGAGGAATTTTGTCAAC | | ACAAAG | CDPWTIADMQLDMI |
| | | | | GGACCGGGCTGCGGGTTCAAGCGCCGAAATGCCACGGGTTTTTGATCA | | CGGACG | DPGSSEKYLGLGIDP |
| | | | | GGCCAACTAAAGAGTCATATACCATCAATGACTGTGACCCGTGGACGAT | | GCCCGC | WIGLSRPELSEVLTR |
| | | | | TGCAGATATGCAATTGGATATGATCGATCCGGGCAGTTCCGAGAAGTAT | | TTTATAA | WVKNIGGAPLKPLQ |
| | | | | CTTGGCCTAGGGATAGACCCATGGATTGGTCTATCGAGACCGGAACTGT | | GCCGGA | KVDILRSYALPRLLFIA |
| | | | | CCGAGGTGCTGACCCGCTGGGTGAAGAACATCGGGGGCGCCCCTTTGA | | AAAGGT | DHAGLSATCLHSLDL |
| | | | | AGCCACTCCAGAAGGTGGACATCTTGAGGAGCTACGCCCTNCCAAGGC | | GCCTTG | SIRSAVKGWLHLPPS |
| | | | | TGCTGTTCATTGCGGATCACGCAGGCCTGAGCGCCACCTGTTTGCATTCC | | TAAAATT | TCDAIIYVSYKDGGLG |
| | | | | CTGGACCTTTCGATAAGATCTGCCGTCAAGGGCTGGTTACATCTACCGC | | GCAAGG | LPRLASLIPNVQARRL |
| | | | | CTAGTACGTGTGACGCTATTATTTACGTCAGCTACAAGGACGGCGGGCT | | TTCATTA | VRIAQSEDDVIRSVVL |
| | | | | GGGTCTTCCCCGTCTGGCGAGCCTAATTCCAAATGTACAGGCTCGCAGG | | AATAG | QEGIQEEIRKVWISA |
| | | | | TTGGTGCGGATCGCCCAATCGGAGGATGATGTCATCAGGAGTGTGGTA | | (SEQ ID | GGRPEKVPSVTGEFP |
| | | | | CTCCAGGAGGGTATCCAGGAGGAGATCCGGAAGGTCTGGATCTCGGCT | | NO: | VMEAQAADEALSEW |
| | | | | GGGGGGCGACCGGAGAAGGTTCCATCTGTGACGGGGGAGTTCCCAGT | | 1343) | ERRAPRTIYPIPCKWR |
| | | | | GATGGAGGCTCAGGCGGCTGACGAGGCCCTATCCGAGTGGGAGAGGC | | | KREMENWTNLKSQG |
| | | | | GAGCTCCACGAACCATCTATCCCATTCCCTGTAAGTGGAGGAAGAGAGA | | | HGIRNFENDRISND |
| | | | | AATGGAGAATTGGACCAATCTAAAATCGCAAGGCCACGGGATTCGGAA | | | WLLHYGRIPHRKLITA |
| | | | | TTTTGAAAATGACCGAATCAGTAATGATTGGCTCCTGCATTATGGCCGC | | | IQLRANVYPTREFLAR |
| | | | | ATTCCCCACCGCAAACTAATAACAGCTATCCAGTTGCGGGCCAATGTCTA | | | GLGEGAPRGCRHCP |
| | | | | TCCCACWCGGGAGTTTTTGGCCCGCGGCCTGGGCGAGGGCGCACCCAG | | | AEWESCSHIIGYCPA |
| | | | | GGGATGTAGGCACTGTCCCGCGGAGTGGGAATCTTGTTCCCACATAATT | | | VQEARIKRHNDICGV |
| | | | | GGCTACTGCCCGGCTGTCCAGGAGGCCAGGATCAAAAGGCATAATGAC | | | LAEEARKLGWVIFIEP |
| | | | | ATCTGTGGTGTGCTGGCTGAAGAGGCNAGAAAGCTGGGATGGGTGATA | | | HLRDNTNELFKPDLV |
| | | | | TTTATAGAGCCCCATCTCAGAGATAACACCAATGAGCTCTTCAAGCCAG | | | LVKGSCAKVVDVTIR |
| | | | | ATTTGGTTTTGGTGAAGGGATCCTGTGCGAAGGTAGTGGATGTAACCAT | | | YESGLTTLSDAAAEKA |
| | | | | CCGCTACGAGAGTGGGTTAACCACCTTGAGTGACGCCGCGGCAGAAAA | | | RKYQHLAGEVRALTS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCTAGGAAGTATCAACATCTGGCAGGGGAGGTGCGGGCCCTAACATC<br>GGCCACTACTGTAGACTTCCTGGGTTTCCCTATTGGCGCTAGAGGGAAG<br>TGGTACGTTGGTAATAATGGACTCCTTTCCGACCTTGGGTTCTCCACTAG<br>CCGTGTAGTGCGGATAGCGAGGGCCCTCTCTAAAAAGGCTCTCCTATCG<br>TCCGTGGACATTATACATATTTTTGCGTCTCGCGCTAGACAGGCCCAAAC<br>GTCCGAGTAGGGGGCTTGGCATTTCTCATTGCCTGCTCCTGAAAGGATA<br>TGGGTCCTGCGTCGCGTGGTAGGCAGACCCATTCGTCCGAGTAGGGGG<br>CTTGGCAGTNTCCATTGCCTGTGCCCGAAAGGACGTGGGTCATCTGGTC<br>TGTCTGCCTACACCTCTCTAGACTTGTAACATCTAGTCTGTCAACAAGAT<br>CAAAATTCTTCACACAGACGACCGAGCTTGCTCAGTCTTCCTGTACCCGC<br>AGAATTTTGCTCTTGCTCTCCTTTGGCTGTGTCCTGGACGTGGGACTATT<br>CCATCTCGTCCCAAATGCCGCGTCCAATTATACCGGATTTGACAAAGCG<br>GACGGCCCGCTTTATAAGCCGGAAAAGGTGCCTTGTAAAATTGCAAGGT<br>TCATTAAATAG (SEQ ID NO: 1097) | | | ATTVDFLGFPIGARG<br>KWYVGNNGLLSDLG<br>FSTSRVVRIARALSKK<br>ALLSSVDIIHIFASRAR<br>QAQTSE (SEQ ID<br>NO: 1465) |
| R2 | R2-<br>1_TSP | — | *Trichinella spiralis* | CTCCTGACTAACCTGATTTCGTCCGTGCGGCGGCGTTTTCTTTTCGCTCTC<br>CGCTCGTCGAAATTTGCTGTAGTTGATTCGCTTTTCTTTGCGTTTTCTTCT<br>ACTTTCGCAGTTTTTTCTGCATTGCCACGATGTCAAACCGCCTTGCCAAT<br>ACTGCTGCGGCTGGTGGGGTTCCAGAGAAAACCTCGGGAACTTTAGAC<br>ATTCCTGGCCAACCCTCTTCATCCGGTGAAAAGCGTGCGATCTCTTACCC<br>TGGTCCATTCGGTTGCAATTCGTGTTCGTTTACGAGTACGACTTGGCTCT<br>CATTGGAATTGCATTTTAAAAGCGTCCATAATATTCGTGACTTCGTCTTC<br>CTCTGCTCTAAATGTAAAAAAAGCTGGCCATCGATCAACTCCGTAGCTA<br>GCCATTACCCTCGGTGCAAAGGTAGCGTCAAGGCTGCAGTTGTTCCTAC<br>ATCTTTGGCGAATACGTGCACCACGTGCGGCTCAAGCTTCGGTACTTTCA<br>GTGGTCTTCAACTCCATCGGAAAAGAGCACATCCGGACGTTTTTGCTGC<br>TTCTTGTAGCAAAAAAACGAAGGCGCGTTGGTCTAACGACGAATTTACC<br>CTTCTGGCGAGACTCGAAGCAGGTCTGGATCCAGCCTGTAAAAACATTA<br>ACCAAGTACTAGCGGAAAGGTTAATGGAGTATAACATCACCAGAGGCG<br>TAGAAATGATAAAAGGCCAACGTAGAAAAGATCAGTACAAAGCGCTCG<br>TTCGTCAACTCCGGTCAAATTCTGAAACACAGCAATGTGTAGGTTTAGCC<br>GGAAGTATGGATTCGAACGTACCGGCCAACGATACATCGTCTTCCGTTG<br>CATCAGAGGTCAGCATTACGTACCCTGAGTACGGGGCCGTGATGTCGTG<br>CGACCTAATTAAAGAAGCGACTGGTATGGCCATAGTTGACATCAACGAG<br>TTGCAAAGCAACTTACGAAAAGCCTTCTTGTCCGGCCGCAAGCTTCCCAT<br>GAAGTTCCATGGAGCGCGTGAAACCGCCCAGAAGAAAATGGCCAACCC<br>CCGTGTTGCGAAATTCAAGCGTTTCCAACGGTTGTTTCGAAGCAACAGG<br>AGGAAACTGGCCAGCCACATCTTCGACAAAGCCTCACTGGAGCAATTCG<br>GTGGCAGCATCGATGAGGCATCTGACCATTTAGAAAAGTTCCTCTCCCG<br>GCCAAGATTGGAGTCCGATTCTTATTCCGTGATAAGCGGTGATAAGTCA<br>ATCGGAGTTGCACATCCAATTTTGGCCGAGGAGGTGGAATTGGAATTAA<br>AAGCCTCCCGACCAACCGCTGTTGGTCCGGATGGAATTGCACTGGAAGA<br>CATTAAAAAACTCAATACTTACGACATAGCCAGTCTTTTCAACCTCTGGC<br>TAAAAGCTGGCGACCTACCCGCATCGGTGAAAGCCAGTAGAACCATCTT<br>TTTGCCCAAAAGCGACGGCACCACCGACATATCGAACTGTCGGCCAATC<br>ACAATCGCATCCGCCATGTATCGGCTGTTCAGCAGAATAATAACGCGAC<br>GTCTGGCAGCCAGGTTGGAATTGAACGTGCGGCAAAAAGCGTTCCGGC<br>CTGAAATGAACGGCGTATTCGAGAACTCCGCCATTTTATACGCCCTCATC<br>AAGGATGCTAAGGTCAGGTCAAGGGAAATTTGCGTAACTACGCTCGAC | CTCCTGAC<br>TAACCTGA<br>TTTCGTCC<br>GTGCGGC<br>GGCGTTTT<br>CTTTTCGC<br>TCTCCGCT<br>CGTCGAAA<br>TTTGCTGT<br>AGTTGATT<br>CGCTTTTC<br>TTTGCGTT<br>TTCTTCTAC<br>TTTCGCAG<br>TTTTTTCTG<br>CATTGCCA<br>CG (SEQ ID<br>NO: 1221) | TGAGGT<br>TTTTGTT<br>TTCTTTT<br>TTCCTTT<br>TACCATT<br>CTTGTTC<br>CATTGTT<br>GTTATTT<br>GCTTTAA<br>TCCTGTA<br>TTTTACC<br>GCCGGC<br>AATTCCA<br>TTGTTAT<br>TATTACT<br>GTTACT<br>GTTATTA<br>TTGTTAC<br>TATTGTT<br>TTTACTT<br>TTACTTA<br>CTACTGT<br>TATTATA<br>CTTTAAT<br>TCGTTAA<br>CTTACGT<br>TATTGTT<br>ACCACT<br>ACTTACT<br>TTGCTCT<br>CTCGCA<br>AACGTT<br>CGTTGTT<br>GTTTCTT | MSNRLANTAAAGGV<br>PEKTSGTLDIPGQPSS<br>SGEKRAISYPGPFGC<br>NSCSFTSTTWLSLELH<br>FKSVHNIRDFVFLCSK<br>CKKSWPSINSVASHY<br>PRCKGSVKAAVVPTS<br>LANTCTTCGSSFGTFS<br>GLQLHRKRAHPDVF<br>AASCSKKTKARWSN<br>DEFTLLARLEAGLDPA<br>CKNINQVLAERLMEY<br>NITRGVEMIKGQRRK<br>DQYKALVRQLRSNSE<br>TQQCVGLAGSMDSN<br>VPANDTSSSVASEVSI<br>TYPEYGAVMSCDLIK<br>EATGMAIVDINELQS<br>NLRKAFLSGRKLPMK<br>FHGARETAQKKMAN<br>PRVAKFKRFQRLFRS<br>NRRKLASHIFDKASLE<br>QFGGSIDEASDHLEK<br>FLSRPRLESDSYSVISG<br>DKSIGVAHPILAEEVE<br>LELKASRPTAVGPDGI<br>ALEDIKKLNTYDIASLF<br>NLWLKAGDLPASVK<br>ASRTIFLPKSDGTTDIS<br>NCRPITIASAMYRLFS<br>RIITRRLAARLELNVR<br>QKAFRPEMNGVFEN<br>SAILYALIKDAKVRSRE<br>ICVTTLDLAKAFDTVP |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTTGCCAAGGCCTTTGACACGGTGCCCCACTCACGCATTTTACGAGCCCTGAGGAAAAATAATGTCGACCCGGAATCCGTCGACCTGATTTCGAAAATGTTAACGGGTACGACTTATGCAGAAATAAAAGGGCTCCAGGGCAAACTTATACCCATTCGCAATGGAGTCAGGCAAGGTGACCCCTTGTCGCCCCTATTATTTAGTCTATTTATAGACGAGATAATAGGTCGCCTACAAGCCTGCGGCCCTGCCTACGATTTCCATGGCGAAAAAATTTGCATCCTGGCTTTCGCCGATGATCTGACGCTGGTGGCTGACAGCGCAGCTGGTATGAAGATCCTTCTAAAAGCGGCTTGTGACTTCCTGGAGGAATCTGGAATGTCACTTAATGCAGAGAAATGCCGCACTCTCTGTATTACAAGATCTCCCCGAAGCCGCAAGACTTTCGTCAACCCAGCTGCCAAATTCATCATCAGCGATTGGAAAACGGGTATCAGCTCAGAAATCCCCTCCCTGTGTGCGACGGACACCTTTCGTTTCCTGGGGCACACCTTCGATGGAGAAGGAAAGATCCACATCGATACGGAGGAAATTCGATCCATGCTCAAATCGGTGAAGTCAGCTCCACTGAAACCGGAACAGAAGGTGGCTTTGATACGGTCACACCTTCTTCCCCGCCTTCAGTTCCTGTTTTCTACAGCTGAAGCTGACAGCCGGAAAGCCTGGTTGATCGATTCCATCATCAGGGGGTGTGTGAAGGAGATCTTGCACTCAGTGAAAGCTGGTATGTGCACTGATATCTTTTACATACCCTCTAGAGACGGTGGAATGGGATTTACTTCCCTCGGGGAGTTTTCTCTTTTCAGCAGGCAGAAGGCACTCGCCAAGATGGCTGGATCGTCGGACCCCCTCTCGAAACGGGTTGCTGAATTCTTCATCGAAAGGTGGAACATCGCCCGTGACCCGAAAGTCATTGAAGCTGCTCGGCGCGTCTACCAGAAAAAACGGTACCAACGCTTTTTCCAGACGTACCAGAGCGGTGGATGGAATGAATTTTCGGGAAACACTATTGGGAACGCCTGGTTGACAAACGGCCGTGCCCGCGGAAGAAATTTCATAATGGCTGTGAAATTCCGTTCCAACACCGCAGCCACCCGGGCCGAAAACCTACGAGGCCGCCCCGGCACGAAAGAATGCCGGTTTTGCAAGAGTGCCACCGAAACTTTGGCACACATTTGCCAGAGGTGTCCGGCAAATCACGGCTTGGTTATCCAGCGCCATGACGCAGTCGTAACATTCCTGGGGGAAGTGGCGCGGAAGGAAGGTTACCAGGTCATGATAGAGCCTAAGGTGTCAACCCCGGTCGGCGCGCTCAAGCCCGACCTCCTACTCATCAAAGCCGACACTGCATTCATTGTGGATGTAGGCATTGCATGGGAAGGTGGACGCCCACTAAAGCTGGTCAACAAAATGAAATGTGACAAGTACAAAACTGCCATCCCGGCAATTTTGGAAACATTTCACGTTGGCCATGCTGAGACGTACGGCGTTATTCTGGGCAGCCGCGGATGCTGGCTCAAGAGCAACGACAAGGCGTTGGCATCAATTGGGCTCAATATCACACGGAAGATGAAAGAACACCTGAGCTGGTTGACGTTTGAAATTATATTTATAACTCAAATAAGCCGGATTTATAACTCATTCATGAAAAAATGAGGTTTTTGTTTTCTTTTTTCCTTTTACCATTCTTGTTCCATTGTTGTTATTTGCTTTAATCCTGTATTTTACCGCCGGCAATTCCATTGTTATTATTACTGTTACTGTTATTATTGTTACTATTGTTTTTACTTTTACTTACTACTGTTATTATACTTTAATTCGTTAACTTACGTTATTGTTACCACTACTTACTTTGCTCTCTCGCAAACGTTCGTTGTTGTTTCTTTTGGACCAGGTTTAGAGAAATCGCACGCACAGCGGAACTGGACCGCTTAAGCCAGAAATAGTAAAGTAACAA (SEQ ID NO: 1098) | | TTGGACCAGGTTTAGAGAAATCGCACGCCGCTTAAGCCAGAAATAGTAAAGTAACAA (SEQ ID NO: 1344) | HSRILRALRKNNVDPESVDLISKMLTGTTYAEIKGLQGKLIPIRNGVRQGDPLSPLLFSLFIDEIIGRLQACGPAYDFHGEKICILAFADDLTLVADSAAGMKILLKAACDFLEESGMSLNAEKCRTLCITRSPRSRKTFVNPAAKFIISDWKTGISSEIPSLCATDTFRFLGHTFDGEGKIHIDTEEIRSMLKSVKSAPLKPEQKVALIRSHLLPRLQFLFSTAEADSRKAWLIDSIIRGCVKEILHSVKAGMCTDIFYIPSRDGGMGFTSLGEFSLFSRQKALAKMAGSSDPLSKRVAEFFIERWNIARDPKVIEAARRVYQKKRYQRFFQTYQSGGWNEFSGNTIGNAWLTNGRARGRNFIMAVKFRSNTAATRAENLRGRPGTKECRFCKSATETLAHICQRCPANHGLVIQRHDAVVTFLGEVARKEGYQVMIEPKVSTPVGALKPDLLLIKADTAFIVDVGIAWEGGRPLKLVNKMKCDKYKTAIPAILETFHVGHAETYGVILGSRGCWLKSNDKALASIGLNITRKMKEHLSWLTFEIIFITQISRIYNSFMKK (SEQ ID NO: 1466) |
| R2 | R2-1_TUr | scaffold_6 | *Tetranychus urticae* | CTCTCTTATTTTAACATATTCGATGTACTCGTACATTGAATATGCTTTTATTTTTTTCAAAGTTTTTGGGTGCATACCCCTGGAAAATTCTGAGATGTATAAATCTCCCATCAGCTTTGGCTGAAACGTTGGCTAAGTTTTGTAGGTTGTTTGCCCCCTACTACTTAGTCGCAAATGGTATTTGCTAACAGTTGTTAAATTGTTACATTTACAAGTCCTATCCAGTGCCTCCTCGTGGCGCTACCCGGTAACACTTAGAGTAATCTGAGTGGCTAAACTGGAAGGGCGGAAAATGCAA | CTCTCTTATTTTAACATATTCGATGTACTCGTACATTGAATATGCTTTT | TGATGTATCCCTTCAATATATTGTAATCCTCATTCGTCC | MCILGGLTSHSREGGLSRGSSQLKTVKPQNEEDNGTTQLKAGSADSFPRPSGDLNPEEPLSIDICPVCFRQMKSYLGVRVHMQKMHLEE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACAGGCGGTTGGTAGATGCTTCGGCATTTTGCCAAAAATCCACGGCTTT | ATTTTTTTT | CTATCCT | YNASIPDPVVSHTRW |
| | | | | TTAGCCCAACAACATCAGGGTGATGGACCCGCCAGCTTGTGGTCAGGAT | CAAAGTTT | TTCATTT | SDEEAAQLAFTEAKIE |
| | | | | CCCATCCATGAATAAAGCATGGCTCTGCTTCTGGTGCATCCTCAACGGG | TTTGGGTG | GATAAA | VDKLLPRGKGINKFLL |
| | | | | ATCGGCTTCGGCTGGATGTAAGTCTTGCGGAGGCATGTGCATCTTGGGT | CATACCCC | AGAAAC | ELLPGRTLESIKSHRK |
| | | | | GGCCTAACAAGCCATTCAAGAGAAGGAGGGCTCTCGCGAGGGAGTTCT | TGGAAAAT | TTTGTTG | RQSHKDLVRKYVKEF |
| | | | | CAACTTAAGACCGTTAAGCCACAAAACGAAGAAGATAATGGAACTACCC | TCTGAGAT | CTCCTTT | VDTLAADNDDDTIIC |
| | | | | AGTTGAAGGCTGGGAGTGCGGACTCTTTCCCAAGGCCAAGTGGTGATTT | GTATAAAT | TAATAG | QDNGDIFNDPIVGAT |
| | | | | GAACCCAGAGGAACCACTGAGCATTGATATCTGTCCAGTTTGTTTCAGA | CTCCCATC | TTGGTC | DSQSETETVADPAEF |
| | | | | CAGATGAAGAGTTATTTAGGCGTTAGAGTGCATATGCAGAAGATGCACT | AGCTTTGG | CCTCCTG | KTFIELADDPTKPKVV |
| | | | | TAGAAGAATATAATGCGTCTATTCCGGACCCAGTCGTTTCCCACACTAG | CTGAAACG | TCCCTTT | AKLRNLIKDKPKSEIL |
| | | | | GTGGTCCGATGAAGAGGCAGCACAATTAGCTTTTACTGAAGCTAAGATT | TTGGCTAA | TCTGGA | GSDILVRILRRTLHGL |
| | | | | GAGGTCGACAAGCTTTTACCTCGTGGCAAAGGCATAAATAAGTTCCTGT | GTTTTGTA | ACCTGG | PVEDELDQYLEVYFT |
| | | | | TAGAGCTTTTGCCTGGTCGAACCTTAGAGTCTATCAAGTCTCACAGAAA | GGTTGTTT | TTGTATC | GKIKQRRSKTQTALSK |
| | | | | AAGACAATCGCATAAAGACTTGGTTCGCAAATATGTAAAGGAGTTCGTT | GCCCCCTA | GATTATT | KQIKQRDYGRLQELY |
| | | | | GATACTTTAGCTGCAGATAACGATGACGATACCATCATCTGTCAAGATA | CTACTTAG | GAAAGT | SRSRKRCANEILNPTS |
| | | | | ATGGTGACATTTTTAATGACCCCATCGTTGGAGCAACTGATTCTCAGTCT | TCGCAAAT | TGCAAT | MSGGFGHQELSEFW |
| | | | | GAGACTGAAACTGTGGCTGATCCTGCTGAATTCAAGACTTTTATTGAGTT | GGTATTTG | AAACGG | TKTFGPDEQPTLGEV |
| | | | | AGCAGACGATCCCACAAAACCAAAAGTCGTAGCAAAACTCAGAAACTTG | CTAACAGT | ATTTAA | EIIPKENCWWDIFSPI |
| | | | | ATAAAAGATAAACCAAAGAGCGAGATCCTTGGAAGTGACATTCTTGTAC | TGTTAAAT | (SEQ ID | SSDEIKASYPSIGKAA |
| | | | | GAATCCTGCGAAGAACTCTTCATGGCTTGCCTGTTGAGGACGAGTTGGA | TGTTACAT | NO: | GPDNFSAYQLRKVPV |
| | | | | CCAGTACTTGGAGGTTTACTTCACTGGGAAGATAAAGCAGAGACGTTCT | TTACAAGT | 1345) | WHLECLYNIFAFYKDI |
| | | | | AAGACACAAACTGCCTTATCTAAGAAACAGATTAAGCAGAGAGATTATG | CCTATCCA | | PSRLKDAKTILIPKKD |
| | | | | GACGTCTTCAGGAGTTATACTCCCGGTCTAGAAAAAGGTGTGCAAATGA | GTGCCTCC | | NAESPGDFRPITLSSII |
| | | | | GATCTTGAACCCTACTTCTATGAGTGGTGGTTTTGGTCATCAGGAGCTAT | TCGTGGCG | | TRHFHKILATRVNNF |
| | | | | CCGAATTCTGGACAAAGACGTTCGGACCAGATGAGCAACCTACTCTGGG | CTACCCGG | | VRFHPMQRGFIQSD |
| | | | | CGAGGTGGAGATCATTCCGAAGGAGAACTGTTGGTGGGATATTTTCTCG | TAACACTT | | GCLENTALIQTVIREA |
| | | | | CCAATATCTTCAGACGAAATCAAAGCCTCATACCCCAGTATAGGGAAAG | AGAGTAAT | | KVRRKQVHITFCDVR |
| | | | | CTGCTGGTCCAGATAATTTCTCTGCTTATCAACTTAGAAAAGTTCCGGTT | CTGAGTGG | | KAFDSVRYDSIIAAIA |
| | | | | TGGCATCTGGAATGTCTCTATAATATCTTTGCTTTCTACAAGGACATACC | CTAAACTG | | KKGAPGSFIMYLSNL |
| | | | | GAGTAGACTTAAAGACGCGAAGACAATTTTGATACCAAAGAAGGATAA | GAAGGGC | | YRGNKTTLLTAGGET |
| | | | | CGCTGAAAGTCCAGGTGATTTCCGCCCTATCACCTTGAGCTCAATTATCA | GGAAAAT | | RITPTRGVRQGDPLS |
| | | | | CTCGACATTTTCACAAGATTCTAGCGACGAGAGTGAATAATTTTGTTCGA | GCAAACAG | | PILFNCVMDQILTALP |
| | | | | TTCCATCCTATGCAAAGAGGCTTCATTCAATCTGATGGTTGTTTGGAGAA | GCGGTTG | | SRTGFTLSAGDESVN |
| | | | | CACTGCGCTCATACAGACGGTCATTAGAGAAGCCAAAGTGCGTAGGAA | GTAGATGC | | VNCLAFADDIILISKTK |
| | | | | GCAAGTGCATATCACCTTCTGTGATGTGCGAAAAGCGTTTGACAGCGTC | TTCGGCAT | | NGHQELLDVTQRILK |
| | | | | CGGTATGACTCGATCATAGCAGCTATTGCAAAGAAAGGTGCACCAGGA | TTTGCCAA | | ENGLDLNPDKCCSLS |
| | | | | AGTTTCATCATGTACCTTAGTAACTTATATAGAGGAAATAAGACTACGCT | AAATCCAC | | LIPHSKTKKIKVVRAD |
| | | | | TTTGACTGCTGGCGGTGAAACAAGAATAACTCCAACACGGGGCGTTAG | GGCTTTTT | | FVVNGVKVRSMSIG |
| | | | | ACAAGGAGATCCGTTATCTCCGATACTTTTTAATTGCGTGATGGACCAG | AGCCCAAC | | DSTCYLGVSINVTGQ |
| | | | | ATTCTCACGGCTCTTCCTTCGAGAACTGGTTTTACGTTATCTGCTGGTGA | AACATCAG | | VAPVKMYQALCEKL |
| | | | | CGAATCAGTTAACGTTAACTGTTTGGCGTTTGCTGATGATATAATTTTAA | GGTGATG | | DSAAIKPHQRLYILKH |
| | | | | TCTCAAAGACCAAGAATGGACATCAAGAACTCCTTGATGTAACACAAAG | GACCCGCC | | FVITKMFHPLILSTIAA |
| | | | | AATTTTAAAGGAGAATGGCCTCGATCTCAATCCTGATAAGTGCTGTTCG | AGCTTGTG | | HKIKNLDLISRRYVRK |
| | | | | CTAAGCTTGATACCGCACAGCAAAACAAAGAAAATCAAAGTGGTTCGTG | GTCAGGAT | | WLHLPHDCGSGMIH |
| | | | | CTGACTTCGTGGTGAACGGAGTCAAAGTGCGATCAATGAGTATTGGTG | CCCATCCA | | AKVSDGGLGVPLLFR |
| | | | | ATTCAACTTGTTACCTAGGTGTCTCAATAAATGTAACTGGCCAAGTAGCA | TGAATAAA | | TIADLKVRRKEKLQV |
| | | | | CCAGTTAAAATGTATCAGGCTCTGTGTGAGAAACTTGATAGTGCTGCTA | GCATGGCT | | HENPIFRILAKLSTVSK |
| | | | | TTAAGCCTCATCAGAGACTGTACATATTGAAGCATTTCGTAATAACGAA | CTGCTTCT | | ELENCKKIASKTTDIQ |
| | | | | GATGTTTCACCCGCTGATTTTGTCAACTATTGCGGCACACAAGATAAAG | GGTGCATC | | EKTFKEMLATYDGLS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AATCTGGATTTGATTAGCAGACGTTATGTCAGGAAGTGGTTACACTTAC<br>CTCATGATTGCGGATCTGGTATGATTCATGCCAAAGTAAGCGATGGAGG<br>ATTGGGTGTTCCATTACTGTTCAGGACAATTGCTGATCTCAAAGTTCGGA<br>GAAAAGAAAAGCTGCAGGTCCATGAAAACCCAATATTTAGAATATTGGC<br>AAAGCTATCTACAGTAAGCAAGGAGTTGGAAAATTGTAAAAAGATAGC<br>TTCCAAGACGACAGACATTCAAGAAAAGACTTTCAAGGAAATGCTTGCG<br>ACTTATGATGGTTTGTCATTGAAAGAAGCTCGAGCGGTACCTGAGGTGC<br>ACAAATGGGTGGACAGCTATGATAAGCGTTATAAGTTTGCAGGCCGAG<br>ATTTCGTTCAAGTTATACAGGCTCGTTTCAATGCGTTACCAACGAGATCT<br>CGAGTATGGCGGGGCAGAGGTGCTGATGAAAAATCGTTACGTTGCAGA<br>GCAGGCTGCAACGCTAGGGAAACGTTGAATCACGTTTCACAATCTTGCT<br>TCAGGACGCATCGAGTACGAACAGCTAGACACGACAAAATCCTGGATTT<br>TATTTGTGAAAGGCTGGACGTAGTCGGTGTTAAATACGTACGAGAAAA<br>GCCAATCAGCTTTCCTGGCAAAAAGTTGATTCCTGATTTGATTGTGGAAA<br>ACACGGACCAAGCTCTTGTGCTCGATCTCCAGATTGTTGGCGATAACAG<br>TGAACTTCCACTTGATGAAAGAGGCAAGAACAAGGTTATCAAATACAAT<br>TGTTCGGAGATGCAGGAATTGTACAAGAGGAAGAAAAAGACTTTGGCG<br>GTTAAGGCACTCACGCTACATTATAAAGGGTTGATGGCACCGGAAACAA<br>GCAATATCCTAAGGTCATTCGGATTCAAGTCTAAGGATTTGGAAAAGAT<br>GGCGTATATGGCGTTGTTTGGTACGGTGGCTGCTTGGGGCATTTTCAAT<br>CGCTCGACGGAGACAATGCGTTCAGTCGCTAACTGGCCTAGACCTGAG<br>GAATTATGATGTATCCCTTCAATATATTGTAATCCTCATTCGTCCCTATCC<br>TTTCATTTGATAAAAGAAACTTTGTTGCTCCTTTTAATAGTTGGTCCCTCC<br>TGTCCCTTTTCTGGAACCTGGTTGTATCGATTATTGAAAGTTGCAATAAA<br>CGGATTTAA (SEQ ID NO: 1099) | CTCAACGG<br>GATCGGCT<br>TCGGCTGG<br>ATGTAAGT<br>CTTGCGGA<br>GGC (SEQ<br>ID NO:<br>1222) | | LKEARAVPEVHKWV<br>DSYDKRYKFAGRDFV<br>QVIQARFNALPTRSR<br>VWRGRGADEKSLRC<br>RAGCNARETLNHVS<br>QSCFRTHRVRTARHD<br>KILDFICERLDVVGVK<br>YVREKPISFPGKKLIPD<br>LIVENTDQALVLDLQI<br>VGDNSELPLDERGKN<br>KVIKYNCSEMQELYK<br>RKKKTLAVKALTLHYK<br>GLMAPETSNILRSFG<br>FKSKDLEKMAYMALF<br>GTVAAWGIFNRSTET<br>MRSVANWPRPEEL<br>(SEQ ID NO: 1467) |
| R2 | R2-<br>2_DWi | — | *Drosophila willistoni* | GAAGCTGGGAAGCTGGGTCGGATGAGCGCAGAAGGGGTGTTCTTCGG<br>AGCACTGTAATTCATAAGTCGTAAGTCTGATCAAGTCGACTCGGAACCT<br>CTTCGTGGTGTTTCCTGGGTGCTGTTGAGTTCCTAGTCTCTAGGTTCTCT<br>CCAGTAGCTAATTCGAGCGGCGAAGCAACTCTTGGGGTTACCAGAACCT<br>TGAGCCAAGTAACGTTGGTCAAGATATGAATACTGTGCCTCGGATAAAC<br>AACACAACAACAACTCCAGCGACTTCCCGTCCTGGAGACCAACCGAGAG<br>AGGCTATAGCAGTGGTAAATCTCGCGGGAGAGATTCCCTGTGCAGTAT<br>GTGGGCGCCTCTTCAATACTAGAAGGGGGTTTGGGGTTCATATGTCACA<br>TCAACACAAAGACGAACTAGATACGCAACGTCAGCGTGAAGATGTAAA<br>ACTCCGATGGAGTGAGGAAGAAGCGTGGATGATGGCGAGAAAGGAGG<br>TGGAGCTCGAAGCAAGTGGTAATTTGAGATTTCCTAATAAGAAGCTAGC<br>GGAAGTATTTACTCACCGTAGCTCCGAAGCAATTAAATGTTTTCGGAAG<br>AGGGGTGAATATAAGGCAAAACTGGAGCAGATCAGAGGGCAATCTACT<br>CCCACCCCAGAAGCGTTGGACTCAATTACCTCACAGCCTCGCCCTAGTTT<br>ACTCGAGCGAAACCACCAAGTATCATCGTCGGAAGCGCAACCAATCAAT<br>CCATCAGAAGAACAGTCGAACTGGGAAATCATGCGGATACTACAGGGC<br>TATCGCCCCGTAGAATGTAGTCCCCGGTGGAGAGCCCAGGTCTTGCAAA<br>CTATCGTAGATAGGGCGCAGGCCGTAGGGAAGGAAACCACTCTCCAAT<br>GCTTATCCAACTATCTCCTGGAAGTATTTCCATTACCAAACGAACCACAC<br>ACCATCGGTCGGAGCAATTTGCGAAGACCTCGAACTAGGAGACAGTTA<br>AGACAACAAGAGTACGCACAGGTTCAGCGTCGTTGGGATAAGAATACT<br>GGGAGATGCATTAAATCCTTGCTTGATGGAACAGATGAGTCGGTTATGC<br>CAAACCAAGAGATAATGGAACCCTATTGGAAACAAGTAATGACGAATCC | GAAGCTG<br>GGAAGCT<br>GGGTCGG<br>ATGAGCGC<br>AGAAGGG<br>GTGTTCTT<br>CGGAGCAC<br>TGTAATTC<br>ATAAGTCG<br>TAAGTCTG<br>ATCAAGTC<br>GACTCGGA<br>ACCTCTTC<br>GTGGTGTT<br>TCCTGGGT<br>GCTGTTGA<br>GTTCCTAG<br>TCTCTAGG<br>TTCTCTCC<br>AGTAGCTA<br>A (SEQ ID<br>NO: 1223) | TAGATG<br>TACTAAC<br>CTCTAGT<br>TTCTCTA<br>TACTTTT<br>GCCTGC<br>TACCTTG<br>GCATTA<br>CATCTAA<br>AAAGGT<br>ACAAAC<br>ATCGCA<br>TTGGCA<br>AAAAGA<br>GGTGGT<br>TTTAGTA<br>CATAGG<br>CGCTGT<br>GGGACT<br>TCATTGT<br>CCCGAT<br>GATGCA<br>GCGAAT | FERRSNSWGYQNLE<br>PSNVGQDMNTVPRI<br>NNTTTTPATSRPGDQ<br>PREAIAVVNLAGEIPC<br>AVCGRLFNTRRGFGV<br>HMSHQHKDELDTQR<br>QREDVKLRWSEEEA<br>WMMARKEVELEAS<br>GNLRFPNKKLAEVFT<br>HRSSEAIKCFRKRGEY<br>KAKLEQIRGQSTPTPE<br>ALDSITSQPRPSLLER<br>NHQVSSSEAQPINPS<br>EEQSNWEIMRILQGY<br>RPVECSPRWRAQVL<br>QTIVDRAQAVGKETT<br>LQCLSNYLLEVFPLPN<br>EPHTIGRSNLRRPRTR<br>RQLRQQEYAQVQRR<br>WDKNTGRCIKSLLDG<br>TDESVMPNQEIMEP<br>YWKQVMTNPSTCSC<br>ENTRFRMEHSLETV |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAGCACATGCTCTTGCGAAAACACAAGATTCCGTATGGAACATTCGCTT | | CGTGCA | WSAITPRDLRENKLK |
| | | | | GAGACGGTTTGGTCAGCGATAACGCCACGCGACCTGAGGGAAAATAAG | | TACGAG | LSSAPGPDGITPRTAR |
| | | | | TTAAAGTTGTCAAGTGCTCCGGGTCCTGACGGTATCACTCCAAGAACAG | | ATTGTCC | SVPLGIMLRIMNLIL |
| | | | | CCAGGAGTGTACCCTTAGGCATTATGCTACGCATAATGAACCTGATTCTC | | AGTAGT | WCGKIPFSTRLARTIFI |
| | | | | TGGTGCGGCAAAATACCATTCTCTACCCGACTGGCCAGAACTATCTTCAT | | TGGTTG | PKTVTANRPQDFRPI |
| | | | | TCCGAAGACTGTGACGGCAAATCGACCGCAAGACTTTCGTCCAATAACA | | CTCGTAT | TVPSVLVRQLNAVLA |
| | | | | GTCCCCTCGGTTTTGGTCAGGCAATTAAACGCTGTTCTGGCTTCTCGATT | | CTTTAGA | SRLASKVNWDPRQR |
| | | | | GGCTTCTAAAGTCAACTGGGATCCAAGGCAGCGCGGTTTCCTACCTACC | | AGATTTC | GFLPTDGCADNATLV |
| | | | | GATGGGTGTGCTGATAATGCGACGTTGGTTGATCTCATTTTGCGGGAGC | | CTTCCTC | DLILREHHKRWKSCY |
| | | | | ACCATAAACGGTGGAAGTCATGTTACCTTGCGACGGTGGATGTCAGCAA | | GGCGAT | LATVDVSKAFDLVSH |
| | | | | GGCTTTTGACTTAGTATCACACCAGGCCATTATCAAGACTTTACAGGCCT | | CAAAAN | QAIIKTLQAYGAPTNF |
| | | | | ATGGTGCTCCAACAAACTTTGTTAGCTTTATAGAAGAACAGTATAAGGG | | AAAAAA | VSFIEEQYKGGGTSL |
| | | | | CGGCGGAACCTCCCTCAATGGGGCAGGATGGAGTTCAGAGGTGTTTAT | | AAAAAA | NGAGWSSEVFIPAR |
| | | | | ACCCGCGCGGGGCGTTAAGCAAGGTGACCCTCTGTCTCCACTATTATTT | | AAAAAA | GVKQGDPLSPLLFNLI |
| | | | | AATCTTATCATTGATAGATTACTTAGGTCCTACCCCAGAGAGATTGGTGC | | (SEQ ID | IDRLLRSYPREIGAKV |
| | | | | CAAAGTCGGAAATACCATGACAAGCGCGGCAGCGTTCGCGGATGATCT | | NO: | GNTMTSAAAFADDL |
| | | | | GGTGCTATTTGCGGAAACTCCGATGGGGCAAACATTGTTGGATACCACG | | 1346) | VLFAETPMGQTLLDT |
| | | | | CTAGGCTTCCTAGCCTCCGTGGGACTCTCCCTTAATGCTGATAAGTGTTT | | | TLGFLASVGLSLNAD |
| | | | | CACTGTCAGTATAAAGGGGCAAGCCAAGCAGAAGTGTACTGTCGTAGA | | | KCFTVSIKGQAKQKC |
| | | | | ACGACGGAGCTTTTGTGTAGGGGAGCGCGAGTGTCCTTCATTGAAGCG | | | TVVERRSFCVGEREC |
| | | | | TACTGAAGAGTGGAAGTATTTAGGTATCCGGTTCACTGCGGATGGGCG | | | PSLKRTEEWKYLGIRF |
| | | | | GGCTCAATATAGTCCAGCAGACGACCTCGGTCCGAAGCTGTTAAGATTA | | | TADGRAQYSPADDL |
| | | | | ACAAGAGCCCCTCTGAAACCACAACAGAAGTTATTTGCACATAGGACTG | | | GPKLLRLTRAPLKPQ |
| | | | | TCCTTATCCCACAACTCTATCACCAACTAACACTTGGGAGTGTGATGATA | | | QKLFAHRTVLIPQLYH |
| | | | | GGCGTCCTAGGAAAATGTGACAGATTGGTACGGCAATTCGTAAGGAGA | | | QLTLGSVMIGVLGKC |
| | | | | TGGTTAGATCTCCCACTGGATGTACCAGTTGCGTACTTTCACGCCCCCCA | | | DRLVRQFVRRWLDL |
| | | | | CACTTGTGGGGGTCTCGGGATTCCGTCAATTAGATGGATAGCACCGATG | | | PLDVPVAYFHAPHTC |
| | | | | CTTCGTCTGAAGCGATTGAGCAATATTAAATGGCCCCACCTCGAACAAT | | | GGLGIPSIRWIAPML |
| | | | | CCGAGGTAGCTAGCTCTTTCATTGACGACGAATTGCAAAGGGCTCGAGA | | | RLKRLSNIKWPHLEQ |
| | | | | TAGATTAAAGGCGGAAAATGTGCAGCGGTGTTCGCGTCCAGAGATTGA | | | SEVASSFIDDELQRAR |
| | | | | CTCGTATTTCGCAAATAGGTTGTACATGTCTGTTGATGGTTGCGGTCTCC | | | DRLKAENVQRCSRPE |
| | | | | GTGAAGCAGGTCATTATGGCCCGCAACATGGATGGGTGAGTCAGCCCA | | | IDSYFANRLYMSVDG |
| | | | | CGCGCTTGCTAACAGGAAAGGAATATTTGCACGGTGTCAAATTGCGGAT | | | CGLREAGHYGPQHG |
| | | | | AAATGCCCTACCCTCGAAGTCTCGTACGACGAGGGGAAGGCACGAATT | | | WVSQPTRLLTGKEYL |
| | | | | GGAGAGACGGTGTCGTGCAGGATGTGATGCTCCCGAGACAACAAACCA | | | HGVKLRINALPSKSRT |
| | | | | CATCTTGCAAAAATGCTATCGTACGCATGGGAGGCGGGTAGCTAGACA | | | TRGRHELERRCRAGC |
| | | | | CAACAGCGTAGTAAATGCCGTCAAGCGGGGACTTGAACGGAAAGGCTG | | | DAPETTNHILQKCYR |
| | | | | CGTTGCCCATGTCGAACCAAGTCTGCAATGCGACTCGGGCTTAAATAAA | | | THGRRVARHNSVVN |
| | | | | CCGGACCTGGTGGGAATCCGACAGAATCACATTTATGTGATAGACGTTC | | | AVKRGLERKGCVAH |
| | | | | AGGTTGTGACAGACGGACATTCCTTAGACCAAGCGCACCAGCGCAAGG | | | VEPSLQCDSGLNKPD |
| | | | | TCGAAAGGTACGACAGAGCTGACATAAGATCACAAATGCGGCGATTTTT | | | LVGIRQNHIYVIDVQ |
| | | | | CGGAGTGACAGGTGAAATCGAGTTTCATTCCGTTACACTCAACTGGAGA | | | VVTDGHSLDQAHQR |
| | | | | GGAATCTGGAGTGGTCAGTCGGTAAAACGATTGATTGCAAAAGATCTCC | | | KVERYDRADIRSQMR |
| | | | | TCATCGCTGAAGATACCAAACTCATCAGCGTCAGAGCAGTAAACGGCGG | | | RFFGVTGEIEFHSVTL |
| | | | | AGTGACGTCTTTTAAATATTTCATGTATTGTGCTGGGTATACTCGAAGCT | | | NWRGIWSGQSVKRL |
| | | | | AGATGTACTAACCTCTAGTTTCTCTATACTTTTGCCTGCTACCTTGGCATT | | | IAKDLLIAEDTKLISVR |
| | | | | ACATCTAAAAAGGTACAAACATCGCATTGGCAAAAAGAGGTGGTTTTAG | | | AVNGGVTSFKYFMY |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TACATAGGCGCTGTGGGACTTCATTGTCCCGATGATGCAGCGAATCGTGCATACGAGATTGTCCAGTAGTTGGTTGCTCGTATCTTTAGAAGATTTCCTTCCTCGGCGATCAAAANAAAAAAAAAAAAAAAAA (SEQ ID NO: 1100) | | | CAGYTRS (SEQ ID NO: 1468) |
| R2 | R2-2_PM | — | *Petromyzon marinus* | CGGTGCGTTCCCTTGGGTAAGGAACACGAGTCTTAGTGGCCTTGACCTCCACGTGGTCCCGCTGGTAACATCATCTCTTGATGATGGCTAACAAGGCTAATGCACCCATTCCATCTCCTATCTCGCATGGAGGCCGCTATGCGTGATTACTAGAGGCCACAAACAAAACTTATGACTGACAAACTTAAGTTCTCAAGCCAGTTGGCACGAGGCCTGGCAAAACAACGTGCTATGGATGGCGCTCGGGTTGGCGATCCACCCATTACAGTTAGACCCACAGAAACCGATCTGTGCAACACTGAGGGTTCATGGGGACGCCGTCCTATGAAACTCTTGTTTGTCTCGGTGTCAACCCAGACACAGAATGAAGATGCCCTCTGGGCATCTGATGTTGCTAAACCTATGGCGTCTAGGTCGGCGCTAAAAATGACGAGTATACCTTCCATGACCTTCCATAACTCGTCCTTGGAAAAGGAAGAGGAGATGAACTACGATTTTTACGAACAGATTAAAAGTCTAGTTGAGTCGGATGACTCTTCAGATGACTTTACAGAGGATGATGAGGATGTGGAGGAGTCCTTCCTCGACATATCGGCTGAGGAACCCGTGTTGGGAAAGTTTCCCATTGACACCAAGGGAACTATCACGGTTGTACTGCCTAGTCTGGAGTATATATGCGTTATCTGTAAACAACACATGGGCAAAGCATCCGAACTTGTTGCACATTTTAACATCAAACACAGAGACATTCCTCTGGTGTTTAAGTGCGCTAAATGTGACAAAACCAACTCAAACCACCGATCGATTGCCTGTCATGCCCCCAAATGTGGGGGAATAAAGTTAACTGAGGAAAGCTTACCAATGGTCTGTGAATGTTGCCAGGCACGCTTTGCGACTCTAAGTGGCCCTTTCGCAGCACAAGAGGCATGCTCACCCAGTCACCCGTAATGAGGAAAGGATTAAAGATGGTATAAAGGGTACCTCGCAGAGAGGGGTACACCGTAGCTGCTGGTCTTTGAAGGAAGTAGAACAGCTGGCCCTTCTAGAGTTGCAGTTTCAGGGGAAAAAGAATATCAATAAGATCATTGCTGAAGCGCTTGGGACTAAGACCAACAAGCAAGTCTCTGACAAGAGACGGGACCTAAGTAAAAAGACAGGGGCCCCCATGTCAGACAGCTTACATTTTTCTTCTAGGCCTCTTGAGACATTGTCTCCCCCACCAAATGTAACAACGGGGACTTCATCCATACTCGCTCAAGCAGCTGAGCGGCTTACGAATGAGAATTCTGGGACCCTGGAAAAGCCTGCAATGGAGGCAATAAAGGCTTGGCTTAACGGCGAGGGCCAACATGATGCCCTCGTAGAAACTGCCACAGCATTGATGCTTTGTCCGATGAGATTGGTGAAAAACAAAGGCAAACGTTCAAAACCCGAGAACGACATTATTAAACCCAGGATATTACCCACACGATCTTGGATGAAGAAGAGAGCGGAAAAACGAGGAAGCTTCATGAAGCACCAGAAGCTCTTCTTTAAGAACCGCTCTCTTCTTGCGTCCTTAGTCCTGGATGGCACTGAACGTCATGAATGCCGAATCCCGAACGCAGATGTATATCGTTTTTACTGCGAAAAATGGGAGAAGGTGTTGCCATTCAATGGCCTGGGCCAATTTAAGTCATCAGGTGTTGCAAATAACGAATACTTTGAGCCCCTAATTTCGGTGGAGGAAGTTCAGACTGCCATACGGGCCATTAAACCAACGTCAGCAGCTGGGCCAGATGGCCTAACAAGGGCTGCAATCTGTGCTGCCGACCCCGAGGGTCGGACACTGACAGCCCTATTTAATGCATGGATGATTACAGGAATTATTCCCAAAGAGTTGAAAAAGAATAGGACGATTCTTATTCCTAAGGTTATGGACGATGAAAAGCTGAAAGAATTGGGGAACTGGAGACCAATAACGATTGGTTCAATGATTCTGAGATTATTTTCCAGAATAATGACTGCACGTCTTGCTCGTGCTTGTCCCTTAAACCCAAGGCAGCGTGGTTTTATAGCGGCATCTGGCTGCTCTGAAAATCTTAAGGTGCTACAGGACCTTATGAGACACGCTAAGAAATTGCACAGGCCGTTGGCTGTCATGTTCATCGACATAGCGAAAGCTTTTGACTCGGTTTCGCATGCTCATATTTTATGGGTGTTAAGG | CGGTGCGTTCCCTTGGGTAAGGAACACGAGTCTTAGTGGCCTTGACCTCCACGTGGTCCCGCTGGTAACATCATCTCTTGATGATGGCTAACAAGGCTAATGCACCCATTCCATCTCCTATCTCGCATGGAGGCCGCTATGCGTGATTAG (SEQ ID NO: 1224) | TGAGAATAATGAGGTGCTAACCTCCCTGGGCCTGACCAAACCCAGAACACATCACTGGCCAAGATGATTTCCCGCAGCACGTTGCTTTTCTCTCTCGATACCCGAGAATGTTCTGCGGAACTACGCAGTCTATGAACAGTCACAGACAACCTCTGATCCAAG (SEQ ID NO: 1347) | RPQTKLMTDKLKFSSQLARGLAKQRAMDGARVGDPPITVRPTETDLCNTEGSWGRRPMKLLFVSVSTQTQNEDALWASDVAKPMASRSALKMTSIPSMTFHNSSLEKEEEMNYDFYEQIKSLVESDDSSDDFTEDDEDVEESFLDISAEEPVLGKFPIDTKGTITVVLPSLEYICVICKQHMGKASELVAHFNIKHRDIPLVFKCAKCDKTNSNHRSIACHAPKCGGIKLTEESLPMVCECCQARFATLSGLSQHKRHAHPVTRNEERIKDGIKGTSQRGVHRSCWSLKEVEQLALLELQFQGKKNINKIIAEALGTKTNKQVSDKRRDLSKKTGAPMSDSLHFSSRPLETLSPPPNVTTGTSSILAQAAERLTNENSGTLEKPAMEAIKAWLNGEGQHDALVETATALMLCPMRLVKNKGKRSKPENDIIKPRILPTRSWMKKRAEKRGSFMKHQKLFFKNRSLLASLVLDGTERHECRIPNADVYRFYCEKWEKVLPFNGLGQFKSSGVANNEYFEPLISVEEVQTAIRAIKPTSAAGPDGLTRAAICAADPEGRTLTALFNAWMITGIIPKELKKNRTILIPKVMDDEKLKELGNWRPITIGSMILRLFSRIMTARLARACPLNPRQRGFIAASGCSENLKVLQDLMRHAKKLHRPLAVMFIDIAKAFDSVSHAHILW |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CACAAGAAAGTAGATGAACACGTGGTGGGCATCATCCAGAACGCCTACGATCGGTGTACGACCTCGTTCAAAAGCAATGGCGAGTCGACTCGAGAAATTAGCATACGTGTTGGTGTCAAACAGGGTGACCCCATGTCACCCCTGCTCTTCAATCTTGCCATGGACCCTTTGATATGCACCCTAGAGTCACACGGAGTTGGGTACTCCATTGATACCGACCACGTGACAGCTCTTGCGTTTGCTGATGATTTGGTGTTGGTGAGCGAATCTTGGGTTGGTATGGCCGCCAATCTAGCGATCTTGGAATCATTTTGTGGGCTATCGGGATTGGAGGTTCAGGCCAGAAAGTGCCAGGGCTTCATGATAAGCCCAACCAAAGATTCATATACGGTGAACAACTGCGACCCATGGACTATCAAAAATAAAGATGTCCATATGATCCAACCTGATGAATCAACGAAATACCTTGGTCTAAAAATTTGCCCTTGGACTGGCATTATACGGTCGGATCTACATGTTCAACTAAAGACACGGATCTCGAAAATCGATGAGGCGCCTCTGAAACCGACTCAGAAGGTCGAACTCCTCAATGCCTACGCCCTACCCAGATTATTGTACCCTGCTGACCACTCGGACTGCAAGCAATCAACTCTCCGTGTGTTGGACCAAGAAATAATAAAGGCGGTAAAAGGATGGCTCCATCTTCCCGCGTCAACCTGTGACGGGCTGTTGTACGCCAGAGCCCGAGACGGAGGCCTTGCCATCTTGAAACTGGAAAATGCAATTCCTTCGGTTCAAGTTAGAAGGCTGCAACGTATTGCAAACTCCTCTGACGCTATCGCTCGAAACATTGCGTCCTCGCAGGGTGTGGAGGAAGAGTACCGAAGTCTGTGGGTACGGGCAGGGGGTGACAGCGAAGCAATCCCAACGTTCTTTCTCAGGGGTTCGGAATCAAAAGAGCCCGTGTATCCGAGACCCTGCGATTGGAGGAAACGCGAATCTCGGAGACGGTGCGAAAAGCCGGTTCAAGGAAGGGGCATTGTAAACTTTGCGCAAGATAGAATCAGTAATGCATGGTTGGGGCCACGGTGCGGCTTTAAACAATGCTTCTTTATCGCAGCATTACAATTAAGGGCAAATATTTACCCAACAAGAGAAAGCATAAACAGAGGCAGAGATGGTGCCTCACGGTCCTGCAGGAAATGCTCTGCCAGGCTGGAGTCTCTCTCGCACATTCTTGGTCAATGTCCCGCAGTACAAAAATTCAAGGATTGCGCGACGCAATAAGATCAGCGACATTCTAGCTGACGAAGCGGCGAGACTGGGCTGGTGGGTGTACAAAGAGCCACGGTTCACATCTGAAGCCGGAGAGCTAAGGAAACCTGCCCTTGTGTTTGCCAAAGGTGAGGAAGCGCTTGTTATTGATGTCACCGTCCGGTTTGAGCTCTCGAGGAAAACCTCATCAGAGGCTGCCTCGCACCAAGTTGCGTACTACACCCCCCCTTGTGATCAAGTCAAAGTGCTGACGAAGGCAAGCAATGTCACATTCTTTGGATTCCAGGTTGGGGCAAGAGGGAAAGTGGCCCCTTGAGAATAATGAGGTGCTAACCTCCCTGGGCCTGACCAAACCCAGAACACATCACTGGCCAAGATGATTTCCCGCAGCACGTTGCTTTTCTCTCTCGATACCCGAGAATGTTCTGCGGAACTACGCAGTCTATGAACAGTCACAGACAACCTCTGATCCAAG (SEQ ID NO: 1101) | | | VLRHKKVDEHVVGIIQNAYDRCTTSFKSNGESTREISIRVGVKQGDPMSPLLFNLAMDPLICTLESHGVGYSIDTDHVTALAFADDLVLVSESWVGMAANLAILESFCGLSGLEVQARKCQGFMISPTKDSYTVNNCDPWTIKNKDVHMIQPDESTKYLGLKICPWTGIIRSDLHVQLKTRISKIDEAPLKPTQKVELLNAYALPRLLYPADHSDCKQSTLRVLDQEIIKAVKGWLHLPASTCDGLLYARARDGGLAILKLENAIPSVQVRRLQRIANSSDAIARNIASSQGVEEEYRSLWVRAGGDSEAIPTFFLRGSESKEPVYPRPCDWRKRESRRRCEKPVQGRGIVNFAQDRISNAWLGPRCGFKQCFFIAALQLRANIYPTRESINRGRDGASRSCRKCSARLESLSHILGQCPAVQKFKDCATQTEAEMVPHGPAGNALPGWSLSRTFLVNVPQYKNSRIARRNKISDILADEAARLGWWVYKEPRFTSEAGELRKPALVFAKGEEALVIDVTVRFELSRKTSSEAASHQVAYYTPPCDQVKVLTKASNVTFFGFQVGARGKVAP (SEQ ID NO: 1469) |
| R2 | R2-2_SMed | — | *Schmidtea mediterranea* | AGTCATAGGGTGAACTGCAATTCTGACACGATGACCGAGCTGTGTCAGTTTGCAGCTAGTCGCTAAAGACTCGATCAGTCCGCCAAGTGAGGTGGCCGGGTATCTGCAGCACTAGAGCCACTGGTATCAAGAGCAGAGATACGCGAGTGGAAGTTGAGTACGACTACCTTCACGGGGTCCTCCTGATAACCACAGTGGACTGTGGGAACTAAATGTGTGCTCAGCGTTCCCTACTTTCTCGTAGGGTAAAGGGTATGATAACCCAGAGAATATCCCATGGGAGATATCCATGGAAAAAGCACCACGTTAGACAATCCGATGGTCTAACTCGGCTCCGAGGGGCTAACTATCCCAAAGGGCTTAAAGAAAAGAACTGGTTACAATCAAAAATCTATTTGAAGAGTCAGGTGCCACCGCGCCTGCACCAGTTCCCCTAGA | AGTCATAGGGTGAACTGCAATTCTGACACGATGACCGAGCTGTGTCAGTTTGCAGCTAGTCGCTAAAGACTC | TAGAAGGGAAACAAAGGAAAAACGAAATGACTGGAAACTATGAAGGATATAGCT | RKELVTIKNLFEESGATAPAPVPLEVAVEVHQSSSVPEITDESTTTQEGSYSEPPIHRCENCGREFRTRAGVQQHRRKAHTNEFMEEKEKAAPTKKLRWTDEEKEILIESEIKIIKEGSLKEQHEINKILASRMPGRSQD |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGTTGCAGTTGAGGTACACCAGTCATCGAGTGTTCCCGAGATAACCGAC | GATCAGTC | GAAAGC | GIAKIRQKQEHKAEIQ |
| | | | | GAATCTACGACTACTCAGGAAGGAAGCTATTCAGAACCACCGATACACC | CGCCAAGT | CGCAAG | RRLHGTVTTNETRGN |
| | | | | GATGTGAGAACTGTGGAAGAGAATTCAGAACAAGAGCAGGAGTTCAAC | GAGGTGG | GAAGGC | RTSEITEPIRSLPINTK |
| | | | | AGCACCGGAGAAAAGCTCACACCAACGAGTTTATGGAGGAGAAAGAGA | CCGGGTAT | TAAGTC | TWSEDEMKRMLAEE |
| | | | | AGGCAGCTCCAACCAAGAAGCTTCGATGGACAGACGAAGAAAAAGAGA | CTGCAGCA | CTGAAA | VKLRTKNEKDINKKLA |
| | | | | TCCTCATCGAAAGCGAGATAAAGATCATCAAGGAAGGATCCCTTAAAGA | CTAGAGCC | CCGATCT | EIFPNRTMGSIKSKRT |
| | | | | ACAACACGAAATAAACAAGATTCTAGCTTCAAGAATGCCTGGAAGATCA | ACTGGTAT | ACATCTT | KDKDYQDLVKLTMQ |
| | | | | CAAGACGGAATAGCCAAAATTCGCCAGAAACAAGAGCACAAGGCTGAA | CAAGAGCA | CGATCC | TISENPDNETDENTS |
| | | | | ATACAGAGAAGGCTACATGGGACCGTCACTACCAACGAAACCAGAGGA | GAGATACG | CAAGAG | NTENNSTDAEKEVKN |
| | | | | AACAGAACCAGCGAAATTACCGAACCAATAAGAAGCTTACCAATAAACA | CGAGTGG | GAACTG | YLNMLLLTINEEEWL |
| | | | | CCAAAACCTGGAGCGAAGACGAAATGAAAAGAATGCTAGCCGAAGAA | AAGTTGAG | TGGGTT | TSTLKEAATLALQGKK |
| | | | | GTGAAGTTGAGAACCAAGAATGAAAAGGATATCAACAAGAAGCTAGCA | TACGACTA | AAGCTT | TEASEKLNEYASKTLF |
| | | | | GAAATATTCCCGAACAGAACAATGGGGTCCATAAAGAGCAAAAGGACG | CCTTCACG | GAGCCG | PGLKITNQTRKREKKI |
| | | | | AAAGATAAGGACTACCAGGATTTGGTAAAGCTAACAATGCAAACAATCA | GGGTCCTC | ACGGAA | SKRETRRQEYAEIQKL |
| | | | | GCGAGAACCCAGACAATGAAACAGACTTCAATACCAGCAACACGGAAA | CTGATAAC | AAAGCG | YKKNISSAAEKAINGK |
| | | | | ACAACAGCACTGATGCAGAGAAAGAAGTGAAGAACTACCTCAATATGC | CACAGTGG | AATGCA | WSIKPEEEYHNNKDL |
| | | | | TACTACTGACCATCAACGAGGAAGAATGGTTGACATCCACTCTGAAGGA | ACTGTGGG | TGTTAG | IKAWKPILEAPPFSDC |
| | | | | AGCAGCAACACTAGCACTACAAGGAAAGAAAACTGAAGCATCTGAAAA | AACTAAAT | ACGACG | RPIENIKEMDYALMEI |
| | | | | GCTTAACGAGTATGCAAGCAAAACGCTGTTCCCTGGATTGAAAATAACT | GTGTGCTC | AGGTAC | STAEIFLAIRAMGKTA |
| | | | | AATCAGACGAGGAAACGAGAAAAGAAAATATCAAAAAGAGAAACCAG | AGCGTTCC | AGTCAC | PGPDGIKYSKLKKNIQ |
| | | | | AAGGCAAGAATACGCTGAAATACAGAAACTCTACAAAAAGAATATTTCA | CTACTTTCT | CTCCTCG | SMAILFNTCLLTSFLP |
| | | | | AGCGCAGCCGAAAAAGCAATCAATGGGAAATGGTCCATAAAACCCGAA | CGTAGGGT | TGGTATT | LPLKIARTILIPKQENP |
| | | | | GAAGAATACCACAACAATAAGGATCTCATTAAAGCATGGAAACCAATAC | AAAGGGT | TGGCGG | GILDYRPLTIASVVTR |
| | | | | TAGAGGCACCTCCATTCAGTGACTGTAGGCCCATCGAAAACATCAAGGA | ATGATAAC | GCAATG | VFHSILAKKLDNNAQ |
| | | | | AATGGACTACGCTTTAATGGAGATCAGCACGGCAGAAATCTTCCTCGCA | CCAGAGAA | CTCACTA | LSQRQKGFRKCDGV |
| | | | | ATAAGAGCCATGGGGAAGACTGCACCAGGACCTGATGGCATTAAATAT | TATCCCAT | AATTAA | AENIVILETILTNSRSE |
| | | | | TCAAAGCTCAAGAAAAATATCCAATCAATGGCAATATTATTCAACACATG | GGGAGAT | CTGTGA | KRPLCMAFVDLRKAF |
| | | | | CCTACTAACGAGCTTCCTGCCACTCCCATTGAAGATAGCAAGGACAATCC | ATCCATGG | GTAGCT | DSVGHESIIRGAKRV |
| | | | | TGATACCTAAACAAGAGAATCCAGGTATCCTTGACTATCGACCACTAAC | AAAAAGCA | GAGAAC | GVPPMLLEYISSSYQ |
| | | | | AATAGCCTCAGTGGTGACAAGAGTGTTCCACAGTATCCTTGCGAAGAAG | CCACGTTA | TGTATGT | NASTNLFGEILNSRR |
| | | | | CTCGACAACAATGCCCAATTAAGTCAACGACAAAAAGGATTTCGAAAAT | GACAATCC | GTATCAT | GVRQGDPLSPILFNF |
| | | | | GTGATGGAGTTGCGGAAAATATAGTAATACTCGAAACTATATTAACCAA | GATGGTCT | GAAAAA | VIDEALENLNRNIGYL |
| | | | | CAGCAGAAGTGAAAAGAGACCGCTCTGTATGGCCTTCGTTGACTTAAGA | AACTCGGC | AAAA | LKEEKVSCLAFADDIV |
| | | | | AAAGCATTCGATTCTGTGGGACATGAGTCTATCATCAGAGGAGCAAAAA | TCCGAGGG | (SEQ ID | LIAETKGGLENHIEKLL |
| | | | | GAGTTGGAGTGCCACCAATGTTGCTCGAGTACATTTCKTCAAGTTACCA | GCTAACTA | NO: | EKLNGAGLELNASKC |
| | | | | GAATGCGTCTACTAACTTGTTCGGCGAAATACTCAACTCGAGAAGAGGA | TCCCAAAG | 1348) | ATLMVMKNGKEKST |
| | | | | GTCAGGCAAGGCGACCCTCTGAGCCCTATTCTCTTCAATTTTGTTATCGA | GGCTTAA | | YISTKAIKIKENDIPTM |
| | | | | TGAAGCTCTAGAAAACCTCAACAGGAATATTGGATATCTACTGAAGGAA | (SEQ ID | | KATETYKYLGLQMGF |
| | | | | GAAAAAGTGAGTTGCCTAGCTTTCGCGGACGACATAGTCCTGATAGCTG | NO: 1225) | | KAREQNANEVITEGL |
| | | | | AGACAAAAGGAGGCCTAGAGAATCATATCGAGAAACTATTAGAGAAGC | | | ENITRAPLKPQQRIHI |
| | | | | TGAATGGGGCCGGTCTCGAGTTGAACGCCTCGAAATGCGCAACACTGA | | | LRDFLIPRLIHKLVLGR |
| | | | | TGGTGATGAAAAACGGAAAGGAAAAATCAACGTATATATCAACAAAAG | | | VAKKSLKRIDQNIRKK |
| | | | | CAATCAAAATCAAAGAAAATGACATTCCAACAATGAAAGCCACAGAAAC | | | VRNWLHLPKDTTAA |
| | | | | GTACAAATATCTCGGATTGCAAATGGGTTTCAAAGCTAGAGAACAGAAT | | | FIHADAGDGGLGVP |
| | | | | GCTAATGAGGTTATTACAGAAGGACTGGAGAATATAACAAGAGCACCA | | | ALEHTIPLLKRERITNL |
| | | | | CTGAAGCCCCAGCAGAGGATACATATCCTACGAGACTTCCTTATACCAA | | | RKSNDPVTKECLRME |
| | | | | GATTAATACACAAATTGGTATTAGGAAGAGTGGCCAAGAAGTCATTAAA | | | YTKQVLGKWSRPTKI |
| | | | | AAGAATCGACCAGAATATAAGAAAGAAAGTGAGGAATTGGCTACATCT | | | GETLATNKSQLKEAF |
| | | | | CCCTAAAGACACGACAGCAGCATTCATACACGCTGATGCAGGAGATGG | | | RKQMLITLDGKGLKD |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGGGCTTGGAGTACCAGCGTTAGAACACACAATTCCTCTACTGAAAAGA | | | HHETPTIHKWIRRGE |
| | | | | GAAAGAATAACTAATCTAAGAAAATCCAATGATCCAGTTACCAAAGAAT | | | NMTGKQFITAVKIRG |
| | | | | GCCTGAGAATGGAGTACACCAAACAAGTACTGGGAAAATGGAGTAGAC | | | NLVATKSRNSRGRPE |
| | | | | CAACTAAAATTGGAGAAACTCTGGCTACCAACAAAAGCCAACTAAAAGA | | | QEKLCEAQCGRPDSL |
| | | | | AGCATTCAGAAAACAGATGTTAATAACGCTAGATGGAAAAGGGCTAAA | | | GHILQGCWRTHGM |
| | | | | AGATCACCACGAAACGCCCACTATCCACAAATGGATCAGAAGAGGAGA | | | RVERHNNICRRIKAI |
| | | | | GAACATGACCGGCAAACAGTTTATCACAGCAGTTAAAATAAGAGGAAA | | | MKGKESEVVEEPRLQ |
| | | | | CCTTGTGGCAACTAAGTCAAGAAATAGCAGAGGGAGACCCGAACAAGA | | | TNEGLRKPDLLICHKG |
| | | | | GAAACTATGTGAAGCTCAATGTGGACGACCAGATAGCCTGGGACACAT | | | KIIICDAQVVADSSNC |
| | | | | ATTACAAGGTTGCTGGAGAACACATGGTATGCGAGTGGAAAGGCATAA | | | SLESENQRKIDYYKKD |
| | | | | CAACATTTGTCGCAGAATTAAAGCAATAATGAAAGGAAAGGAAAGCGA | | | SVVSEARKLIGRVDE |
| | | | | AGTAGTCGAAGAACCAAGACTACAAACGAATGAAGGTCTCAGAAAGCC | | | DIIIMAVTFNWRGAI |
| | | | | TGACTTACTGATCTGTCACAAAGGTAAAATAATAATATGCGATGCACAA | | | SKTSIRDLDMLLDIKS |
| | | | | GTAGTGGCAGATAGCTCGAACTGCAGTCTTGAAAGCGAAAACCAAAGA | | | KEVIKMSRKIIRDNSI |
| | | | | AAGATAGATTACTACAAGAAAGATTCAGTAGTATCAGAAGCAAGAAAA | | | MVEMHRNRTEKRR |
| | | | | CTTATCGGACGTGTCGACGAAGATATAATTATAATGGCAGTGACCTTTA | | | (SEQ ID NO: 1470) |
| | | | | ACTGGAGAGGAGCCATCTCAAAAACATCAATAAGAGATTTGGACATGCT | | | |
| | | | | TCTAGATATAAAATCAAAAGAAGTAATTAAAATGTCAAGGAAAATAATC | | | |
| | | | | AGAGATAATAGCATCATGGTGGAGATGCACAGAAACCGGACTGAGAAA | | | |
| | | | | AGGAGATAGAAGGGAAACAAAGGAAAAACGAAATGACTGGAAACTAT | | | |
| | | | | GAAGGATATAGCTGAAAGCCGCAAGGAAGGCTAAGTCCTGAAACCGAT | | | |
| | | | | CTACATCTTCGATCCCAAGAGGAACTGTGGGTTAAGCTTGAGCCGACGG | | | |
| | | | | AAAAAGCGAATGCATGTTAGACGACGAGGTACAGTCACCTCCTCGTGGT | | | |
| | | | | ATTTGGCGGGCAATGCTCACTAAATTAACTGTGAGTAGCTGAGAACTGT | | | |
| | | | | ATGTGTATCATGAAAAAAAAA (SEQ ID NO: 1102) | | | |
| R2 | R2- | — | *Tribolium* | TGGAAGACCCCGCCCATGAGGCTTGGAGAGTGTGATCCTGATCACACTT | TGGAAGAC | TGATGC | MKSRSFRRIGDCAAG |
| | 2_TCas | | *castaneum* | GAAAAGTTATGCTGAGTACGTCGTGAGAGTCGGTAACTGTCCCAGGAT | CCCGCCCA | TCCTTTG | SSRRGVRLTGKAGRE |
| | | | | GGTCTGGGATAGGCTAAACCTCAGCAGGGGAAAGTTGTAGGGGCCTGC | TGAGGCTT | GTTTTAC | GRFAASPHLSPRYLA |
| | | | | CACCCCTACACTTTTATAGATATGGCATTCGATACCTCAAATAGAGCCTC | GGAGAGT | CATCTGT | GSVSGNVPSVPPGP |
| | | | | GGACTTGGAGGAGCATGGTTCCCCTCCTCCTCGTACTAGACCTGGAACC | GTGATCCT | GGGGGC | GLGAGAPAFAAGRN |
| | | | | AACGGTCTTGACAACCCCATTGGACCTACGGGAGCGGACCATGCTCATG | GATCACAC | ATCGGT | ADGGPAQNPCPYCA |
| | | | | GACATGGATTCCGAAGACGAAGCGGGGGAACACGGACCCCCCGCCGAT | TTGAAAAG | CCTCAC | RSFTTANGRGLHIRR |
| | | | | AATGCTCACTTAACGTCAGGCGAACCCATCGAAATCATCTTGATGTTACC | TTATGCTG | GGTTTC | AHPDEANNAIDIERI |
| | | | | CTTTCAAAGCAGGTCATGCGGCATATGTCTCAATGCCGGAAAGGGTGGC | AGTACGTC | CTCGGG | HARWSHEETAMMA |
| | | | | TCCCGGGCGTAACGGACATCTATCGCTGATGGAASCTAGCTCGCTCTTG | GTGAGAGT | TTTCCTA | RLEAGAIQRGGVRF |
| | | | | AAGAACGGCGGACGGGGACTTGGAATCGTGGTGTGGTTCTGATGTAAG | CGGTAACT | TTGTTTT | MNQFLVPRMPGRTL |
| | | | | TCCTGAAATTATGGCGTGATGGCCCGCCCGCCCGACCGGAGGGACTTA | GTCCCAGG | TCCTAAA | EAVKSKRRDATYKAL |
| | | | | GAACCCCCTTCCGCGAGGGTCCTGTCTGTAGGTCCWCCATCTCCGTAAA | ATGGTCTG | CCCGAC | VQRFLQAPQINLPEL |
| | | | | ACGAGTTGGAGGAAACCGCAGACGGGGATGAAGAGTCGTTCGTTCCGT | GGATAGG | AAGGAG | RDGDAPRQPDPQQE |
| | | | | CGCATCGGGGATTGCGCAGCTGGGTCAAGTCGGCGGGGTGTTCGGCTA | CTAAACCT | CCCTTTG | NPPEPPSFDGAIRGA |
| | | | | ACGGGCAAGGCTGGGCGTGAGGGGAGGTTTGCAGCTTCCCCTCACTTA | CAGCAGG | GCCCTCC | VADLVGGVDWQRL |
| | | | | AGCCCACGTTATCTTGCAGGCTCGGTTTCAGGTAATGTTCCTTCAGTTCC | GGAAAGTT | TCCTTAA | GFQGDRLCNIARRAC |
| | | | | CCCCGGCCCCGGCCTGGGGGCCGGGGCTCCTGCATTTGCTGCTGGTCG | GTAGGGG | ACACCTC | DGGDVSGQLLGWLR |
| | | | | GAATGCCGATGGGGGGCCCGCCCAAAATCCGTGCCCGTATTGTGCACG | CCTGCCAC | TCCTTCA | DVFPVKRVSTRGDQS |
| | | | | GTCGTTTACTACCGCCAATGGCCGCGGGTTGCACATACGGAGGGCGCAT | CCCTACAC | TCCTSTT | DLDVDGALVSRRTAR |
| | | | | CCAGACGAGGCTAATAACGCCATAGACATCGAACGCATTCATGCCCGCT | TTTTATAG | AGTCCA | TREYARVQELYRKEP |
| | | | | GGTCACACGAGGAGACAGCCATGATGGCCAGGCTTGAGGCCGGTGCCA | ATATGGCA | TTCCGG | KACLARILGDRREGA |
| | | | | TCCAGCGAGGGGGTGTAAGGTTTATGAACCAGTTTCTGGTTCCGCGCAT | TTCGATAC | CTAAAA | NRAPNRDPAFIDFW |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCCGGGCAGGACTCTGGAAGCGGTGAAAAGTAAGCGCAGAGATGCGA | CTCAAATA | TGATGA | RGVFSEASAEVEGW |
| | | | | CTTACAAAGCACTGGTCCAGAGGTTTCTGCAGGCGCCGCAAATAAACCT | GAGCCTCG | AGACCG | AEEVSDHGELARRV |
| | | | | CCCCGAACTGCGTGATGGTGATGCGCCTCGTCAGCCTGATCCTCAACAG | GACTTGGA | AGGAGT | WDPISVEEVGRSRVR |
| | | | | GAAAACCCTCCCGAGCCCCCTTCTTTCGATGGGGCGATCAGGGGCGCTG | GGAGCAT | GTCACTC | NGAAPGPDGIAVSV |
| | | | | TCGCCGACCTTGTCGGAGGGGTCGACTGGCAGCGCCTCGGGTTTCAGG | GGTTCCCC | TCTTGG | WNKLPPEAAALLFNV |
| | | | | GAGACCGTCTCTGTAACATCGCGAGACGGGCTTGCGATGGGGGGGATG | TCCTCCTC | CGGGGT | LLLGRCLPAELTRTRT |
| | | | | TTTCGGGCCAGTTGCTGGGCTGGCTGCGGGATGTCTTCCCCGTCAAGAG | GTACTAGA | TAACCC | VFIPKTDAPRTPADYR |
| | | | | GGTTAGTACTAGAGGGGATCAGAGCGACCTAGATGTCGACGGCGCATT | CCTGGAAC | GTCCAA | PISIASVVARHFHRVL |
| | | | | GGTGAGCAGGCGCACGGCGAGGACAAGGGAGTACGCTCGGGTGCAGG | CAACGGTC | GTGTAA | SARVQRIPDLFTKYQ |
| | | | | AGCTGTACCGGAAGGAACCTAAGGCGTGTTTGGCTCGAATCCTTGGTGA | TTGACAAC | ATGTGA | RGFLSGVDGIADNLS |
| | | | | TCGTCGAGAGGGGGCCAATCGGGCTCCTAATCGCGATCCCGCATTCATC | CCCATTGG | CCTCGCC | VLDTMLTMSRRCCK |
| | | | | GATTTTTGGCGAGGCGTCTTTTCGGAGGCGTCCGCTGAGGTCGAGGGA | ACCTACGG | ATTCGG | HLHLAALDVSKAFDT |
| | | | | TGGGCGGAGGAGGTCTCCGACCATGGTGAGCTGGCACGCCGGGTTTGG | GAGCGGA | GCTCTG | VSHFAIVRACRSIFGS |
| | | | | GACCCCATCTCTGTCGAGGAGGTGGGAAGGTCTCGGGTCCGGAATGGT | CCATGCTC | ATA | AETVLEEGGRRHFVQ |
| | | | | GCAGCGCCGGGGCCCGACGGAATAGCGGTTTCCGTGTGGAACAAGCTT | ATGGACAT | (SEQ ID | VRXGVRQXDPLSPLL |
| | | | | CCGCCGGAGGCCGCTGCCCTTCTTTTCAATGTGCTGCTGTTGGGGAGAT | GGATTCCG | NO: | FNLVLDRALKRLSTDV |
| | | | | GTCTGCCTGCAGAACTCACCCGCACGCGAACGGTCTTTATTCCAAAGAC | AAGACGA | 1349) | GFRLTDATKVTALAF |
| | | | | CGACGCACCGCGAACACCTGCAGACTATCGGCCGATTTCGATCGCGTCG | AGCGGGG | | ADDVVLCATTARGL |
| | | | | GTAGTCGCACGGCACTTCCACCGTGTCTTATCCGCACGTGTTCAACGCAT | GAACACG | | QTNLDVLEAELRLAG |
| | | | | TCCCGACTTGTTCACAAAGTATCAAAGGGGCTTCTTAAGCGGCGTGGAC | GACCCCCC | | LLLNPNKCQALSLVAS |
| | | | | GGGATCGCAGATAATCTCTCGGTCCTTGACACAATGCTGACGATGTCCC | GCCGATAA | | GRDHKVKLVTKPTFK |
| | | | | GGAGATGCTGCAAGCATTTGCACTTGGCCGCGTTAGACGTGTCAAAAGC | TGCTCACT | | VGQNTIHQVDASSI |
| | | | | ATTTGACACTGTCTCTCACTTTGCCATAGTGCGTGCTTGCCGGTCCATATT | TAACGTCA | | WKYLGIQFRGSGMC |
| | | | | TGGGAGTGCGGAGACCGTGTTGGAGGAGGGCGGGAGGAGGCACTTCG | GGCGAACC | | GCGSEGVAAGLKRIT |
| | | | | TGCAAGTGCGGYGTGGGGTGAGGCAGKGAGACCCACTCTCTCCTCTCCT | CATCGAAA | | CAPLKPQQRMHLLR |
| | | | | CTTTAACCTGGTCTTGGACCGGGCTCTGAAGAGGCTGTCCACCGATGTG | TCATCTTG | | VFFLPKFYHAWTFGR |
| | | | | GGCTTTCGTCTAACGGATGCGACCAAAGTTACGGCACTCGCTTTTGCGG | ATGTTACC | | LNAGVLRRLDVVVRT |
| | | | | ACGACGTCGTTCTGTGCGCGACCACCGCTAGAGGACTCCAGACCAATCT | CTTTCAAA | | SVRTWLRLPHDIPVG |
| | | | | GGATGTTCTCGAAGCGGAGCTTCGCCTAGCCGGTCTCTTGTTGAACCCC | GCAGGTCA | | YFHAPTKSGGLGIPQ |
| | | | | AACAAGTGTCAGGCCTTATCCTTGGTGGCTTCCGGACGGGACCACAAAG | TGCGGCAT | | LSRFIPFLRLKRFDRLG |
| | | | | TGAAGCTCGTGACAAAACCCACCTTTAAGGTGGGACAAAACACGATTCA | ATGTCTCA | | RSAVDYVRECAFTDI |
| | | | | CCAAGTGGATGCGTCCAGTATTTGGAAGTACCTGGGAATCCAGTTTAGG | ATGCCGGA | | ADRKIRWCRERLSGI |
| | | | | GGTAGTGGGATGTGCGGATGCGGTTCGGAGGGTGTGGCTGCTGGGTT | AAGGGTG | | VDQVAGGRDALDAY |
| | | | | GAAGCGGATCACTTGTGCTCCGCTGAAGCCTCAGCAGAGGATGCACCT | GCTCCCGG | | WTAQLHQSVDGRAL |
| | | | | GCTGCGAGTCTTTTTCTTGCCCAAGTTTTATCATGCTTGGACATTTGGGA | GCGTAACG | | RESASVASSTQWLRC |
| | | | | GACTCAATGCGGGTGTACTGCGCCGTCTGGACGTTGTGGTCCGAACTTC | GACATCTA | | STRAIPASDWLHYTA |
| | | | | GGTTCGGACCTGGCTACGCCTCCCCCACGATATACCGGTGGGATACTTT | TCGCTGAT | | VHIGALPSRVRTSRG |
| | | | | CACGCTCCTACGAAGTCCGGGGGGCTGGGGATCCCGCAGTTGTCACGA | GGAASCTA | | RRGGQDVSCRGGCL |
| | | | | TTCATCCCGTTCTTGCGATTAAAGCGGTTCGACCGGTTGGGGCGTTCCG | GCTCGCTC | | LDETPAHCIQVCHRT |
| | | | | CGGTTGACTATGTCCGAGAGTGTGCATTTACGGACATTGCGGATCGAAA | TTGAAGAA | | HGGRVLRHDAIAKRI |
| | | | | GATCCGATGGTGCCGTGAGCGCCTCTCGGGCATAGTGGACCAAGTCGC | CGGCGGA | | SADLMELGWIVTREV |
| | | | | GGGTGGGCGGGACGCGCTTGATGCATATTGGACAGCGCAGCTTCATCA | CGGGGACT | | SFRTTAGVFRPDMV |
| | | | | GTCGGTGGACGGAAGAGCACTAAGGGAGTCCGCTTCGGTGGCTTCCAG | TGGAATCG | | AVKEGVTVILDVQIVS |
| | | | | CACGCAGTGGCTCCGCTGTAGCACACGTGCAATTCCGGCCTCTGACTGG | TGGTGTGG | | PAPTLDEAHRRKVAK |
| | | | | CTGCATTACACGGCTGTCCATATTGGCGCCCTACCATCGCGTGTTCGCAC | TTCTGATG | | YRDRADLARYLAEAA |
| | | | | ATCGCGTGGGAGGCGGGGCGGCCAGGATGTCTCTTGTCGGGGTGGAT | TAAGTCCT | | VARGRAPPANIRFAS |
| | | | | GTCTTCTGGACGAAACTCCGGCACACTGCATCCAGGTTTGCCACCGCAC | GAAATTAT | | ATISWRGVWSAESV |
| | | | | CCACGGGGGGCGGGTGTTGCGACACGACGCCATCGCCAAGCGCATTTC | GGCGTGAT | | GSLRELGLSARHFDR |
| | | | | TGCCGACCTGATGGAACTTGGATGGATCGTAACGAGGGAGGTTTCCTTC | GGCCCGCC | | YTTMALCGSWRNW |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGGACGACTGCGGGTGTTTTCCGGCCGGACATGGTCGCGGTAAAGGAG | CGCCCGAC | | VRFNASTASRMGRG |
| | | | | GGTGTTACCGTGATCTTGGACGTGCAGATTGTTTCACCGGCCCCGACAC | CGGAGGG | | RGDASPRRHENQQ |
| | | | | TGGATGAGGCCCATCGGCGAAAGGTTGCCAAGTATCGGGACAGGGCTG | ACTTAGAA | | (SEQ ID NO: 1471) |
| | | | | ACCTGGCCAGGTACTTGGCTGAGGCTGCGGTTGCTCGTGGGCGTGCGC | CCCCCTTC | | |
| | | | | CGCCTGCGAATATACGATTTGCCAGCGCGACCATCTCTTGGCGAGGCGT | CGCGAGG | | |
| | | | | TTGGAGTGCTGAGTCGGTGGGGTCCCTGCGCGAGCTGGGGCTCTCCGC | GTCCTGTC | | |
| | | | | TCGGCACTTCGATCGCTATACAACGATGGCACTCTGCGGTTCATGGAGA | TGTAGGTC | | |
| | | | | AATTGGGTGCGGTTCAATGCGTCCACGGCCTCTCGGATGGGTCGTGGAC | CWCCATCT | | |
| | | | | GCGGCGACGCGAGTCCTCGGAGGCACGAAAATCAGCAGTGATGCTCCT | CCGTAAAA | | |
| | | | | TTGGTTTTACCATCTGTGGGGGCATCGGTCCTCACGGTTTCCTCGGGTTT | CGAGTTGG | | |
| | | | | CCTATTGTTTTTCCTAAACCCGACAAGGAGCCCTTTGGCCCTCCTCCTTAA | AGGAAACC | | |
| | | | | ACACCTCTCCTTCATCCTSTTAGTCCATTCCGGCTAAAATGATGAAGACC | GCAGACG | | |
| | | | | GAGGAGTGTCACTCTCTTGGGGGGTTAACCCGTCCAAGTGTAAATGTG | GGG (SEQ | | |
| | | | | ACCTCGCCATTCGGGCTCTGATA (SEQ ID NO: 1103) | ID NO: | | |
| | | | | | 1226) | | |
| R2 | R2-7_MR | — | *Megachile rotundata* | TCTAGTTAGCAAGCGGCCCCCTCTAATCGGGTCCCGCCACGAGTACCTTC | TCTAGTTA | TAAATG | SGPATSTFGETKSRLC |
| | | | | GGGGAAACCAAGAGCCGCCTCTGCGAACCTACCTCCGCATTGGGTTGCC | GCAAGCG | TCGAAC | EPTSALGCRPGAVVI |
| | | | | GGCCCGGTGCGGTTGTAATTCAGTGGGCCCAAATTCACAAGGAAAAGA | GCCCCCTC | CGAATTT | QWAQIHKEKRKRIVG |
| | | | | GAAAAAGAATTGTCGGTTGGCCCTTAGGGCATCTCGGATCACCGACCTC | TAA (SEQ | TGGGTA | WPLGHLGSPTSLKLR |
| | | | | ACTGAAACTTCGACACCCGCGCCTGCAAGCGAAGCGCATAGTTCCAGTG | ID NO: | ACGTGC | HPRLQAKRIVPVLAEL |
| | | | | CTTGCGGAGTTGATGCAATGTTTGTGTGCTCGACATGTCAGCGGCCGTT | 1227) | ACCCCA | MQCLCARHVSGRSP |
| | | | | CGCCACAAAAATCGGCTTGGGCGTTCACGTTAGAAGAGCGCACGAGTG | | CCATCCT | QKSAWAFTLEERTSA |
| | | | | CTTGCGGAGTTGATGCAATGTTTGTGTGCTCGACATGTCAAAGGTCGTT | | TAATCG | CGVDAMFVCSTCQR |
| | | | | CGCCACAAAAATCGGCTTGGGCGTTCACGTTAGAAGAGCGCACGTGGA | | GCAGCA | SFATKIGLGVHVRRA |
| | | | | AGTCGCAAACGCTGCCATATCAGTGGAGCGCGTTAAGGATCGTTGGTC | | CGCAAT | HVEVANAAISVERVK |
| | | | | GGAGGAGGAGCGAAGAATAATGGCTGCCGTCGAGGTTCGAGGAGTAC | | AAAGCC | DRWSEEERRIMAAV |
| | | | | TCTCTGGGGCTCGTTTTATAAACGAGTACATTATGAGTCATCTCCAGACC | | GTGGGC | EVRGVLSGARFINEYI |
| | | | | AGCCGGACCCTCGAATCTGTCAAAGGAACTCGGAAAAACCCCAAATACA | | AGTGGT | MSHLQTSRTLESVKG |
| | | | | AGGAACTTGTCGCAACCTTACTGGAAGAGGCACGAACCAGTGTGCGGG | | TTTAGTG | TRKNPKYKELVATLLE |
| | | | | AGGAGAGTCCTCGTAGTGCGGTCAACGATAGCGCCACCCAACCATCAG | | GGTAGT | EARTSVREESPRSAV |
| | | | | GCCCCTCTGATACACGAAGCCTGCGCACCGAACACCTGTTCACTGAAAG | | CATTAG | NDSATQPSGPSDTRS |
| | | | | CACCGAGCCTTTCGAACATCGGATCCGAGAGTTGATCGGGGATCTTGAG | | GAGTCC | LRTEHLFTESTEPFEH |
| | | | | GGAGTGACCGACTTCAGAGCTGAGTTGCTGGTTTCCATTGCGGAACAGC | | CACAGT | RIRELIGDLEGVTDFR |
| | | | | AGCTTCAAGGCGATGAGGTGGCGGAATCCCTGACTCGGTGGCTTGGCG | | ACCCAG | AELLVSIAEQQLQGD |
| | | | | AGGTTTTTAAACCCGAGAACCAACAACAACAGGTTCAGCGTAAGCGTCG | | CGAACA | EVAESLTRWLGEVFK |
| | | | | GCGACAAAGAAAGGCCCCTGTCAGTGGGCAGCTGCCAAAGTGGCGCGA | | TCTTAGT | PENQQQVQRKRRR |
| | | | | GAGGCGAAGGGATTATGCAGCGATGCAGACTCTCTTCCATCGGAACCCC | | GGGTCT | QRKAPVSGQLPKWR |
| | | | | AGTCTTGCTGCTGGTCGTGTGCTGGACGGCAAGAACGAGTCCCGGCCCC | | GCGTAA | ERRRDYAAMQTLFH |
| | | | | CGGATCTGCCAGAAATGACAGCGTTTTGGGAACCGATACTCACCGAGCA | | ACGCAT | RNPSLAAGRVLDGK |
| | | | | ATCTGCCGAACATCGGGCAGTTGGGCCGGCTTCCGAGAAATCGGAGTT | | TTCCACT | NESRPPDLPEMTAF |
| | | | | GTGCTCAGTATGGGGTCCAGTAGAGAAAGAAGAACTTCTCTCCTCCGTG | | GCCTATC | WEPILTEQSAEHRAV |
| | | | | CCGCCGTTGGACACGGCTGTTGGCCCTGACGGTGTCACCGCCAGACAAT | | CTCCGG | GPASEKSELCSVWGP |
| | | | | GGAGAGCGGTTTTACCGGCCGTTAGAGCTCTCTTGTATAACATCATCCTC | | GAAAAA | VEKEELLSSVPPLDTA |
| | | | | AAGAGAGGCTCTTTCCCCGCCTCGATGCTGGAAAGCAGAACCGTGTTCC | | AAAAAA | VGPDGVTARQWRA |
| | | | | TGCCGAAGAAGCAACATAGTGTCAATCCTGCTGACTTTCGACCCATCAG | | AAAAAA | VLPAVRALLYNIILKR |
| | | | | CATAGCGTCGGTCGTCGTCCGTCAATTACACAAGATCTTGGCCATGCGC | | AAAAAA | GSFPASMLESRTVFL |
| | | | | CTTCGCCGTACGAACCTCGTTGACGAAAGGCAACGATGCATGGATGAC | | AAAAAA | PKKQHSVNPADFRPI |
| | | | | GGATGTGCCGAGAACATCACGGTGTTGGCCTCGCTGCTGGACGATGCG | | AAAAAA | SIASVVVRQLHKILA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGGCATGGTCTGAAGGAGCTGCATCTGGTTTCGTTGGATTGTGCTAAGG | | AAAAAA | MRLRRTNLVDERQR |
| | | | | CGTTCGACAGCGTTAGTCACCATGCGATCGACGCAACACTAAAAGAATG | | AAAA | CMDDGCAENITVLAS |
| | | | | CGGTCTGCCCGCGGGATTTGTGCAATACATCTCCCGCACATATTCCGACA | | (SEQ ID | LLDDARHGLKELHLV |
| | | | | GTTCCACCAGGCTCGAGGTCGGAAGGAATCGGTCGGAGCCAATAAAGA | | NO: | SLDCAKAFDSVSHHA |
| | | | | CCAACCGGGGAGTGCGGCAGGGTGATCCCCTGTCAACCCTCATCTTCTG | | 1350) | IDATLKECGLPAGFV |
| | | | | TCTGTGCTTCGATAGAGTCGCGCGTACCCTCTCACCACACATTGGGTATG | | | QYISRTYSDSSTRLEV |
| | | | | ACCTTAATAACACCCGCATCAGTACTCTGCTTTACGCTGATGATGCTTTC | | | GRNRSEPIKTNRGVR |
| | | | | CTTGTCTCGACGACTGCTCCGGGGATGAACATCCTGCTCCGGAGTGTGG | | | QGDPLSTLIFCLCFDR |
| | | | | AGGAAAGTGCCGGTGAGGTGGGGCTTTCTTTTAACACCTCGAAATGCTC | | | VARTLSPHIGYDLNN |
| | | | | AGCCCTCTCCTTAATTCCATCTGGAAAGGAAAAGAAAATGAAGGTCGGA | | | TRISTLLYADDAFLVS |
| | | | | ACGACTCCGACGTTCAAAACGTCGCAGGGTTTTATTACCCAGATAACGC | | | TTAPGMNILLRSVEE |
| | | | | CCTCGCAAGAGTGGAGGTATCTAGGAGTCGACTTCCAATACTCCGGACC | | | SAGEVGLSFNTSKCS |
| | | | | GAAAAAAGCAAGTCGGAGTCTCAAAATCGAGCTGGAACGCATTTCGAA | | | ALSLIPSGKEKKMKV |
| | | | | GGCCCCCCTCAAGCCGCAACAGCGGCTTTTAATCCTCAGAGTCTACCTGC | | | GTTPTFKTSQGFITQI |
| | | | | TGCCGCGATATTACCATCATCTCGTACTCTCCAGGACAACCCTTGGTCAC | | | TPSQEWRYLGVDFQ |
| | | | | CTTAGGGGCCTGGACCTGCAAGTGCGCGCGGCTGTTCGTAGGTGGCTG | | | YSGPKKASRSLKIELE |
| | | | | TCTCTGCCGCGCGACATCCCCATTGCCTACTTCCACACAACAGCGAAGG | | | RISKAPLKPQQRLLILR |
| | | | | AAGGGGGTCTGGGTCTTCCGGCGTTTGAGACGTCCATTCCATGCCTGAT | | | VYLLPRYYHHLVLSRT |
| | | | | GTTAGCCCGCTTGAGGTCGATGGAAACCTCGACTTGCAAGGCGGCTAG | | | TLGHLRGLDLQVRAA |
| | | | | GGCGGCGGTTCAAGGCTTCTGGGTGCAGAAACGCATCCATTGGGCTAC | | | VRRWLSLPRDIPIAYF |
| | | | | GGCCGCTCTCACTAAGAACGGAGAAGCCCTAACATGCAAGGCGGACGT | | | HTTAKEGGLGLPAFE |
| | | | | CGATCGGTGGTGGGCCAGTAGGCTCCACAAGTCAGTGGATGGTCGCGA | | | TSIPCLMLARLRSME |
| | | | | ACTGCGTGAGTGCTCAGGCGTTGGCTCGTCCAGCACCTGGGTAAATTCT | | | TSTCKAARAAVQGF |
| | | | | GCGCTTAACATCACCGGCAGAGATTACGTGCAGTATCATCACGTCCGCA | | | WVQKRIHWATAALT |
| | | | | TCAATTCTCTCCCGACTCGCATTAGGACATCTCGGGGTGTGCGAAGAGA | | | KNGEALTCKADVDR |
| | | | | GGGGATGGAGGTCACGTGCCGCGCTGGGTGTCAGGTAACTGAGACCGC | | | WWASRLHKSVDGRE |
| | | | | GGCGCATGTCATCCAGTCTTGCCACCGCACACATGGAGGTCGGATTCTT | | | LRECSGVGSSSTWVN |
| | | | | CGACACAATGCCGTGTGCAAAGTGCTGGCGTCCGGCCTTCGCGACAAG | | | SALNITGRDYVQYHH |
| | | | | GGATGGGAGGTGCGTGAAGAGCCAAAACTGCGAACGCGACAGGGTCT | | | VRINSLPTRIRTSRGV |
| | | | | GAGGAAGCCGGACATAGTGGCGATAAAGGACGGCGTCGCAAGGGTGA | | | RREGMEVTCRAGCQ |
| | | | | TAGACGCACAGGTCGTGAGTGGATCTGGACCGCTTGACGAGGCGCATG | | | VTETAAHVIQSCHRT |
| | | | | AGACCAAGCGCAAGTATTATTCCGACAATGGCGACGTAACTGCTGCGAT | | | HGGRILRHNAVCKVL |
| | | | | TGCTCGTGAGTGCAACATTGCTCCATCGAATGTTGCATACTCGTCATGCA | | | ASGLRDKGWEVREE |
| | | | | CTATCTCTTGGAGGGGTGTGTGGTCGCCTCGGTCCGCTGCAGACCTACT | | | PKLRTRQGLRKPDIV |
| | | | | ACAGGTGGGTCTGTCCAAAAAGCTCTTGGGTTTCATCACCCTAAGGGTC | | | AIKDGVARVIDAQVV |
| | | | | TTGAGAGGCAGTCATCTAAATTGGACACGGTGGAACAAAATGACAACG | | | SGSGPLDEAHETKRK |
| | | | | ATGCGCGTACACCATCAGCGAACAGGTATCGGGTAAATGTCGAACCGA | | | YYSDNGDVTAAIARE |
| | | | | ATTTTGGGTAACGTGCACCCCACCATCCTTAATCGGCAGCACGCAATAA | | | CNIAPSNVAYSSCTIS |
| | | | | AGCCGTGGGCAGTGGTTTTAGTGGGTAGTCATTAGGAGTCCCACAGTAC | | | WRGVWSPRSAADLL |
| | | | | CCAGCGAACATCTTAGTGGGTCTGCGTAAACGCATTTCCACTGCCTATCC | | | QVGLSKKLLGFITLRV |
| | | | | TCCGGGAAAAAAAAAAAAAAAAAAAAAAAAAAAAAAAAAAAAAAAAA | | | LRGSHLNWTRWNK |
| | | | | AAAA (SEQ ID NO: 1104) | | | MTTMRVHHQRTGIG |
| | | | | | | | (SEQ ID NO: 1472) |
| R2 | R2Amel | — | *Apis* | TGGTAATCAAATGCCTCGCTATTTTAGTAGCGGTAGCGCTCCGCCCGCG | TGGTAATC | TGATCG | MSSNEEGASDTGAP |
| | | | *mellifera* | CAGGAACCATTGACGCCGCCGTAGTGTGGGTGATTTTATATCCAACCAA | AAATGCCT | TTAAAA | GPGVPVADVSAADG |
| | | | | TCACGTCAACTACGATCATTTGTAATCACCGACGGTACTTGGTAGGGGT | CGCTATTT | GTAAAA | RATYDDHGMSTDYE |
| | | | | ACCACATGGGCATTCTTGCTCATTCCACAACGCCGCCTCCATCATGGCAA | TAGTAGCG | ATCTATT | KQTIELPLNGQIQCL |
| | | | | CAATTTAAAATATATATAAATTCTTAAGGTTTGACCGTATTCATATATATA | GTAGCGCT | TATTTAT | WCHIEGRNQRFLQE |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TATATATATTTAATATTACAACCATAAATCTTATATCGAGCCTTCTATTTG | CCGCCCGC | TTTTATT | SQYLKHKDTQHPKGE |
| | | | | GTCTCAAAAGCAATACGTTGTCAGATCTTGTAGAACATCAGGAGTGAGC | GCAGGAA | CCTATAT | IIWRCAACQKEFEKL |
| | | | | GGTGCGCTGTGGTATCCGTGCTTTGTGCCGCGGCGACAAACCAATACGC | CCATTGAC | TATAAC | HGCRCHLPKCKGRKE |
| | | | | TGCTGCCTGTCGCAAAGCAATACGCTGCTGATTCTCGGATGCGGGTGTC | GCCGCCGT | ACATTAT | AKGVAKFKCDSCEES |
| | | | | GACGGTCACGCAAAGCGATACGCTGGTGGGGTTTCAAAACAATACGGC | AGTGTGG | TTATTTA | FLTQRGLSMHELHRH |
| | | | | GCTGGTGCTAAAAAGCATTATGCCGCTAACGGCTGGATTGTCGATCGCC | GTGATTTT | TTTACTT | PAIRNLKRTQGTSRG |
| | | | | GCTGCGGGGGCTAGTGGCGCACCCAGAGAGGTGCGACGCGCAAGCAT | ATATCCAA | ATTGTTT | NTRPINRASVWSKEE |
| | | | | TGGTTCTGTGCGAAGCGGAGTTCTTGAGAGTAATGGTTGCTGGGGGCA | CCAATCAC | TAAAGA | TDLLIKLNERYKHLKQ |
| | | | | CAAAGCGCAACATATAGCCTCTTATGCCTCAAGTCGTAGTTCGTACCTCC | GTCAACTA | TGACGA | PNVALKEYFPDKTLK |
| | | | | ACGTGGTCCCGCTGGAATGCCTATCGACTCCTCCCCGGAGGATCATAGA | CGATCATT | AGCCGC | QISDKRRLLPVQEPE |
| | | | | GTTCGAAACCGGCTACGGCGAGGCAAGGGCGGTGAGGTGCACACCGA | TGTAATCA | AAGGCC | DVATTDETGPPPSDS |
| | | | | TGGGGAGCAGCGACCCCACCTACCCTTAGCTAAGAGAGCAGGCGATCC | CCGACGGT | AATCCA | SEESIYESATEDEGGG |
| | | | | GCCAACTGTCAGCACGAAATAAACTAATCATATGTATACGAGGGAGAAT | ACTTGGTA | AATTTAA | DMQQTAPNDSWKE |
| | | | | TTACAACGGGTACCTTGTGCCCGAACCGCCTGTAGGTATCACCTACAGG | GGGGTACC | CAAAAG | PFIQSIRTNHLEEEDSL |
| | | | | TGTTAAAATGAATCTGATAGCTGGCGGATCGTCGACCCTCTTTGATGGC | ACATGGGC | AACGAG | RKVEEAIERMAMNE |
| | | | | TCTGCGCCAACGACTGGAAAGAATAGGAACGGAAGTCTAATGGAAGGA | ATTCTTGC | ACTACT | GVTEQEVGTLLEQFV |
| | | | | AAGTGTCGGGAGCACTATAAATTCCCAAAGAAGAAAAGAAAAGAAAAA | TCATTCCA | GGTCGA | DSLTQSPTTERKGSR |
| | | | | AAATAAAAAACCCAAATTAAATGTCGAGTAACGAAGAAGGAGCCTCGG | CAACGCCG | CATTAA | RKSQKTTKRKTTHNN |
| | | | | ACACGGGGGCCCCCGGCCCTGGGGTCCCCGTGGCGGACGTGTCCGCTG | CCTCCATC | AAAGAC | RKKFLYAKHQELYKKS |
| | | | | CGGATGGAAGGGCCACTTATGACGACCATGGCATGTCCACGGACTACG | ATGGCAAC | GAAGCA | PRRLLELALSGESSSG |
| | | | | AGAAACAAACCATCGAACTGCCCCTGAACGGGCAGATACAATGCTTATG | AATTTAAA | GCTGCC | REVVNLPEADSVGPL |
| | | | | GTGCCACATTGAAGGAAGGAACCAAAGATTCCTCCAGGAAAGCCAATA | ATATATAT | AGCTGA | YKSLWGQIGPEKTHR |
| | | | | CTTAAAACACAAAGACACGCAACACCCTAAAGGCGAAATAATATGGAG | AAATTCTT | TAAACA | NQPMCNNIDMSEI |
| | | | | GTGCGCTGCATGCCAGAAAGAATTCGAGAAACTCCATGGCTGCAGGTG | AAGGTTTG | ACAGAG | WTPIALESLVEKFKKI |
| | | | | TCACTTACCCAAGTGTAAGGGACGCAAAGAAGCCAAGGGTGTTGCCAA | ACCGTATT | CCCGTCT | KSDTAAGADQIKKFH |
| | | | | ATTTAAATGCGACTCCTGCGAGGAATCGTTCCTAACGCAAAGAGGATTG | CATATATA | CGGCCT | LRKKGALHVFAKLCN |
| | | | | TCTATGCACGAGCTACATAGACATCCAGCGATTAGGAACTTGAAAAGAA | TATATATA | TTACACC | LLMLHRIYPAQWKT |
| | | | | CACAAGGCACCAGTCGGGGAAATACCAGACCAATCAACAGAGCCTCGG | TATTTAAT | GAGCGG | NRTTLIPKPGKSAEEV |
| | | | | TCTGGTCCAAAGAGGAAACGGACCTCTTGATAAAACTTAACGAGCGCTA | ATTACAAC | TGCAAG | ENWRPITIGSLLGRIY |
| | | | | CAAACACTTAAAACAGCCGAACGTAGCGCTCAAAGAATATTTCCCCGAC | CATAAATC | TCCTGAC | SAMIDRKLRSKIKQHI |
| | | | | AAGACACTAAAACAAATCAGCGACAAAAGAAGGCTCTTGCCCGTTCAG | TTATATCG | GTACTAT | RQKGFTQEDGCKNN |
| | | | | GAACCCGAAGACGTGGCCACAACTGATGAAACGGGACCTCCTCCTTCCG | AGCCTTCT | TGTACG | IAILSSALTKMKEDSG |
| | | | | ACTCATCGGAAGAGAGCATATACGAATCGGCCACGGAGGACGAAGGA | ATTTGGTC | TCTAGG | GIITIIDISKAFDTVPH |
| | | | | GGAGGAGATATGCAACAAACGGCTCCAAACGATAGCTGGAAGGAGCC | TCAAAAGC | GCGCGG | GEISQSLMNKGVPSP |
| | | | | GTTTATACAAAGTATAAGAACAAACCACCTCGAAGAGGAAGACTCCCTT | AATACGTT | GGCAGA | ICEYIQKMYIGCKTIIY |
| | | | | CGAAAGGTGGAAGAAGCCATCGAAAGAATGGCTATGAATGAAGGGGT | GTCAGATC | TTCTACC | CRDKKTLPVDILRGVK |
| | | | | AACTGAACAAGAGGTGGGCACCCTTCTTGAACAATTTGTCGACTCCCTA | TTGTAGAA | GTGTAG | QGDPLSPLLFNLIIDPI |
| | | | | ACTCAATCCCCAACAACGGAAAGAAAGGGGAGCCGACGTAAGAGTCAA | CATCAGGA | AATCTG | IGTLDETTEGIKLENE |
| | | | | AAGACTACAAAAAGAAAGACCACCCATAACAATAGAAAAAAGTTCTTAT | GTGAGCG | GGGCGA | NISVLAFADDLVLLAK |
| | | | | ATGCCAAACACCAGGAGCTCTATAAAAAGAGCCCACGAAGGCTTCTGG | GTGCGCTG | CGCCTCC | DKETADKQNRLINEY |
| | | | | AGTTGGCGTTATCGGGTGAGTCTAGCAGTGGCAGAGAAGTGGTTAATC | TGGTATCC | GCGAGG | LDDLKMKVSAEKCTT |
| | | | | TCCCTGAGGCCGACTCAGTGGGTCCACTATATAAAAGTCTATGGGGCCA | GTGCTTTG | CACTCCC | FEIKRQNKTWFLGDP |
| | | | | AATAGGCCCGGAAAAAACTCACAGAAACCAACCTATGTGCAACAATATC | TGCCGCGG | TGGACA | QLTLGQQRIPYADPE |
| | | | | GATATGAGCGAAATTTGGACTCCAATCGCCCTGGAGAGCCTTGTCGAAA | CGACAAAC | ACGTAC | AAIKYLGTNFNPWRG |
| | | | | AATTCAAAAAGATAAAGTCCGACACCGCAGCCGGCGCGGACCAGATAA | CAATACGC | GCTAAA | LCKTSIKEIIDAARTVK |
| | | | | AGAAATTCCACCTGAGAAAGAAAGGGGCACTACACGTATTCGCCAAACT | TGCTGCCT | GCGTAC | QLKLKPHQKINLIRTY |
| | | | | GTGTAACCTCCTCATGCTGCACCGAATATACCCAGCACAGTGGAAAACC | GTCGCAAA | GGCTAA | LLPRYIHKLVANPPPL |
| | | | | AACCGAACCACGCTTATTCCCAAACCGGGGAAGAGCGCGGAAGAGGTT | GCAATACG | GTGCGC | GTLDLIDKELKTIIKEIL |
| | | | | GAGAACTGGAGACCAATCACCATCGGGTCTCTGCTGGGAAGAATATATT | CTGCTGAT | CTCCCG | HLHPSTTDGLIYTDKS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
| --- | --- | --- | --- | --- | --- | --- | --- |
| | | | | CGGCTATGATCGACCGTAAATTACGGTCGAAAATAAAGCAGCACATAAG | TCTCGGAT | AAAGGG | HGGLGIQRVANIVKL |
| | | | | ACAGAAGGGGTTTACACAGGAGGATGGCTGTAAAAATAATATAGCCAT | GCGGGTG | TCCCCGT | AKLKHSILMTRSEDN |
| | | | | TCTCAGTAGTGCCTTAACCAAAATGAAAGAGGACTCAGGTGGAATCATA | TCGACGGT | TCCTAAT | AVKIALNGQEGMVK |
| | | | | ACCATAATAGACATTTCCAAAGCCTTCGACACGGTTCCCCACGGCGAAA | CACGCAAA | TTTTCCG | RYATSIGLQWPCGIE |
| | | | | TAAGCCAAAGTCTGATGAACAAAGGAGTCCCATCGCCCATATGCGAATA | GCGATACG | AGCCCG | EIEETRKKLKRADTNK |
| | | | | CATTCAAAAAATGTACATAGGTTGTAAAACTATTATATATTGCAGAGACA | CTGGTGG | CGGGCA | WKTLISQGQGIKEFF |
| | | | | AGAAAACACTGCCAGTGGACATACTGAGAGGAGTCAAACAGGGAGACC | GGTTTCAA | GATCTC | GDKTGNAWLYNPE |
| | | | | CGCTATCGCCACTGCTTTTCAACTTGATAATAGATCCCATAATAGGGACA | AACAATAC | GTGGCA | MLRPSRYLDALKLRT |
| | | | | CTGGACGAGACGACGGAGGGCATTAAATTAGAAAACGAGAACATTTCA | GGCGCTG | GTGACG | NTYGTKAALHRAKRD |
| | | | | GTTCTCGCCTTCGCCGACGACCTTGTCCTTTTGGCGAAAGACAAAGAAA | GTGCTAAA | CTAGAA | IDINCRRCGVQVETL |
| | | | | CAGCCGATAAGCAAAATCGGCTCATCAATGAATATCTGGACGACCTGAA | AAGCATTA | AGTTAA | GHILGLCTHTKNKRIK |
| | | | | AATGAAAGTATCCGCCGAAAAATGCACAACCTTCGAAATCAAACGGCAG | TGCCGCTA | GTCCGC | RHDEICDLIAKNVSKE |
| | | | | AACAAAACGTGGTTCCTAGGAGACCCACAGTTGACGTTGGGTCAGCAAC | ACGGCTGG | GGACAT | YVIFREPEVEVNGDR |
| | | | | GTATCCCGTATGCCGACCCAGAAGCAGCAATCAAATACCTAGGAACCAA | ATTGTCGA | ATAAAA | RKPDMVIKDHDKVY |
| | | | | CTTCAATCCATGGAGAGGGTTGTGCAAAACCTCGATAAAAGAAATCATC | TCGCCGCT | TTACAG | VVDVTVRYENNDSL |
| | | | | GATGCGGCTAGAACTGTCAAACAGCTGAAACTTAAGCCGCATCAAAAAA | GCGGGGG | CCTTAAA | NKAYKEKENKYKETA |
| | | | | TCAACCTTATAAGAACCTACCTCTTGCCAAGATACATACATAAATTGGTG | CTAGTGGC | TAATGA | EIMRRDLKAKESRVL |
| | | | | GCAAATCCTCCCCCTCTGGGGACTCTAGACCTAATCGATAAAGAGCTCA | GCACCCAG | ACCCCA | PVVIGSRGAVPRATIE |
| | | | | AAACTATAATAAAGGAAATATTGCACCTCCATCCGTCCACCACGGACGG | AGAGGTG | CGAAGG | NLKVLGLQTKHALTA |
| | | | | ACTAATATACACTGATAAGAGCCATGGCGGTCTAGGGATCCAGCGGGT | CGACGCGC | AGGTAT | SLIALRSSIEMANEFL |
| | | | | GGCGAACATAGTCAAGCTGGCCAAACTAAAACATAGTATACTAATGACA | AAGCATTG | CCTCGA | DYDHTT (SEQ ID |
| | | | | AGGTCAGAGGATAATGCCGTCAAGATAGCACTTAACGGGCAAGAGGGA | GTTCTGTG | AATTCC | NO: 1473) |
| | | | | ATGGTGAAAAGATACGCCACGTCCATAGGCCTACAATGGCCATGTGGA | CGAAGCG | GCCACG | |
| | | | | ATAGAAGAAATCGAGGAAACGCGTAAAAAACTCAAGAGGGCGGATAC | GAGTTCTT | ATCCTTC | |
| | | | | AAACAAATGGAAAACTTTAATTTCGCAAGGACAAGGCATAAAAGAATTT | GAGAGTA | TGATCG | |
| | | | | TTCGGGGATAAAACCGGGAATGCCTGGTTATACAACCCCGAAATGCTGA | ATGGTTGC | TAGGCG | |
| | | | | GACCGTCTCGATACCTGGACGCACTAAAACTGAGAACAAATACATATGG | TGGGGGC | CAAAAC | |
| | | | | CACAAAAGCAGCACTCCACAGAGCGAAAAGAGACATAGACATAAACTG | ACAAAGCG | A (SEQ | |
| | | | | TCGGAGATGCGGCGTCCAGGTGGAAACCCTAGGACATATATTGGGACT | CAACATAT | ID NO: | |
| | | | | ATGCACCCATACAAAGAACAAAAGAATAAAAAGACACGACGAAATCTG | AGCCTCTT | 1351) | |
| | | | | CGATCTTATCGCAAAGAATGTCTCTAAAGAATACGTGATATTTAGGGAA | ATGCCTCA | | |
| | | | | CCAGAAGTAGAGGTAAACGGTGACAGACGTAAACCAGATATGGTCATA | AGTCGTAG | | |
| | | | | AAAGACCATGACAAGGTATACGTCGTGGACGTCACCGTAAGATACGAA | TTCGTACC | | |
| | | | | AACAATGATTCCCTAAACAAGGCCTACAAAGAAAAAGAAAACAAATACA | TCCACGTG | | |
| | | | | AAGAGACAGCGGAAATTATGAGAAGAGACTTGAAAGCAAAAGAGAGC | GTCCCGCT | | |
| | | | | AGAGTTCTGCCAGTGGTTATCGGGAGCAGAGGGGCAGTGCCCCGAGCC | GGAATGCC | | |
| | | | | ACTATAGAAAATCTAAAAGTCCTAGGGCTTCAAACAAAACATGCCCTGA | TATCGACT | | |
| | | | | CGGCTTCGCTCATAGCCCTCCGATCGTCGATCGAAATGGCAAATGAATT | CCTCCCCG | | |
| | | | | CCTGGACTACGATCACACTACGTGATCGTTAAAAGTAAAAATCTATTTAT | GAGGATCA | | |
| | | | | TTATTTTTATTCCTATATTATAACACATTATTTATTTATTTACTTATTGTTTT | TAGAGTTC | | |
| | | | | AAAGATGACGAAGCCGCAAGGCCAATCCAAATTTAACAAAAGAACGAG | GAAACCG | | |
| | | | | ACTACTGGTCGACATTAAAAAGACGAAGCAGCTGCCAGCTGATAAACAA | GCTACGGC | | |
| | | | | CAGAGCCCGTCTCGGCCTTTACACCGAGCGGTGCAAGTCCTGACGTACT | GAGGCAA | | |
| | | | | ATTGTACGTCTAGGGCGCGGGGCAGATTCTACCGTGTAGAATCTGGGG | GGGCGGT | | |
| | | | | CGACGCCTCCGCGAGGCACTCCCTGGACAACGTACGCTAAAGCGTACG | GAGGTGC | | |
| | | | | GCTAAGTGCGCCTCCCGAAAGGGTCCCCGTTCCTAATTTTTCCGAGCCCG | ACACCGAT | | |
| | | | | CGGGCAGATCTCGTGGCAGTGACGCTAGAAAGTTAAGTCCGCGGACAT | GGGGAGC | | |
| | | | | ATAAAATTACAGCCTTAAATAATGAACCCCACGAAGGAGGTATCCTCGA | AGCGACCC | | |
| | | | | AATTCCGCCACGATCCTTCTGATCGTAGGCGCAAAACA (SEQ ID NO: | CACCTACC | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | 1105) | CTTAGCTA AGAGAGC AGGCGATC CGCCAACT GTCAGCAC GAAATAAA CTAATCAT ATGTATAC GAGGGAG AATTTACA ACGGGTAC CTTGTGCC CGAACCGC CTGTAGGT ATCACCTA CAGGTGTT AAAATGAA TCTGATAG CTGGCGGA TCGTCGAC CCTCTTTG ATGGCTCT GCGCCAAC GACTGGAA AGAATAG GAACGGA AGTCTAAT GGAAGGA AAGTGTCG GGAGCACT ATAAATTC CCAAAGAA GAAAAGA AAAGAAA AAAAATAA AAAACCCA AATTAA (SEQ ID NO: 1228) | | |
| R2 | R2B_NVi | — | *Nasonia vitripennis* | GACTAGACTATGGGTTCAGTCAGTCCCAAATAGCCGATCCTGGCGCGTC CGGCAGTAATGCCACGTATGAGTCGGTTACCCATCTCTAAACGCGTAGA GGTGGGGAGCTAAAGGCCAGGCGGTTTACCCGACGTCGAATTTCTCCA GGTCTGTGTCAGTCGACGGAATAAAGGTACTACAACATCTACTATCTAT CGGGATCGGAAGACGCCTTACAGCGTTTTCCGATTTTTGCTCTTTGAGCA TTTTTCTTCAAATTGCGATAACCGACCCGATCACGCGGGGCTTTGACAAA GCAATGCGTGGTCGGTAAGATGGTTGCAATCTTTTCCACCTCGTTTCTTT TACGGAACGAAAGCAATGCGTGTGGGGAACGTTAAAAACTCCCTTCATG CATCCCAGGATTTATCCTGCTTACTGCAAAGCAATGCGTGTGGAGCGAC | GACTAGAC TATGGGTT CAGTCAGT CCCAAATA GCCGATCC TGGCGCGT CCGGCAGT AATGCCAC GTATGAGT | TGACCT GAACAA AACGTG TTGTCTT GTCTTGT CTAAAA CTATTTA TTCGAA ATAAGG | TFAPTHPMVRSGPC RKTKRPGSDYRESLI MDSGNNVASEPRGA VDVTSAAPIGAELNA EPCEGRNQRREAALS AQTRRRNXARRARN AQQADEPGDDEEIET HGPLTIRTXEPMEIVA IAKNPQACPKCLQGG |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTTACCACGAGTCGCTCCACCGCAAAGCAATGCGTATCGCGCAAAAGCA | CGGTTACC | GGAGGC | TQLLCMGSWELSRHI |
| | | | | ATGCGTGTGGGGGACTTGTCAAAGATCCCCCGCCGCAAAGCAATGCGT | CATCTCTA | TAACTG | NKEHPSVDVTWVCG |
| | | | | GTCGGCACCACGTAGAGCAAAGCGTGTAGGCAGACTTTGTCAAAAGTA | AACGCGTA | CCTGCA | ACQRRCTTLRSWSC |
| | | | | GTTCTGCCGCAAAGCAATGCGTGTGGAGATCTTCGCCGGTGAAAGCAAT | GAGGTGG | AGTTGA | HVLHCKGRQEPKDLP |
| | | | | ACGTGTGGGCGAACTTAGACCTTCGCGCCCACACATCCCATGGTGAGGA | GGAGCTAA | ACGCGA | FKCEHCSLSFDSQIGL |
| | | | | GCGGCCCATGTCGAAAGACTAAGCGCCCCGGTAGTGACTACCGTGAAA | AGGCCAG | AAGTTA | SQHERHVHPEVRND |
| | | | | GTCTAATAATGGACAGCGGAAATAACGTTGCCTCGGAGCCGAGGGGAG | GCGGTTTA | GACCTTC | KRAAEANKPKGKSGR |
| | | | | CTGTGGATGTGACCTCAGCAGCTCCAATCGGGGCGGAGTTAAACGCCG | CCCGACGT | CCACCTA | RPSIWSDEDLLLIRELE |
| | | | | AACCTTGCGAAGGTCGCAACCAAAGGAGGGAGGCTGCCTTAAGTGCTC | CGAATTTC | AAGCCC | SEYHGARNINEKIAE |
| | | | | AAACACGCCGGCGAAATNCGGCCCGCCGAGCTCGGAATGCCCAACAGG | TCCAGGTC | AAAAGT | HFPDRTGRQVSDAR |
| | | | | CTGACGAGCCCGGCGATGATGAGGAAATAGAGACACACGGGCCTCTAA | TGTGTCAG | GATCGG | RRKDYAALRGRGGP |
| | | | | CTATCCGGACGNCGGAGCCGATGGAGATTGTCGCAATAGCGAAAAACC | TCGACGGA | GGAATG | QGPAEGVEAIEEVDE |
| | | | | CACAGGCCTGTCCCAAATGCCTGCAGGGAGGTACCCAACTTCTCTGCAT | ATAAAGGT | AATCCG | GEIPEGEELVATDGA |
| | | | | GGGCAGCTGGGAACTAAGCAGGCACATTAATAAAGAACATCCGTCAGT | ACTACAAC | CGGGTG | ALESGPPENGGSAPA |
| | | | | CGACGTGACCTGGGTGTGCGGTGCTTGTCAAAGGCGCTGCACAACGCT | ATCTACTA | ACCCCA | EQVNAPALESSSQQ |
| | | | | CAGGTCGTGGAGCTGTCATGTTCTNCACTGTAAGGGGCGACAAGAACC | TCTATCGG | GAGTTG | DRECSPAVGSDEQIE |
| | | | | AAAGGATCTGCCGTTCAAATGTGAGCATTGCAGCTTGTCGTTTGACTCG | GATCGGAA | GGTAAA | DSSDDDEFSDALGEIS |
| | | | | CAAATCGGACTCTCTCAGCACGAGAGGCATGTCCATCCAGAGGTGCGA | GACGCCTT | CCCTTGA | LPEPLSVERTTISPPPR |
| | | | | AACGATAAGCGCGCGGCAGAGGCCAATAAGCCAAAGGGCAAGAGTGG | ACAGCGTT | AACGTT | DDWKGPMRWEICN |
| | | | | CCGTAGGCCTTCTATATGGTCCGACGAAGACTTGCTGCTCATCCGGGAA | TTCCGATT | GGAGAA | ASEEAGSYANWVTG |
| | | | | TTAGAGAGCGAATACCACGGAGCTCGAAATATCAATGAAAAAATAGCT | TTTGCTCTT | GCGGAA | LQELVRNNALSEIGLD |
| | | | | GAACATTTCCCGGATAGAACAGGCAGACAGGTGTCGGACGCCCGGAGG | TGAGCATT | GAGAGT | SLYDQLIQIMRHPSD |
| | | | | CGTAAGGATTATGCCGCGCTCCGAGGGAGAGGAGGCCCGCAAGGCCCA | TTTCTTCA | CCCGCC | DNEQDRLQLNARGP |
| | | | | GCAGAAGGAGTCGAGGCCATCGAAGAGGTAGACGAAGGCGAAATCCC | AATTGCGA | ACCGAG | PRRGHRKNRRRRRLT |
| | | | | TGAGGGGGAAGAGCTGGTCGCCACCGATGGCGCTGCGTTGGAAAGCG | TAACCGAC | CATCGA | AADRKRFAFARCQDL |
| | | | | GCCCCCCGGAGAATGGAGGGAGCGCACCCGCAGAACAAGTCAATGCGC | CCGATCAC | GTGCTG | WNNNPKKLAELVIA |
| | | | | CCGCGCTGGAAAGCAGTTCTCAGCAAGATCGAGAGTGCAGCCCGGCAG | GCGGGGC | CGGCGC | NDLSILQRRQAPGRT |
| | | | | TGGGGTCCGATGAACAAATCGAGGACAGCAGTGACGACGACGAATTCA | TTTGACAA | CCGAAT | ETQTLYNELWGRVG |
| | | | | GCGACGCATTAGGAGAAATATCACTCCCAGAACCTCTCTCGGTTGAACG | AGCAATGC | GAAACC | PNIEAPRRTEDPIPVS |
| | | | | CACAACAATCTCACCACCTCCTCGAGATGACTGGAAAGGCCCAATGAGG | GTGGTCG | GATCGC | RIFTPITPQEIMGRIRR |
| | | | | TGGGAGATTTGCAATGCGAGCGAAGAAGCCGGAAGTTACGCGAACTGG | GTAAGATG | GGATGG | IKNDSAAGPDGVTKD |
| | | | | GTGACTGGACTGCAGGAGCTAGTCAGGAACAATGCGCTGAGTGAAATA | GTTGCAAT | TGCAAG | DLRGRGVSIALSKLFN |
| | | | | GGACTAGACTCCCTGTATGACCAGCTCATCCAGATTATGCGGCACCCTTC | CTTTTCCA | TCGTAG | SILLAGYYPKAWREN |
| | | | | CGATGACAACGAACAGGATCGCCTTCAATTGAACGCTAGAGGCCCCCCA | CCTCGTTT | GACGGG | RTTLLPKPEKDPADV |
| | | | | CGAAGGGGCCACCGCAAGAACCGACGGCGCCGTCGTCTCACGGCCGCT | CTTTTACG | GCACGA | KNWRPITISSMVSRV |
| | | | | GATCGAAAGCGGTTTGCCTTTGCCAGGTGCCAAGATCTTTGGAACAACA | GAACGAA | CCTAAG | YSGLLDQRVRAVIKQ |
| | | | | ACCCAAAGAAGCTAGCCGAGTTAGTGATTGCCAATGACCTGTCCATTCT | AGCAATGC | CCTCTGT | CDRQKGFTEENGCFS |
| | | | | CCAAAGGCGCCAAGCGCCAGGTAGAACGGAGACACAGACTCTGTACAA | GTGTGGG | CACGGC | NIQLLDDAVSNAKKA |
| | | | | CGAGCTGTGGGGGAGGGTCGGACCTAATATCGAAGCGCCAAGGCGCA | GAACGTTA | GGCGAA | GGVITILDVSKAFDTV |
| | | | | CCGAAGACCCGATACCCGTATCGAGGATCTTCACTCCGATCACTCCCCAA | AAAACTCC | GCCAGG | PHAVIQGCLEKKGIPE |
| | | | | GAGATAATGGGCAGAATCAGGCGAATCAAAAACGACTCGGCAGCGGGT | CTTCATGC | AATCAC | TVAAYISSMYRDCST |
| | | | | CCTGACGGGGTAACGAAGGACGACCTGAGAGGAAGAGGAGTCAGCAT | ATCCCAGG | CATGCA | AIRTRSGDVKIGMKR |
| | | | | AGCCCTCTCCAAGCTGTTCAACTCGATCCTGCTAGCGGGTTACTACCCAA | ATTTATCC | AAGGTG | GVKQGDPLSPLIFNL |
| | | | | AGGCATGGAGAGAGAACAGAACAACCCTTCTGCCGAAGCCAGAAAAAG | TGCTTACT | TGAACT | VLEPLLERLQETSGVE |
| | | | | ATCCTGCTGACGTTAAGAACTGGCGGCCCATTACCATCAGCTCAATGGT | GCAAAGCA | GGGGCG | IEGMNLSCAAFADDI |
| | | | | TAGTCGAGTCTACTCAGGCTTGCTTGACCAGCGAGTGAGGGCCGTCATT | ATGCGTGT | GATACC | VCFANTAPEAGRQLR |
| | | | | AAGCAGTGTGATCGGCAGAAAGGATTCACGGAGGAAAATGGCTGTTTC | GGAGCGA | TCCACG | MVADYLGRLDMSLS |
| | | | | AGCAACATACAGTTGTTGGATGACGCCGTATCGAACGCAAAGAAAGCG | CTTTACCA | GGGTTT | VSKCIAVEYVPHRKT |
| | | | | GGCGGTGTCATTACTATCTTGGATGTTTCGAAAGCATTCGACACTGTCCC | CGAGTCGC | CCCTGG | WYTKNPGLEVNGNA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCATGCCGTGATCCAAGGGTGCTTGGAGAAAAAAGGAATCCCCGAAAC | TCCACCGC | GCATCG | VPSISPSETFKYLGAK |
| | | | | CGTGGCCGCCTATATCTCGAGCATGTATCGCGACTGCTCCACTGCAATCC | AAAGCAAT | CGCGAG | VSPWKGLLEGFESDA |
| | | | | GAACGAGGAGCGGGGACGTAAAGATTGGAATGAAGAGAGGAGTCAAG | GCGTATCG | CGATGG | FREVISRVQRLPLKP |
| | | | | CAGGGGGATCCCCTGTCACCTCTCATTTTCAATCTGGTTCTCGAACCTCT | CGCAAAAG | CCAAAG | MQKVDLLQMYIFPR |
| | | | | ATTAGAACGATTGCAAGAGACAAGTGGAGTGGAAATCGAAGGCATGAA | CAATGCGT | TCCGCTT | YTYGLITSPPAKAVLK |
| | | | | TCTCTCGTGCGCGGCTTTCGCAGACGACATAGTATGTTTTGCGAATACA | GTGGGGG | TCTCAGC | TIDRIIRTRIKEILHLPE |
| | | | | GCCCCCGAGGCGGGAAGGCAGCTACGGATGGTGGCGGATTATCTGGG | ACTTGTCA | TACAAA | SVSSSFLYTPRKQGGL |
| | | | | CCGACTCGATATGAGTCTTTCAGTGTCAAAGTGTATAGCTGTAGAGTAT | AAGATCCC | ACAAAA | GLLEVEKMVLIAALR |
| | | | | GTCCCCCACAGGAAGACCTGGTACACTAAAAACCCAGGCCTCGAGGTG | CCGCCGCA | ATGGTA | NGLRARQSHDPVTR |
| | | | | AACGGTAATGCCGTTCCGAGCATCTCACCTAGTGAGACGTTCAAGTACC | AAGCAATG | TGAGAC | AAMNSNAADDRLKS |
| | | | | TCGGGGCAAAGGTCTCTCCCTGGAAGGGGCTGCTCGAAGGCTTCGAAT | CGTGTCGG | TTCGTTA | YADALRLHWPLTTKE |
| | | | | CTGACGCGTTCAGGGAAGTCATATCCCGCGTCCAAAGACTGCCGTTGAA | CACCACGT | ACACTA | LDTYKYQLRLSYAQK |
| | | | | GCCCATGCAAAAGGTGGACCTTCTACAGATGTATATCTTTCCGAGGTAC | AGAGCAA | ATTTTTC | WAEQKWQGQGVEE |
| | | | | ACCTATGGGTTGATAACATCGCCTCCGGCGAAGGCAGTCTTAAAGACTA | AGCGTGTA | CGAGCC | FAQDPVGNSWLQRY |
| | | | | TCGACCGGATCATAAGAACGAGAATCAAGGAGATCCTCCACCTGCCAGA | GGCAGACT | TAGCAG | DLLPASRYIDAIKLRT |
| | | | | ATCGGTAAGTAGCAGTTTTCTCTACACGCCGAGGAAGCAGGGTGGATT | TTGTCAAA | GCTCCCT | NTYPTRALMKIIDGR |
| | | | | GGGGCTCCTTGAAGTGGAGAAGATGGTGCTGATAGCCGCTCTTCGGAA | AGTAGTTC | TGACAA | VDSSCRKCQGSSETL |
| | | | | CGGCTTGAGAGCCCGTCAATCCCACGATCCGGTCACACGCGCGGCCATG | TGCCGCAA | CGCTTAT | GHILGRCRYTKDKRIS |
| | | | | AACTCGAACGCAGCCGACGATCGGCTAAAATCTTACGCCGATGCTCTAA | AGCAATGC | GAATCT | RHNEIKDLLKARLAK |
| | | | | GACTACACTGGCCACTAACAACCAAGGAGCTAGATACTTATAAGTATCA | GTGTGGA | GGAAAA | NHQVMDEPQITVRG |
| | | | | GCTTCGCCTGAGCTATGCCCAGAAATGGGCTGAGCAAAAATGGCAAGG | GATCTTCG | GGACAC | QRFKPDLVVKTNEGR |
| | | | | CCAGGGGGTCGAGGAGTTCGCACAAGATCCCGTCGGCAACTCATGGCT | CCGGTGAA | AAAGTG | VHVIDVTVRYEHRTY |
| | | | | GCAGCGCTATGATCTTCTGCCCGCGTCAAGGTACATCGATGCTATCAAG | AGCAATAC | GAAAAA | LDEGRTEKIGKYRQIL |
| | | | | CTACGAACAAACACGTACCCGACGCGAGCACTAATGAAGATCATAGATG | GTGTGGG | GCGCTG | STLRRDLHSNAEEVIP |
| | | | | GACGTGTTGATAGCTCTTGCCGAAAGTGCCAAGGCAGTAGCGAGACCC | CGAACTTA | ATGGTG | IVIGSRGAIPRETRKAL |
| | | | | TTGGTCATATACTTGGCAGATGCCGGTATACTAAGGATAAGCGAATAAG | G (SEQ ID | GACAAA | SKLGIGKSDWLTISLIA |
| | | | | CCGGCACAATGAAATCAAAGACCTCCTCAAGGCTCGTCTAGCCAAAAAC | NO: 1229) | AGTCAG | LRSSLEIVNAFMDD |
| | | | | CATCAGGTTATGGACGAGCCGCAGATAACGGTCCGAGGCCAGAGGTTT | | TTGAGA | (SEQ ID NO: 1474) |
| | | | | AAACCCGATCTCGTCGTGAAAACGAATGAGGGAAGGGTGCACGTAATC | | CTTGATA | |
| | | | | GACGTAACTGTCCGCTACGAGCACAGAACCTATCTGGATGAGGGCCGT | | TCAGTT | |
| | | | | ACTGAGAAAATTGGCAAATATCGCCAAATTCTCAGCACGCTTCGGCGAG | | GTTTGA | |
| | | | | ATCTGCACTCGAACGCCGAGGAGGTCATTCCAATTGTAATCGGGTCGAG | | CTAAGA | |
| | | | | AGGTGCAATTCCAAGGGAAACGCGGAAAGCCCTCTCGAAACTCGGAAT | | ATTTTAT | |
| | | | | TGGCAAGAGTGATTGGCTTACGATCTCACTAATAGCGCTGCGTAGCTCG | | TATCGTT | |
| | | | | CTAGAGATCGTCAACGCCTTCATGGATGACTGACCTGAACAAAACGTGT | | GACTTTT | |
| | | | | TGTCTTGTCTTGTCTAAAACTATTTATTCGAAATAAGGGGAGGCTAACTG | | AAATATT | |
| | | | | CCTGCAAGTTGAACGCGAAAGTTAGACCTTCCCACCTAAAGCCCAAAAG | | TTATTAT | |
| | | | | TGATCGGGGAATGAATCCGCGGGTGACCCCAGAGTTGGGTAAACCCTT | | TGACTG | |
| | | | | GAAACGTTGGAGAAGCGGAAGAGAGTCCCGCCACCGAGCATCGAGTGC | | TTAATAT | |
| | | | | TGCGGCGCCCGAATGAAACCGATCGCGGATGGTGCAAGTCGTAGGACG | | ACTGAC | |
| | | | | GGGCACGACCTAAGCCTCTGTCACGGCGGCGAAGCCAGGAATCACCAT | | TTGGGA | |
| | | | | GCAAAGGTGTGAACTGGGGCGGATACCTCCACGGGGTTTCCCTGGGCA | | CCAAGT | |
| | | | | TCGCGCGAGCGATGGCCAAAGTCCGCTTTCTCAGCTACAAAACAAAAAT | | CATCTCT | |
| | | | | GGTATGAGACTTCGTTAACACTAATTTTTCCGAGCCTAGCAGGCTCCCTT | | GTTACCC | |
| | | | | GACAACGCTTATGAATCTGGAAAAGGACACAAAGTGGAAAAAGCGCTG | | GGTACC | |
| | | | | ATGGTGGACAAAAGTCAGTTGAGACTTGATATCAGTTGTTTTGACTAAG | | GGTTCC | |
| | | | | AATTTTATTATCGTTGACTTTTAAATATTTTATTATTGACTGTTAATATACT | | TGTCATC | |
| | | | | GACTTGGGACCAAGTCATCTCTGTTACCCGGTACCGGTTCCTGTCATCAA | | AAACCG | |
| | | | | ACCGGAAAGTCCGTCCCACGTAATGTGGTAGACGCAGGAG (SEQ ID | | GAAAGT | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | NO: 1106) | | CCGTCCC<br>ACGTAA<br>TGTGGT<br>AGACGC<br>AGGAG<br>(SEQ ID<br>NO:<br>1352) | |
| R2 | R2Ci-B | AB097122 | *Ciona intestinalis* | CGACGGTGAACCACCTTGTCGCGGTGTAAGAGCTTTAGTGTCTCGAACA<br>AGAAATAGCTTGTGTGCTGTCCTTCTGGGCGGTGCACATACTTCTTAACC<br>TCCCGAGGCCATGCCGGCGGGGGCTTTAGCCCCCGGCAGGTTTTACCAT<br>GCCGGACGGGTTCGAGAGGTAGAGGCCAAACTAAGAGTTCACCAGCAG<br>ACTTCGCACGCGGCTGGCCACTGGCCGAAGTTTAAACAACAGGGCCGC<br>ATCTTCCCAAACTCAATATATGGTGTTAAGTGAACCGTGCCGATGGGTG<br>AATGGCCATGGGTAAGTTGGTCTCTAACGGTCCTTGTGGAGAAGTGGC<br>GACCCTTCACAATACTTCAGCCTTACCCTATGCCCGGGCAACTTAGGGTG<br>GACGTATATCTCCCGCGGAAAACATCTTATCTCATGGATAAAAATATATA<br>CGAAAACACTACTTCTCCAGGAGGGGGACCGCTTTGCGGTGAGAAGAC<br>GCATCGTTCCGATGTGATCATCCCTCCACCGGGGTTCGCCCCGTCGACG<br>GACACTGCTTCCAATACATTAGGGGAAAATGTGGATGCATCTGCAACCA<br>CTAGCAGTGCCAACCCATTAAGTCAGGAACCAGGATGGTGCGAATCTTG<br>TTCCAAGCTGTTCAAATCACAAAGAGGACTTAGAGTCCACCAAAGATCA<br>AAACATCCAGAGTTGTACCATTCTCAGAATCAACCGCTTCCGCGATCTAA<br>AGCACGATGGAGTGATGAGGAAATGGTTATCTTTGCTCGCGAAGAAAT<br>TGCAAATAGGAAGATCCGCTTTATCAATCAGCACTTACACAAAGTGTTTC<br>CACACAGAACGCTAGAGTCAATTAAAGGGTTGAGGGGAAAAAACGTAA<br>GATACGCTCGCATCATGGCTGACCTTGAGGCGGAAATGACCTCTCAGCC<br>CGAAGCAGCCACAAGCTTGTGCACCGAAACATCAGAAAATCTCGCTTCT<br>AGCAATGTTCTGCCCCAAACAAGAGGATGGGCTGAAAATCTCGTCGAAA<br>ATATTGACACAGCACATCTGGCAAACCTTGGGCCGTTATCCCAGTTTGA<br>ACCTGGTAAACCAAGCAGCAGTACAAAAGAGGCTATCAACACCGAGTA<br>CAACGACTGGATCAGCAAATGGCTTCCCTCTGGTGCTGCTCATAGAGAA<br>AGAAGAGCAAATCCACCCTCAACTAAGCTAAATGCTAGAGCAACAAGG<br>AGGCTACAATACAGTAGGATCCAGAATCTCTACAAATTAAATCGTTCTGC<br>CTGCGCCCAAGAAGTATTAAGCGGGGCTTGGAAGGTCCAGTCGGGCGA<br>ACTGAACTTGAAAGAGGTCCAACCGTTTTGGGAAAAAATGTTCCGGAAA<br>GAATCCGCCAAGGACAGGCGCAAGCCCAAGCCCACTGGTGAAGTACTC<br>TGGGGACTGATGGAGCCTCTAACAATTGCCGAGGTGGGATCCACTCTG<br>AAGTCAACGACACCATCAGCCCCAGGACCCGACAAGTTAACACTAGATG<br>GCGTAAAGAGGATACCCATTGCTGAACTAGTATCCCATTACAACCTATG<br>GTTGTACGCTGGCTACCAACCAGAGGGACTGCGCGAAGGAATAACCAC<br>CCTAATTCCGAAAATTAAGGGTACGCGTGACCCGGCTAAGCTACGCCCA<br>ATTACAGTGTCTAGCTTTATTTGCCGCATCTTCCACCGATGTTTGGCACA<br>ACGAATGGAAACCTCTCTTCCATTGGGCGAAAGACAGAAAGCTTTCCGC<br>AAGGTCGATGGCATCTGTCATAATATTTGGTCCCTAAGGTCTCTAATACA<br>CAATAGCAAAGACAACTTAAAAGAACTCAATATAACATTTTTGGACGTA<br>CGAAAAGCATTTGACTCCATCTCGCATAAATCACTGGGCATAGCTGCAG<br>CCCGCCTTGGACTTCCCCCACCCTTGATAACATACATCTCCAACCTTTACC | CGACGGTG<br>AACCACCT<br>TGTCGCGG<br>TGTAAGAG<br>CTTTAGTG<br>TCTCGAAC<br>AAGAAATA<br>GCTTGTGT<br>GCTGTCCT<br>TCTGGGCG<br>GTGCACAT<br>ACTTCTTA<br>ACCTCCCG<br>AGGCCATG<br>CCGGCGG<br>GGGCTTTA<br>GCCCCCGG<br>CAGGTTTT<br>ACCATGCC<br>GGACGGG<br>TTCGAGAG<br>GTAGAGG<br>CCAAACTA<br>AGAGTTCA<br>CCAGCAGA<br>CTTCGCAC<br>GCGGCTG<br>GCCACTGG<br>CCGAAGTT<br>TAAACAAC<br>AGGGCCG<br>CATCTTCC<br>CAAACTCA<br>ATATATGG<br>TGTTAAGT<br>GAACCGTG<br>CCG (SEQ<br>ID NO:<br>1230) | TGACAG<br>TAATAT<br>GAAAAC<br>ATCACAT<br>CTGACC<br>GGCACA<br>GAATCA<br>CCATGC<br>CGTAAT<br>GCACCC<br>AACTAA<br>GGATTC<br>CAATGG<br>GTAAAA<br>AAAAAA<br>AAAAAA<br>AAAAAA<br>AAAAAA<br>AAAAAA<br>AAAAAA<br>A (SEQ<br>ID NO:<br>1353) | MGEWPWVSWSLTV<br>LVEKWRPFTILQPYP<br>MPGQLRVDVYLPRK<br>TSYLMDKNIYENTTS<br>PGGGPLCGEKTHRSD<br>VIIPPPGFAPSTDTAS<br>NTLGENVDASATTSS<br>ANPLSQEPGWCESCS<br>KLFKSQRGLRVHQRS<br>KHPELYHSQNQPLPR<br>SKARWSDEEMVIFA<br>REEIANRKIRFINQHL<br>HKVFPHRTLESIKGLR<br>GKNVRYARIMADLE<br>AEMTSQPEAATSLCT<br>ETSENLASSNVLPQT<br>RGWAENLVENIDTA<br>HLANLGPLSQFEPGK<br>PSSSTKEAINTEYND<br>WISKWLPSGAAHRE<br>RRANPPSTKLNARAT<br>RRLQYSRIQNLYKLNR<br>SACAQEVLSGAWKV<br>QSGELNLKEVQPFW<br>EKMFRKESAKDRRKP<br>KPTGEVLWGLMEPL<br>TIAEVGSTLKSTTPSA<br>PGPDKLTLDGVKRIPI<br>AELVSHYNLWLYAGY<br>QPEGLREGITTLIPKIK<br>GTRDPAKLRPITVSSF<br>ICRIFHRCLAQRMETS<br>LPLGERQKAFRKVDG<br>ICHNIWSLRSLIHNSK<br>DNLKELNITFLDVRKA<br>FDSISHKSLGIAAARL<br>GLPPPLITYISNLYPNC<br>STKLKVNGKISKPIEV<br>RRGVRQGDPLSPLLF<br>NAVMDWALSELDPR |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAAACTGTTCTACCAAATTAAAAGTAAACGGAAAAATATCAAAACCAAT | | | VGVQIGEQRINHLAF |
| | | | | TGAAGTTCGTCGAGGAGTCCGACAAGGAGACCCACTCTCCCCGCTACTG | | | ADDIILVSSTKIGMVS |
| | | | | TTTAATGCAGTAATGGATTGGGCCCTATCTGAACTGGACCCAAGAGTGG | | | SINTLSRHLAKSGLEIS |
| | | | | GAGTACAAATTGGGGAACAACGAATAAACCATCTAGCATTCGCCGATGA | | | AGKEGKSASMAIVV |
| | | | | TATTATTTTGGTCTCTTCAACAAAGATCGGAATGGTGTCCTCCATCAATA | | | DGKKKMWTVDPLPR |
| | | | | CGTTGAGTCGCCATCTGGCAAAATCAGGCCTCGAAATTAGCGCTGGGAA | | | FKVNSQKIPALSITQQ |
| | | | | AGAAGGAAAATCAGCTAGTATGGCCATCGTTGTTGATGGAAAGAAAAA | | | YKYLGINIDAQGARN |
| | | | | GATGTGGACAGTAGATCCCCTTCCTAGGTTCAAAGTAAACAGCCAGAAA | | | DAARILTEGLAELSRA |
| | | | | ATTCCGGCACTGAGTATTACACAACAGTATAAGTATCTGGGGATAAACA | | | PLKPQQRLYLLRVHLL |
| | | | | TAGATGCCCAAGGGGCAAGAAATGATGCAGCTCGAATCCTTACAGAGG | | | PKLQHGLVLSSCAKR |
| | | | | GTCTAGCAGAATTATCTCGTGCCCCACTGAAGCCACAACAGCGACTATA | | | ALTYLDKSVRSAIRR |
| | | | | TCTGCTTCGGGTGCATCTTCTTCCGAAACTGCAACACGGACTGGTTTTAA | | | WLTLPKDTPTAFYHA |
| | | | | GTAGTTGTGCAAAAAGAGCGCTAACATACCTGGACAAAAGTGTAAGGT | | | KACDGGLGITRLEHTI |
| | | | | CTGCAATAAGAAGATGGCTTACACTTCCGAAGGACACACCAACAGCCTT | | | PILKRNRMMKLTLSE |
| | | | | TTACCATGCGAAAGCATGTGACGGTGGACTAGGCATTACACGTTTGGAA | | | DPVIMELVKLTYFTNL |
| | | | | CACACAATACCAATACTCAAAAGAAATAGAATGATGAAGTTGACATTGT | | | LHKYSNVKLLNSWPV |
| | | | | CAGAGGATCCAGTGATCATGGAACTTGTAAAATTGACATACTTTACAAA | | | TDKDSLARAEASMLH |
| | | | | TTTACTACACAAATACTCAAATGTGAAGCTGCTTAACTCCTGGCCAGTAA | | | TSVDGRGLSNCSDVP |
| | | | | CAGACAAAGACAGTCTGGCCCGTGCCGAAGCCTCCATGCTTCACACCTC | | | RQSDWVTNGASLLS |
| | | | | TGTGGATGGGCGTGGACTAAGCAATTGCAGTGATGTCCCGCGCCAAAG | | | GRDFIGAIKVRGNLLP |
| | | | | TGACTGGGTCACAAATGGCGCGTCGCTACTTAGTGGTCGTGACTTTATT | | | TKVSAARGRQREITC |
| | | | | GGAGCAATAAAAGTGAGGGGCAACCTCTTGCCAACAAAGGTTAGTGCG | | | DCCRRPESLGHILQTC |
| | | | | GCACGTGGACGGCAACGGGAGATAACATGCGACTGCTGCAGACGACCG | | | PRTWGPRISRHDSLL |
| | | | | GAGTCACTGGGCCACATCCTGCAGACCTGCCCTAGAACATGGGGACCG | | | KRVRNQACLKNWTP |
| | | | | AGAATCTCCAGGCATGACTCCCTGTTGAAGCGAGTTCGGAATCAGGCAT | | | IIEPSIPTNIGLRRPDL |
| | | | | GCTTAAAAAACTGGACCCCGATAATAGAGCCATCGATACCAACCAACAT | | | VLAKGNIAFLVDATV |
| | | | | AGGACTTCGTCGGCCAGACCTCGTTTTGGCCAAAGGTAACATCGCCTTT | | | VADNANMQLQHEA |
| | | | | CTTGTAGATGCCACCGTGGTTGCAGACAATGCCAACATGCAGTTGCAAC | | | KVEKYNNSDIKEWIK |
| | | | | ACGAAGCAAAAGTGGAAAAGTACAACAACTCAGATATAAAGGAATGGA | | | VHCPGVDEVRVTSLT |
| | | | | TAAAAGTACACTGCCCAGGGGTTGATGAAGTGAGGGTAACGTCACTAA | | | ANWRGCLYGGSASF |
| | | | | CTGCGAACTGGCGCGGTTGCTTGTATGGAGGTTCAGCATCCTTCCTAAC | | | LTEDLGLPKAELSLLS |
| | | | | AGAAGACCTGGGACTGCCTAAAGCAGAGTTAAGTCTGCTCAGTGCAAA | | | AKINEKGYYLWCAHY |
| | | | | GATCAATGAAAAAGGATACTACCTTTGGTGTGCTCACTACAGGGGAACA | | | RGTARLWNRPLRS |
| | | | | GCAAGGTTGTGGAATCGACCGTTAAGGTCCTGACAGTAATATGAAAACA | | | (SEQ ID NO: 1475) |
| | | | | TCACATCTGACCGGCACAGAATCACCATGCCGTAATGCACCCAACTAAG | | | |
| | | | | GATTCCAATGGGTAAAAAAAAAAAAAAAAAAAAAAAAAAAAAAAAAAAA | | | |
| | | | | AAAAAA (SEQ ID NO: 1107) | | | |
| R2 | R2C_NGi | — | *Nasonia* | CGGGTTCCCCCGACTTCGGCTTGCCGTGGTCTGGGGCTCACTGCTTTTTG | CGGGTTCC | TAGCGG | WVTSPRRPRYVGPQ |
| | | | *giraulti* | TGGAGTCATGGTTACATGGTGACCCTGGTTCCTCGCACCCCCGCTGGAA | CCCGACTT | ACTGGA | KKKASDGNDGRAAA |
| | | | | ACTATCTGGGGAGGCCATGATTGGGTAACGATAAAGGTCCTGGTCGTG | CGGCTTGC | CTGTCT | RAEPTNPGGPDRAD |
| | | | | TCCTCCTGAGATAGGCTGAATGGGTCACTAAGTGGCACCTAATGGGTTA | CGTGGTCT | GGAGGA | DDEGDVKFWCEFPG |
| | | | | CCAGCCCTAGGCGGCCGAGATACGTTGGTCCACAGAAAAAGAAAGCCT | GGGGCTCA | GTGTTTA | CDRFFMTRSGRGLH |
| | | | | CGGATGGAAATGACGGACGAGCCGCTGCTCGTGCCGAACCAACGAATC | CTGCTTTTT | ACTCGG | HKKGHPDWNDQRN |
| | | | | CGGGCGGACCAGACCGCGCTGACGACGACGAAGGGGATGTTAAATTCT | GTGGAGTC | GTTCTCA | LAGKQHRKEIWSEEE |
| | | | | GGTGTGAATTTCCAGGTTGTGATCGCTTCTTTATGACCAGGAGCGGTAG | ATGGTTAC | TGGGAA | RLLLAKKEAELAISGA |
| | | | | AGGCCTCCATCACAAGAAAGGCCACCCTGATTGGAATGATCAGAGAAA | ATGGTGAC | CCCGAC | RFINVELRDFTARSLD |
| | | | | CCTGGCCGGAAAGCAACACCGAAAAGAGATATGGTCGGAGGAAGAAC | CCTGGTTC | AACGTT | AIKGQRKRPDYKILVE |
| | | | | GTCTCCTGCTTGCCAAAAAAGAGGCGGAGCTTGCCATCAGTGGAGCTA | CTCGCACC | GTTATCT | KFVRELRVRGIRQGV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGTTTATTAACGTAGAGTTGCGTGATTTTACAGCGCGCTCCCTAGACGCT | CCCGCTGG | TGTATG | ASRSQQARAMAVA |
| | | | | ATCAAGGGCCAGCGAAAGAGACCCGACTATAAGATCTTAGTCGAGAAA | AAACTATC | ACAATTC | GAPAATSSGAPPVAT |
| | | | | TTTGTCAGGGAGTTAAGGGTTAGAGGCATTCGTCAAGGAGTGGCCTCG | TGGGGAG | ATAAAA | QPPPSGRVLRSQVVE |
| | | | | CGGAGTCAACAAGCTCGCGCGATGGCGGTGGCAGGAGCTCCTGCAGCG | GCCATGAT | AAAAAA | APAMEIPVAESEGDS |
| | | | | ACGTCCTCGGGGGCACCACCTGTCGCGACTCAACCACCACCATCAGGTC | TGGGTAAC | AAAAAA | SGDELFEDVEPVRLS |
| | | | | GCGTACTAAGATCTCAGGTCGTTGAAGCACCAGCGATGGAGATCCCCGT | GATAAAG | AAAAAA | DLPPDRFTIYFAGLEIP |
| | | | | GGCAGAGTCGGAAGGTGACTCCTCGGGGGACGAGCTGTTTGAGGATGT | GTCCTGGT | AAAAAA | GTEDIYAHRLHTICL |
| | | | | CGAGCCCGTGCGATTGTCCGACCTACCCCCTGACAGGTTTACGATATACT | CGTGTCCT | (SEQ ID | MTTWRTKEEVRLEL |
| | | | | TTGCTGGGCTTGAAATACCCGGCACCGAAGATATATATGCCCACAGGCT | CCTGAGAT | NO: | GLFLKDLFPSKGSQER |
| | | | | CCATACCATCTGCCTGATGACAACGTGGCGAACCAAAGAAGAGGTAAG | AGGCTGAA | 1354) | PERTNLPDPRNRIER |
| | | | | ATTAGAACTTGGCCTCTTTTTGAAAGATTTGTTCCCGAGTAAGGGCAGTC | TGGGTCAC | | RRGEYKKCQDLWRR |
| | | | | AAGAACGCCCGGAGAGAACCAACCTGCCGGACCCGAGAAATCGGATCG | TAAGTGGC | | NKSTCVQRILKEDLSQ |
| | | | | AGAGGCGGAGGGGGGAGTACAAAAAATGCCAGGATCTATGGCGACGA | ACCTAA | | GECLPRELMEPFWN |
| | | | | AATAAGTCAACCTGTGTTCAGCGGATCCTTAAAGAGGATCTTTCGCAGG | (SEQ ID | | ATFTQNPGTAPVLPP |
| | | | | GTGAATGTTTGCCTCGAGAGCTGATGGAGCCCTTTTGGAATGCGACTTT | NO: 1231) | | PTEVYSSVWEPIRPE |
| | | | | CACCCAGAATCCTGGCACGGCTCCGGTGCTCCCTCCTCCCACGGAGGTT | | | NIKGNYPPQNTAAGI |
| | | | | TATTCTAGTGTTTGGGAGCCCATTCGGCCCGAGAATATCAAGGGCAACT | | | DGLTVGDLKGVSRE |
| | | | | ATCCGCCGCAGAACACCGCGGCAGGGATAGACGGACTGACAGTGGGT | | | MLARIFNLFMWCGK |
| | | | | GACCTGAAAGGGGTGTCGCGGGAGATGCTGGCCAGAATTTTTAACTTAT | | | LPEHLCASRTILLPKKP |
| | | | | TCATGTGGTGCGGCAAACTGCCAGAGCACCTTTGTGCCTCACGCACAAT | | | GAKVPGEFRPITVTSV |
| | | | | TCTCCTGCCCAAGAAACCTGGGGCGAAAGTCCCCGGCGAATTCAGGCCT | | | LIRTFHKVLAERLKVV |
| | | | | ATCACCGTGACATCCGTCCTCATCCGGACCTTTCACAAGGTTCTGGCCGA | | | PLDPRQRGFRESDGC |
| | | | | AAGACTGAAGGTTGTCCCTCTTGACCCCCGCCAAAGAGGCTTCAGAGAG | | | AENVMLLDMTIRYH |
| | | | | TCCGATGGATGTGCAGAGAACGTGATGCTACTGGACATGACCATCCGGT | | | HERRRKMFLALLDM |
| | | | | ACCACCACGAGCGGCGCAGAAAGATGTTCTTGGCCCTGCTAGACATGG | | | AKAFDSVSFESMREV |
| | | | | CTAAGGCATTTGACTCGGTCTCTTTCGAGTCCATGCGGGAGGTTTTGACT | | | LTTKGIPTPFIEYFMT |
| | | | | ACTAAAGGCATACCAACGCCATTTATTGAGTATTTTATGACGCACTTGGA | | | HLEDSFTVLQHGNW |
| | | | | GGATAGTTTTACTGTTCTTCAGCATGGTAACTGGCAATCGGGGAAAATC | | | QSGKIHPTCGVKQG |
| | | | | CACCCAACATGTGGTGTGAAGCAAGGCGATCCACTGTCTCCGCCTATCT | | | DPLSPPIFNFIMDEM |
| | | | | TCAACTTCATCATGGATGAAATGTTGAAGAGGTTGCCTAAGGAAATCGG | | | LKRLPKEIGVNLDGLF |
| | | | | GGTTAACTTGGACGGGTTATTTGTTAATGCTATGGCATTTGCGGATGAC | | | VNAMAFADDLSLVA |
| | | | | CTGAGCCTTGTTGCCAATACCGAACAAGGTCTGCAGATCCTCATAGATG | | | NTEQGLQILIDEATSF |
| | | | | AAGCTACTTCCTTTCTGGGGCTCTGTGGACTCCGCGCCAATCCCAATAAG | | | LGLCGLRANPNKCVT |
| | | | | TGCGTCACCCTAGCAATTAAGACCATCCCGAAGGAGAAAAAGACGGCC | | | LAIKTIPKEKKTAIDPS |
| | | | | ATTGACCCCTCATCACATTTAGGATAGGTAATGCGGTGATCCCCTCGTT | | | SHFRIGNAVIPSLKRT |
| | | | | GAAGAGGACAGATGAGTGGGTGTACTTAGGGATCAAATTTAATTCAAA | | | DEWVYLGIKFNSNGR |
| | | | | TGGTCGCCTTATCTCTGACGCAAAACCCAAGCTCATAAAAGATCTTGAG | | | LISDAKPKLIKDLELLT |
| | | | | CTACTAACTAAGGCACCACTCAAACCACAGCAAAGACTGTGGGCGCTTA | | | KAPLKPQQRLWALK |
| | | | | AGGTGATTGTCATTCCGGGCATCCTTTACAGAGGTACCCTGGGGAGCAG | | | VIVIPGILYRGTLGSST |
| | | | | CACCGCAGGCTACCTACGCTCTCTTGACTGTGTAATAAGGGCCTATGTTC | | | AGYLRSLDCVIRAYVR |
| | | | | GGCGATGGCTACGTCTCCCTGGAGATTGCCCGAATGGGTATTTTCATGC | | | RWLRLPGDCPNGYF |
| | | | | AGCGGTTGCGGATGGAGGGCTGGGAGTTCACCCCATACGATACAAGGC | | | HAAVADGGLGVHPI |
| | | | | GATGGTAGATCGCCTTGCCCGGCTCCGAAAATTAGAGAAATCCGCGTAC | | | RYKAMVDRLARLRKL |
| | | | | ATCACGGGGCCTGAAGCCGCACGTTATCTTCAAAGACAAGTTTCTATCG | | | EKSAYITGPEAARYLQ |
| | | | | CCGAAAATAGGCTCCGAGATGGGGCCAACCGCATTATGAGTGATGCGA | | | RQVSIAENRLRDGAN |
| | | | | GTATGCTAAGGGAGTTCCTTCGGGAGCTTCTGTACAAGTCCTTTGATGG | | | RIMSDASMLREFLRE |
| | | | | TCGTCCCCTGGAAAATTCCAGCAAAGTACCAGGTCAGCACCGCTGGGTC | | | LLYKSFDGRPLENSSK |
| | | | | GAGGAGCCAACCCGTTTCCTATCCGGGGCGGACTATATGAATTGTATAC | | | VPGQHRWVEEPTRF |
| | | | | GTGCGAGGATCGCAGCTCTTCCGACTGCAGCCAGGTGTGCTAGGGGAC | | | LSGADYMNCIRARIA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTCTCAAAGACAAGCATTGCCGGGCAGGTTGCGGAAATGTGGAGACGC | | | ALPTAARCARGRLKD |
| | | | | TTAACCACGTCTTGCAATTCTGCCACCGTACCCATGGCACTCGCATTGGA | | | KHCRAGCGNVETLN |
| | | | | CGCCATGATGCGGTTGTAAAGTATGTTGTAGGAGGACTCAAGAAGAGG | | | HVLQFCHRTHGTRIG |
| | | | | GGGTACGCAGTGAAAGAAGAGCCGAAAATCGTCTTACAGGATGTGGTG | | | RHDAVVKYVVGGLK |
| | | | | TACAAACCTGATATGGTTGCGACCAAGGAAGGGAAAACACTCATTCTGG | | | KRGYAVKEEPKIVLQ |
| | | | | ACGCTCAGGTTCTAGGCGACCAGCGTGATATGAGACTGGCACATGAAG | | | DVVYKPDMVATKEG |
| | | | | ATAAGCTCCGTAAGTATGGGGCCCCAGAATTTAAACGAAAGATCAGGA | | | KTLILDAQVLGDQRD |
| | | | | GTGAGACGGGGTCGGCAACCATTAAGTCCTTGTCGGTTACATTGAGCTG | | | MRLAHEDKLRKYGA |
| | | | | GCGAGGGTTGTGGGGACCTGACTCAGTAAAGGGGCTCCTCGAAGAGG | | | PEFKRKIRSETGSATIK |
| | | | | GAGTGATTCTAAAGAAGGACCTTAAGATCTTGTCCACAAGAGTACTTAT | | | SLSVTLSWRGLWGP |
| | | | | AGGAGCTTTGGCAGGCTGGAGAAGGTTTAATGAAAGGACGAGTATGGC | | | DSVKGLLEEGVILKKD |
| | | | | AACATCTGGAAGAAGAGAAGAGGTTACAACAAGGATGGTGAGAAGGT | | | LKILSTRVLIGALAGW |
| | | | | GGAAGAGAAGAGAGAGGGTCGGTGTTGGTTAGCGGACTGGACTGTCT | | | RRFNERTSMATSGRR |
| | | | | GGAGGAGTGTTTAACTCGGGTTCTCATGGGAACCCGACAACGTTGTTAT | | | EEVTTRMVRRWKRR |
| | | | | CTTGTATGACAATTCATAAAAAAAAAAAAAAAAAAAAAAAAAAAA (SEQ | | | ERVGVG (SEQ ID |
| | | | | ID NO: 1108) | | | NO: 1476) |
| R2 | R2La | JN937617 | *Lepidurus* | GGGGTAGCAATTGATCGATTCCCGCTTCCTCGTGGCGCTACCCTGGGTA | GGGGTAG | TGATAA | MSGKSSKPRTVSSGS |
| | | | *arcticus* | ATACTATGAGGAATTGATCACACCGTAGCGAACGTCATCAGTCACAGCT | CAATTGAT | TCGCTCC | SSQETPPSGSNACDI |
| | | | | GCACGAATCCAGATAGAAATATAACAGACGAGTAATTCTTTTAAAAGCT | CGATTCCC | ATCCTGC | CGKCFMKPVGLSRV |
| | | | | CGTCAGTAATCTTCCCAGATGTCTGGAAAGAGCAGCAAACCGAGAACTG | GCTTCCTC | AACTAA | HPSQYHARLEKNQPK |
| | | | | TATCCAGTGGATCCAGTTCCCAAGAGACTCCTCCAAGTGGGTCCAACGC | GTGGCGCT | TTATGA | AKKFRWTDEDLYFLA |
| | | | | ATGTGATATATGCGGGAAATGCTTCATGAAACCGGTCGGTTTGTCCAGA | ACCCTGGG | ATGCAA | KKEAELLHLGSIKFVN |
| | | | | GTCCATCCTAGTCAATATCATGCACGCTTAGAAAAGAACCAACCTAAAG | TAATACTA | ATCTGTT | KELAEFFPEKSVDQIR |
| | | | | CGAAGAAGTTCAGATGGACTGATGAGGATTTGTATTTTTTAGCGAAAAA | TGAGGAAT | AAGTGA | GQRRSETYKQQVLSI |
| | | | | AGAAGCGGAACTTTTACACTTGGGCAGCATTAAATTTGTGAATAAAGAA | TGATCACA | CATTAGT | HSELLKLQTVADSPPP |
| | | | | CTGGCAGAATTCTTTCCGGAGAAATCTGTCGACCAAATCAGAGGCCAAA | CCGTAGCG | GATACTT | SRIPAKEVSAWLDFFL |
| | | | | GACGTTCTGAGACGTACAAACAGCAAGTTTTATCTATCCATTCTGAACTG | AACGTCAT | ACCTGA | ALPKTKNKFSEDKLD |
| | | | | CTCAAGTTGCAGACTGTAGCCGATTCTCCTCCCCCATCGAGAATCCCGGC | CAGTCACA | TACTTAC | QLIRTAQDGTLILDDL |
| | | | | GAAAGAAGTCTCCGCTTGGCTTGACTTTTTTCTGGCCCTTCCCAAAACCA | GCTGCACG | CCTGGT | DLYLREVLVQPTSQG |
| | | | | AGAATAAATTTAGTGAAGACAAGTTAGACCAACTCATCCGTACCGCTCA | AATCCAGA | ATTTATT | EKQAKLLPPPKSSREK |
| | | | | AGATGGTACTCTCATCCTGGATGATCTAGATTTATATCTTAGAGAAGTTC | TAGAAATA | TGACCT | RDREYARAQNLYRK |
| | | | | TAGTTCAACCCACTAGTCAGGGAGAGAAACAAGCGAAGTTGCTCCCACC | TAACAGAC | ATACTTA | NKTACVNAILDGNKK |
| | | | | CCCCAAATCCAGTAGAGAGAAAAGAGACCGCGAATATGCCCGTGCCCA | GAGTAATT | CCCTGG | CENKIPDIDDFWKTIF |
| | | | | GAATTTATATCGGAAGAATAAGACCGCTTGTGTGAACGCCATCCTTGAT | CTTTTAAA | TATCTAC | ESHSPPDAEPVCYVV |
| | | | | GGTAACAAGAAGTGCGAAAATAAAATACCTGACATTGACGATTTCTGGA | AGCTCGTC | CTGACA | DEEPTNIWSWISFFE |
| | | | | AGACCATATTTGAGTCCCATTCTCCCCCAGATGCAGAACCGGTGTGTTAT | AGTAATCT | TATATTT | MNHNYPDSSTSPGP |
| | | | | GTCGTTGACGAGGAGCCGACAAATATTTGGAGTTGGATTTCATTTTTTG | TCCCAG | ATCTAAC | DGVTARMLRSIPARV |
| | | | | AGATGAATCATAACTACCCCGATTCGTCTACCTCACCCGGTCCTGATGGC | (SEQ ID | CACCTAC | LNKLLNLLLFIEDLPAV |
| | | | | GTGACTGCTCGCATGCTCCGTTCCATCCCAGCACGTGTCCTAAATAAATT | NO: 1232) | CTATGAT | FKCHRTVLIPKIDNPT |
| | | | | GTTAAACCTTTTACTCTTTATTGAAGACTTACCTGCAGTGTTCAAGTGCC | | GACTCC | SPGEFRPITISSIVVRQ |
| | | | | ATCGTACCGTGTTGATACCGAAAATCGACAATCCGACATCACCAGGCGA | | CGCGGA | LNKIIAARVSEGVPIN |
| | | | | ATTTCGTCCCATCACGATTTCCTCCATAGTTGTTCGGCAGCTGAACAAAA | | AACTCTC | PRQKAFRQIDGCAEN |
| | | | | TCATCGCTGCTCGCGTCTCAGAGGGCGTTCCCATAAATCCTCGCCAGAA | | ACTTACC | VFLLDFILRDAKTKIKS |
| | | | | GGCCTTCCGGCAAATTGATGGATGCGCTGAGAATGTTTTCCTTTTGGATT | | TTATTAC | LSLATVDIKKAFDSVS |
| | | | | TCATTCTTCGTGACGCAAAAACGAAAATTAAGTCCCTTTCGTTGGCTACT | | CCACTTG | HHSIFRAIRGARCPEN |
| | | | | GTCGACATTAAGAAAGCATTTGATAGTGTGTCACATCATTCCATCTTCCG | | GTCTTTT | LVNYIQNSYSGCTTQI |
| | | | | AGCGATTAGAGGAGCGAGATGCCCTGAGAATCTAGTGAATTATATCCA | | ATTTTCT | SVGGSISASKIPMNR |
| | | | | GAACAGCTACTCGGGTTGTACGACCCAAATTTCTGTTGGCGGCTCTATAT | | CGTTCCT | GVKQGDPLSPVLFNL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAGCATCAAAAATCCCGATGAACCGTGGTGTCAAACAAGGGGACCCACT | | TATTACT | VINEIIRKLPASIGYPIN |
| | | | | ATCTCCTGTCCTCTTTAATTTAGTGATAAACGAAATTATTCGCAAACTGCC | | TTGTTCC | SELSINCIAYADDLILV |
| | | | | GGCCTCGATTGGATACCCAATCAATAGTGAGCTTTCGATAAACTGTATT | | TTTGGT | TNTREGLKLLLGLLNE |
| | | | | GCTTATGCGGATGACCTGATACTAGTTACAAATACTAGAGAGGGCCTGA | | GTAGGG | ELPKRGLELNASKCFG |
| | | | | AGCTACTACTCGGCCTATTGAATGAAGAGCTCCCTAAGCGAGGATTAGA | | TTCTCTG | LSLTALGKLKKTHLCT |
| | | | | ATTGAATGCATCTAAGTGTTTCGGCTTATCCTTAACAGCACTCGGGAAAT | | GTTTTTG | SDQLDLHGTLIKNLTA |
| | | | | TGAAGAAGACTCACCTGTGTACCAGTGACCAACTCGATTTACATGGGAC | | GAACGG | EESWVYLGVPFSHIG |
| | | | | TCTAATTAAGAATCTTACCGCTGAGGAATCCTGGGTTTATTTGGGTGTTC | | CTTCCTT | RSKSFSPDLEALLNKL |
| | | | | CTTTCTCACACATTGGGCGCTCTAAGAGCTTCAGTCCAGATCTTGAAGCT | | AGCCGG | QKSPLKLQQKLFALR |
| | | | | CTTTTAAATAAACTCCAGAAATCGCCGCTTAAACTGCAACAAAAGCTTTT | | AATTTTG | VYLIPRLLHGLVLSRV |
| | | | | TGCTTTGCGAGTTTATCTAATTCCTAGACTGCTCCACGGTTTAGTCCTATC | | TCTGAT | AIGELKIMDKLILKHL |
| | | | | AAGAGTGGCCATTGGCGAATTAAAAATAATGGATAAGTTAATTTTGAAA | | GTATCTT | RVWLRLPKDTPLGFF |
| | | | | CACTTACGCGTATGGCTTCGTTTACCGAAAGATACCCCTTTGGGATTTTT | | GCTTGT | YSPVKLGGLGIKNLRT |
| | | | | CTACTCACCGGTGAAATTGGGCGGTTTGGGGATTAAAAACTTACGTACA | | GTCCTT | NVLKCRKQRIERMLV |
| | | | | AACGTTTTGAAGTGCAGGAAACAACGCATTGAGCGAATGCTAGTCTCCC | | GAAATA | SPDDVVRLVAESEIFL |
| | | | | CTGATGATGTGGTGCGCTTGGTTGCAGAGTCGGAGATTTTCCTGAAAGA | | TACGAC | KETDKLKDLLTINGM |
| | | | | GACGGACAAGTTAAAGGACCTACTTACTATTAACGGAATGTGCCTAGAT | | CCAGGC | CLDXRNVPRTGKNN |
| | | | | TANCGGAATGTGCCTAGAACGGGAAAAAATAACAAGTTTTGGAGTGAA | | TTGCGT | KFWSERLYTSFDGKT |
| | | | | AGGCTATATACGTCATTTGATGGTAAAACACTTGCCTATAGCGAGTACTT | | CATTTAG | LAYSEYFTQGGGWIR |
| | | | | TACTCAAGGCGGCGGCTGGATCCGTGAAGATAAGATCCTTCAACCTGCC | | GCTCTG | EDKILQPAHVFAECIK |
| | | | | CATGTTTTCGCTGAATGCATCAAGTTACGTATTAATGCTTTACCCACTAA | | GGAAA | LRINALPTKSRVAHG |
| | | | | ATCTAGAGTTGCACATGGCCGTCCAACTAAAGATCGTTCCTGTCGTGCC | | (SEQ ID | RPTKDRSCRAGCLDV |
| | | | | GGATGTCTTGACGTTCAAAAAGTGCCAACTATCGAAACAATCAATCATA | | NO: | QKVPTIETINHIAQVC |
| | | | | TAGCACAAGTTTGTCCTCGGACGCATGGTGCAAGAATAAAAAGACACG | | 1355) | PRTHGARIKRHDRLV |
| | | | | ATCGGCTCGTTCAATTCCTTTCTCTCAACCTTAGGAAAAATCCAAAAAGA | | | QFLSLNLRKNPKRNV |
| | | | | AATGTTTTAGTGGAGTACAATTTCCGTACAGTCGCTGGTATCCGTAAACC | | | LVEYNFRTVAGIRKP |
| | | | | GGATATCATTGTTATTGAAGATACCCGTGCAGTTATCCTTGACGTCCAAG | | | DIIVIEDTRAVILDVQ |
| | | | | TTGTTGGTGATTCGTCCAATTTGGAGATGGAATACCTGGAGAAATCCAG | | | VVGDSSNLEMEYLEK |
| | | | | GAAATATTCTAATGACGCTAACTTTATCAATGCGCTTCAAAAACTTTATC | | | SRKYSNDANFINALQ |
| | | | | CAACGGTCACTAACCTAACTTTTCATGCAGTTACCTTCAACAATAGAGGC | | | KLYPTVTNLTFHAVTF |
| | | | | CTGATTGCCAAATCCACAGTGGCGGCCCTCCGGATGCTCGGCGTCCCAC | | | NNRGLIAKSTVAALR |
| | | | | CTAGATGCATAATGATCCTTTGTGTGATTAGCCTTGAGAAGACCCTGGA | | | MLGVPPRCIMILCVIS |
| | | | | AGTCTGGAGGATGTTTAACCAATCAACTGCTTCCGCTCGGAAATGATAA | | | LEKTLEVWRMFNQS |
| | | | | TCGCTCCATCCTGCAACTAATTATGAATGCAAATCTGTTAAGTGACATTA | | | TASARK (SEQ ID NO: |
| | | | | GTGATACTTACCTGATACTTACCCTGGTATTTATTTGACCTATACTTACCC | | | 1477) |
| | | | | TGGTATCTACCTGACATATATTTATCTAACCACCTACCTATGATGACTCCC | | | |
| | | | | GCGGAAACTCTCACTTACCTTATTACCCACTTGGTCTTTTATTTTCTCGTT | | | |
| | | | | CCTTATTACTTTGTTCCTTTGGTGTAGGGTTCTCTGGTTTTTGGAACGGCT | | | |
| | | | | TCCTTAGCCGGAATTTTGTCTGATGTATCTTGCTTGTGTCCTTGAAATATA | | | |
| | | | | CGACCCAGGCTTGCGTCATTTAGGCTCTGGGAAA (SEQ ID NO: 1109) | | | |
| R2 | R2LcA | — | *Lepidurus* | TTTGGGGTAGCAATTGATCGATTCCCGCCTCCTCGTGGCGCTACCCCGG | TTTGGGGT | TAGTGC | MSEESRPKQTASKRG |
| | | | *couesii* | GATAGCCTCAAAGAAATTTGACGGTAAAGCAAAGAGGAATTGATCACC | AGCAATTG | TTGAGT | AAVEKTMMSGTYVC |
| | | | | CAAGGCAGTACATCGGCCTTCCTGCAGGAGCTCTGATAAAGATATTAGT | ATCGATTC | GATGCC | TLCGRSFEKSVGLSLH |
| | | | | GAGTTATTCTGTTGAAGCTCGCTATTTCATTCCCCTGATGTCAGAGGAAA | CCGCCTCC | TATCCTT | TNRMHPEAYNKLKE |
| | | | | GCAGACCAAAGCAGACGGCCTCCAAGCGTGGAGCCGCCGTGGAGAAG | TCGTGGCG | TCTTTGA | AKKPVLKKARWSEEE |
| | | | | ACTATGATGAGTGGGACCTACGTGTGTACTTTATGTGGTAGGAGTTTTG | CTACCCCG | TTAACTC | VFLLAQKEAELSFIGG |
| | | | | AGAAGTCGGTGGGTTTGTCACTCCACACGAACCGGATGCACCCTGAAGC | GGATAGCC | TTACCAT | IKFMNIELHKIFPEREL |
| | | | | TTACAATAAGCTGAAGGAGGCTAAGAAACCTGTTTTGAAGAAGGCGCG | TCAAAGAA | ATACTTA | EGIKGQRKNPTYKAQ |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATGGTCAGAGGAGGAGGTTTTCCTTCTAGCGCAGAAGGAAGCGGAGCT | ATTTGACG | CCAGTTC | VVSLLAEIRESKANDS |
| | | | | CTCATTCATTGGAGGAATTAAGTTCATGAACATCGAGCTGCATAAAATTT | GTAAAGCA | TTACCCG | SSSSSSSSSCDSASLGI |
| | | | | TTCCAGAGCGTGAGTTGGAGGGAATCAAAGGCCAAAGAAAGAACCCAA | AAGAGGA | TACTTAC | SNWLEFLLALPKTSN |
| | | | | CGTACAAAGCGCAAGTCGTTAGCTTATTAGCTGAGATCCGAGAGTCTAA | ATTGATCA | CCTGTAT | QFQEGRLDRLISDAL |
| | | | | GGCCAATGATTCCTCTTCATCTTCCTCATCCTCCTCCTCTTGTGATTCGGC | CCCAAGGC | ACTTACC | RGVDVLENLDAYLLE |
| | | | | CTCTTTGGGCATTAGCAATTGGCTTGAATTTCTGCTAGCTCTCCCGAAGA | AGTACATC | TGTGTG | VFAKPMAQNPCPKP |
| | | | | CCTCCAACCAATTCCAGGAAGGTAGGCTAGATAGGCTAATCTCTGATGC | GGCCTTCC | CGTACCT | PPPAKNSRERRDREY |
| | | | | CCTGCGGGGTGTTGATGTGCTAGAAAACCTTGATGCTTACCTTCTCGAG | TGCAGGA | GTGTAC | SRVQNFYKKNRSACI |
| | | | | GTTTTCGCTAAGCCCATGGCGCAAAATCCTTGTCCAAAGCCCCCACCCCC | GCTCTGAT | TTGTCCT | NSILDGNTRSQNVIP |
| | | | | TGCGAAGAACAGTCGTGAGAGAAGGGATAGAGAATACTCTAGAGTTCA | AAAGATAT | TTAGCC | GLTKFWTETFEKNSP |
| | | | | GAATTTTTATAAGAAGAACCGTTCAGCGTGCATTAATTCCATTTTAGACG | TAGTGAGT | GCCTTG | PDDEAPDQFVADEP |
| | | | | GGAACACCCGGTCTCAAAATGTGATACCTGGCTTGACGAAGTTTTGGAC | TATTCTGT | TGTTTTT | RDMYKWITFYEMSQ |
| | | | | CGAGACGTTTGAGAAGAACTCGCCACCTGATGATGAAGCCCCTGACCA | TGAAGCTC | ACCATT | DYLDSSTAPGVDGFS |
| | | | | GTTCGTTGCGGACGAGCCTAGAGACATGTATAAGTGGATAACTTTTTAT | GCTATTTC | GGTACT | AKQLRSMSPRVLNKI |
| | | | | GAGATGTCTCAAGATTATCTTGATTCTTCCACTGCTCCTGGAGTGGATGG | ATTCCCCT | TACCTTG | LNLLLLSENLPNSFKM |
| | | | | TTTCTCTGCCAAACAGCTCCGGTCCATGTCTCCCAGGGTGCTAAATAAGA | G (SEQ ID | TGTGGT | HKTVLIPKIDDPKSPG |
| | | | | TATTGAACCTTTTACTTCTTAGTGAGAACTTACCTAATTCGTTTAAGATGC | NO: 1233) | TGCCCG | DFRPITISPVLARLLNK |
| | | | | ATAAGACAGTTCTTATACCGAAGATTGATGATCCAAAGAGTCCTGGGGA | | ATACTTA | ILAARLSKLVPISQRQ |
| | | | | TTTTAGACCGATCACGATTTCCCCTGTCCTTGCTCGCCTCCTTAACAAGAT | | CCTTGTA | KAFLPVDGCGENIFLL |
| | | | | TCTCGCTGCTAGATTGAGCAAACTAGTCCCCATTAGTCAGCGTCAAAAG | | TTTGCCT | DYILRSSKKSSKSVAM |
| | | | | GCTTTTTTGCCTGTTGATGGCTGTGGGGAGAATATTTTCCTTTTGGATTA | | TGTAATT | AVLDVKKAFDSVSHH |
| | | | | TATTCTTCGTAGCTCTAAGAAAAGTAGTAAATCAGTGGCGATGGCAGTT | | CTGCAT | SILRALNEAKCPINFIN |
| | | | | TTGGATGTTAAAAAGGCATTTGATAGTGTATCGCATCACTCCATCCTTAG | | GATATTT | FVRNSYDGCTTKLTC |
| | | | | AGCCCTTAATGAGGCCAAGTGTCCTATTAACTTTATTAACTTCGTCAGGA | | ATTGTGT | GGTSFPDSVRMNRG |
| | | | | ATAGTTATGATGGATGCACTACCAAACTTACTTGTGGGGGTACTTCCTTT | | AGGTTC | VKQGDPLSPVLFNLII |
| | | | | CCGGACTCGGTACGCATGAACCGAGGAGTGAAACAGGGAGATCCCCTA | | CTGATG | DSAIRKLPDSIGYVIR |
| | | | | TCGCCTGTGCTCTTTAATTTGATCATTGATAGTGCAATTAGGAAGTTACC | | CTTACCT | DGLKINCLAYADDLIL |
| | | | | TGACTCTATCGGCTATGTGATAAGGGATGGCTTAAAGATTAATTGCCTG | | GATTTGT | VASSRAGLKTLLNIVA |
| | | | | GCATACGCTGATGACCTGATTTTGGTAGCTTCAAGTCGTGCTGGCCTTAA | | CCCCCTC | EHLSLRGLDLNAAKC |
| | | | | GACCTTACTGAATATTGTTGCTGAGCATCTCTCGCTACGCGGGTTGGATT | | ATCATCT | HGLSIIASGKAKTTYV |
| | | | | TGAATGCTGCTAAATGTCATGGTCTGTCAATTATCGCCAGTGGTAAGGC | | TTAGTTT | SAADSLDLDGQPIKN |
| | | | | CAAAACTACTTACGTTAGTGCTGCGGATTCCCTAGATCTTGACGGTCAAC | | CGTTCTA | LGVLDTWTYLGIPFS |
| | | | | CTATAAAGAATTTGGGAGTGCTGGACACGTGGACCTACCTCGGGATTCC | | TTTCACT | HLGRAEKVSPDLTNL |
| | | | | ATTTTCCCATCTGGGTCGAGCTGAGAAAGTTTCTCCTGATTTGACCAACT | | CCATTAT | LNKLQKAPLKLQQKL |
| | | | | TACTTAACAAACTTCAGAAAGCTCCCCTCAAACTCCAGCAGAAGTTATAT | | GGAGTT | YAVRNFVIPRALHGLI |
| | | | | GCTGTACGTAACTTTGTTATCCCTAGAGCACTCCATGGCCTCATTCTATC | | CCGTTT | LSKTNLKELNTLDRAI |
| | | | | GAAGACAAACCTAAAAGAATTAAACACGCTTGATAGAGCAATTAGAGTT | | GTTTTTT | RVFLRTLLYLPKDTPL |
| | | | | TTTCTACGTACCTTGCTTTACTTACCTAAAGATACGCCACTGGGATTTTTC | | GGTGGA | GFFHSPIKSGGLGITC |
| | | | | CATTCCCCTATCAAGTCCGGAGGACTTGGGATTACGTGTTTTAGAACATC | | GGTACA | FRTSVLKCRLQRIAR |
| | | | | TGTCCTTAAGTGCCGGCTACAGAGAATAGCCCGAATGCGTAGTTCCTGT | | GCACCC | MRSSCDGVIQAVAES |
| | | | | GATGGAGTTATACAGGCAGTGGCGGAATCTGATATCTTCGCTGATGAAT | | TTTAAGC | DIFADEYAKLRDLIRIN |
| | | | | ATGCCAAGTTGCGGGACCTTATTAGGATAAACGGCAATGTGCTCGACAC | | TGGAAT | GNVLDTTESIKRYWA |
| | | | | GACCGAGAGTATTAAGAGGTATTGGGCTCAACGTCTTCACTCTTCGGTA | | TGAGTG | QRLHSSVDGKTLAY |
| | | | | GATGGCAAGACTTTGGCCTACATGGATTATTTCCCTCAGGGTAATCTTTG | | AGTTTAT | MDYFPQGNLWMSE |
| | | | | GATGTCAGAGGATAAAGTGAGCCAGCGATCTTACGTCTTTGCTGACTGT | | GTACTTT | DKVSQRSYVFADCVK |
| | | | | GTCAAGTTACGGATTAATGCCATCCCAACTCGTGTCCGTGTTTCTCGTGG | | GGATGG | LRINAIPTRVRVSRGR |
| | | | | TCGACCTAATAAGGAAATGTGCTGTAGAGCGAAATGTTTGATTCCCAG | | TTGTAAT | PNKEMCCRAKCFDS |
| | | | | AGAATGCCAGCGTTTGAATCCTTGAACCACATAACGCAAGTGTGTCCGC | | AAACTA | QRMPAFESLNHITQV |
| | | | | GCACTCATGGCTCGCGAATCCAGCGGCATGATAAGATAGCCAAGTTCCT | | CCCGGA | CPRTHGSRIQRHDKI |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTTTAAGAACCTGAACAATTGCCCATCTCGCTCGGTTCTGTATGAACCCC<br>ATTTTGTGACGGTCGATGGCCTGCGGAAGCCTGACATTATCATTTACGA<br>TGATAGCCACATGGTGGTTCTCGATGTCCAGGTGGTTTCCGACTCTGCTA<br>ACCTGGAGAAGGAATTTGAGTGCAAGGCGAAGAAATATGCCAATGATG<br>TTGCACTTCGATCTGCAATGCTAATTAAATACCCATTCATTAAGTCATTTT<br>CTTTCGTTGCAGCTACCTACAACAACCGTGGTCTGATAGCTAAATCCTCT<br>GTCCAGGTCCTTCGCCAGCTGGGTCTCTCGCCGCGCTCCATAATGGTCTC<br>CATCCTCATCTGCCTTGAGGGTACTTTGGAAACATGGCGCATCTTCAATC<br>AGTCTACAATGAATGCCCATTAGTGCTTGAGTGATGCCTATCCTTTCTTT<br>GATTAACTCTTACCATATACTTACCAGTTCTTACCCGTACTTACCCTGTAT<br>ACTTACCTGTGTGCGTACCTGTGTACTTGTCCTTTAGCCGCCTTGTGTTTT<br>TACCATTGGTACTTACCTTGTGTGGTTGCCCGATACTTACCTTGTATTTGC<br>CTTGTAATTCTGCATGATATTTATTGTGTAGGTTCCTGATGCTTACCTGAT<br>TTGTCCCCCTCATCATCTTTAGTTTCGTTCTATTTCACTCCATTATGGAGTT<br>CCGTTTGTTTTTTGGTGGAGGTACAGCACCCTTTAAGCTGGAATTGAGT<br>GAGTTTATGTACTTTGGATGGTTGTAATAAACTACCCGGAGGCAT (SEQ<br>ID NO: 1110) | | GGCAT<br>(SEQ ID<br>NO:<br>1356) | AKFLFKNLNNCPSRS<br>VLYEPHFVTVDGLRK<br>PDIIIYDDSHMVVLDV<br>QVVSDSANLEKEFEC<br>KAKKYANDVALRSA<br>MLIKYPFIKSFSFVAA<br>TYNNRGLIAKSSVQV<br>LRQLGLSPRSIMVSILI<br>CLEGTLETWRIFNQS<br>TMNAH (SEQ ID NO:<br>1478) |
| R2 | R2LcB | JN937619 | *Lepidurus couesii* | TTTTGGGGTAGCAATTGATCGATTCCCGCCTCCTCGTGGCGCTACCCTGG<br>GATAACCTCAAAGAAATTTGACGGTAAAGCTAAGAGGAATTGATCACAC<br>CGTGACGAATATCATCAGTCACAGCTGCACGAATCCAGATAGATATATA<br>ACAGGCGAGTAATTCTTTTCGAAGCTCGTCAGTAATCTTCCCAGATGTCT<br>GGAAAGAGCAGCAAACCGAGAACTGTATCCAGCGGATCCAGTTCCCAA<br>GAGACTCCTCCAAGTGGGTCCAACGCATGTGATATATGCGGGAAGTGCT<br>TCATGAAACCAGTTGGTTTATCACTACACATGTCCAAAGTCCATCCTACT<br>CAGTACCATGCACGCTTGGAAAAGAATCAACCGAAAGCCAAGAAATTTA<br>GATGGACGGATGAAGATTTGTATTTTTTAGCGAAGAAGGAAGCTGAAC<br>TTTTACTTTTGGGTGGCATTAAGTTCATGAACAAGGAACTGGCAGAATT<br>CTTTCCGGAGAAATCTGTTGACCAAATCAAAGGCCAAAGACGTTCCGAG<br>ACATACAAACAGCAAGTTGTATCAATTCATTCTGAACTGCTTAAGTTGCA<br>GGCTGTAGCTGATTCTCCTCCACCATCGAGAATTCCAGCGAAAGAAGTC<br>TCGGCCTGGCTTGATTTCCTTCTGGCCCTTCCCAAAACCAAGAATAAATT<br>TAGTGAGGACAAGTTAGACCAACTTATACGTACCGCGCAAGAAGGCACT<br>CCGGTCCTAAACGATCTAGATTTATATCTAAGAGAAGTTCTAGTTCAGCC<br>CACAAGACAGGGAGAGAGACAGGCGAAGCCTCTCCCACCACCCAAATC<br>CAGTCGAGAGAAAAGAGACAGAGAATATGCTCGTGTCCAGAATTTTTAT<br>CGCAAGAATAAAACCGCATGTGTGAACGCCATCCTTGATGGAAATAAGA<br>AGTGCGAAAACAAAATACCTGACATTGACGAATTCTGGAAGGCCATATT<br>TGAATCTCAATCTCCTCCTGATGCAGAACCAGTGAGTTACGTTGTAGAC<br>GAGGAACCGAAGAATATTTGGAGTTGGATTTCGTTCTTCGAAATGAATC<br>GTAACTACCCTGATACGTCGACCTCACCCGGTCCAGACGGCGTGACGGC<br>TCGTATGCTCCGTTCCATCCCTGCGCGTGTCCTAAATAAATTGTTAAACC<br>TATTACTCTTTATTGAAGACTTACCTGCAGTGTTCAAGTGCCATCGTACC<br>GTTCTGATACCTAAAGTTGACAATCCAGCATTACCGGGAGAATTTCGGC<br>CTATCACGATTTCTTCCATAATTGTTCGGCAGCTGAATAAAATCATCGCT<br>GCTCGCGTCTCAGAGGGCGTTCCCATAAATCCTCGTCAGAAGGCCTTTC<br>GGCAAATAGATGGATGTGCTGAGAATGTTTTCCTTTTAGATTTCATTCTT<br>CGTGACGCAAAAACGAAAATTAAGTCCCTTTCGTTGGCTACTGTCGACA<br>TTAAGAAAGCATTTGACAGTGTGTCACATCATTCCATTTTCCGAGCGATT | TTTTGGGG<br>TAGCAATT<br>GATCGATT<br>CCCGCCTC<br>CTCGTGGC<br>GCTACCCT<br>GGGATAAC<br>CTCAAAGA<br>AATTTGAC<br>GGTAAAGC<br>TAAGAGG<br>AATTGATC<br>ACACCGTG<br>ACGAATAT<br>CATCAGTC<br>ACAGCTGC<br>ACGAATCC<br>AGATAGAT<br>ATATAACA<br>GGCGAGT<br>AATTCTTTT<br>CGAAGCTC<br>GTCAGTAA<br>TCTTCCCA<br>G (SEQ ID<br>NO: 1234) | TGATAA<br>TCGCTCC<br>ATCCTGC<br>AACTAA<br>TTATGA<br>ATGCAA<br>ATCTGTT<br>AAGTGA<br>CATTAGT<br>GATACTT<br>ACCTGA<br>TACTTAC<br>CCTGGT<br>ATTTATT<br>TGACCT<br>ATACTTA<br>CCCTGG<br>TATCTAC<br>CTGACA<br>TATATTT<br>ATCTAAC<br>CACCTAC<br>CTATGAT<br>GACTCC<br>CGCGGA<br>AACTCTC<br>ACTTACC<br>TTATTAC<br>CCACTTG<br>GTCTTTT<br>ATTTTCT | MSGKSSKPRTVSSGS<br>SSQETPPSGSNACDI<br>CGKCFMKPVGLSLH<br>MSKVHPTQYHARLE<br>KNQPKAKKFRWTDE<br>DLYFLAKKEAELLLLG<br>GIKFMNKELAEFFPE<br>KSVDQIKGQRRSETY<br>KQQVVSIHSELLKLQ<br>AVADSPPPSRIPAKEV<br>SAWLDFLLALPKTKN<br>KFSEDKLDQLIRTAQE<br>GTPVLNDLDLYLREVL<br>VQPTRQGERQAKPL<br>PPPKSSREKRDREYA<br>RVQNFYRKNKTACV<br>NAILDGNKKCENKIP<br>DIDEFWKAIFESQSPP<br>DAEPVSYVVDEEPKN<br>IWSWISFFEMNRNY<br>PDTSTSPGPDGVTAR<br>MLRSIPARVLNKLLNL<br>LLFIEDLPAVFKCHRT<br>VLIPKVDNPALPGEFR<br>PITISSIIVRQLNKIIAA<br>RVSEGVPINPRQKAF<br>RQIDGCAENVFLLDFI<br>LRDAKTKIKSLSLATV<br>DIKKAFDSVSHHSIFR<br>AIRGARCPENLVNYI<br>QNSYSGCTTQISVGG |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGAGGAGCGAGATGCCCTGAGAATTTGGTGAATTATATCCAGAACAGC<br>TATTCGGGTTGTACGACCCAAATTTCCGTAGGCGGCTCTATATCTACAAC<br>AAAAATCCTGATGAACCGTGGTGTAAAACAAGGGGACCCACTATCTCCT<br>GTCCTCTTTAACTTAGTGATAAACGAAATTATTCGCAAGCTGCCGGCCTC<br>GATTGGATATCCAATCAATAGTGAGCTCTCGATAAACTGTATTGCCTATG<br>CGGATGACCTGATACTAGTTGCAAATACTAGAGAGGGTCTGAAGCTACT<br>ACTCAACCTATTGAATGAAGAGCTCCCTAAGCGAGGATTAGAATTGAAT<br>GCATCTAAGTGTTTCGGCTTATCCTTAACAGCACTCGGGAAATTGAAGA<br>AGACTCACCTGTGTACCAGTGACCAACTCGATTTACATGGGACTCTAATT<br>AAGAATCTTACCGCTGAGGAATCCTGGGTTTATTTGGGTGTTCCTTTCTC<br>ACACATTGGGCGCTCTAAGAGCTTCAGTCCAGATCTTGAAGCTCTTTTAA<br>ATAAACTCCAGAAATCGCCGCTTAAACTGCAACAAAAGCTTTTTGCTTTG<br>CGAGTTTATCTAATTCCTAGACTGCTCCACGGTTTAGTCCTATCAAGAGT<br>GGCCATTGGCGAATTAAAAATAATGGATAAGTTAATTTTGAAACACTTA<br>CGCGTATGGCTTCGTTTACCGAAAGATACCCCTTTGGGATTTTTCTACTC<br>ACCGGTGAAATTGGGCGGTTTGGGGATTAAAAACTTACGTACAAACGTT<br>TTGAAGTGCAGGAAACAACGCATTGAGCGAATGCTAGTCTCCCCTGATG<br>ATGTGGTGCGCTTGGTTGCAGAGTCGGAGATTTTCCTGAAAGAGACGG<br>ACAAGTTAAAGGACCTACTTACTATTAACGGAATGTGCCTAGATTANCG<br>GAATGTGCCTAGAACGGGAAAAAATAACAAGTTTTGGAGTGAAAGGCT<br>ATATACGTCATTTGATGGTAAAACACTTGCCTATAGCGAGTACTTTACTC<br>AAGGCGGCGGCTGGATCCGTGAAGATAAGATCCTTCAACCTGCCCATGT<br>TTTCGCTGAATGCATCAAGTTACGTATTAATGCTTTACCCACTAAATCTA<br>GAGTTGCACATGGCCGTCCAACTAAAGATCGTTCCTGTCGTGCCGGATG<br>TCTTGACGTTCAAAAAGTGCCAGCTATCGAAACAATCAATCATATAGCAC<br>AAGTTTGTCCTCGGACGCATGGTGCAAGAATAAAAAGACACGATCGGCT<br>CGTTCAATTCCTTTCTCTCAACCTTAGGAAAAATCCAAAAAGAAATGTTT<br>TAGTGGAGTACAATTTCCGTACAGTCGCTGGTATCCGTAAACCGGATAT<br>CATTGTTATTGAAGATACCCGTGCAGCTATCCTTGACGTCCAAGTTGTTG<br>GTGATTCGTCCAATTTGGAGATGGAATACCTGGAGAAATCCAGGAAATA<br>TTCTAATGACGCTACTTTATCAATGCGTATCAATGCGCTTCAAAAACTTT<br>ATCCAACGGTCACTAGCCTAACTTTTCATGCAGTTACCTTCAACAATAGA<br>GGCCTGATTGCCAAATCCACAGTGGCGGCCCTCCGGATGCTCGGCGTCC<br>CACCTAGATGCATAATGATCCTTTGTGTGATTAGCCTTGAGAAGACCCTG<br>GAAGTCTGGAGGATGTTTAACCAATCAACTGCTTCCGCTCGGAAATGAT<br>AATCGCTCCATCCTGCAACTAATTATGAATGCAAATCTGTTAAGTGACAT<br>TAGTGATACTTACCTGATACTTACCCTGGTATTTATTTGACCTATACTTAC<br>CCTGGTATCTACCTGACATATATTTATCTAACCACCTACCTATGATGACTC<br>CCGCGGAAACTCTCACTTACCTTATTACCCACTTGGTCTTTTATTTTCTCG<br>TTCCTTATTACTTTGTTCCTTTGGTGTAGGGTTCTCTGGTTTTTGGAACGG<br>CTTCCTTAGCCGGAATTTTGTCTGATGTATCTTGCTTGTGTCCTTGAAATA<br>TACGACCCAGGCTTGCGTCATTTAGGCTCTGGGAAA (SEQ ID NO: 1111) | | CGTTCCT<br>TATTACT<br>TTGTTCC<br>TTTGGT<br>GTAGGG<br>TTCTCTG<br>GTTTTTG<br>GAACGG<br>CTTCCTT<br>AGCCGG<br>AATTTTG<br>TCTGAT<br>GTATCTT<br>GCTTGT<br>GTCCTT<br>GAAATA<br>TACGAC<br>CCAGGC<br>TTGCGT<br>CATTTAG<br>GCTCTG<br>GGAAA<br>(SEQ ID NO: 1357) | SISTTKILMNRGVKQ<br>GDPLSPVLFNLVINEII<br>RKLPASIGYPINSELSI<br>NCIAYADDLILVANTR<br>EGLKLLLNLLNEELPK<br>RGLELNASKCFGLSLT<br>ALGKLKKTHLCTSDQ<br>LDLHGTLIKNLTAEES<br>WVYLGVPFSHIGRSK<br>SFSPDLEALLNKLQKS<br>PLKLQQKLFALRVYLI<br>PRLLHGLVLSRVAIGE<br>LKIMDKLILKHLRVWL<br>RLPKDTPLGFFYSPVK<br>LGGLGIKNLRTNVLKC<br>RKQRIERMLVSPDDV<br>VRLVAESEIFLKETDKL<br>KDLLTINGMCLDXRN<br>VPRTGKNNKFWSER<br>LYTSFDGKTLAYSEYF<br>TQGGGWIREDKILQP<br>AHVFAECIKLRINALP<br>TKSRVAHGRPTKDRS<br>CRAGCLDVQKVPAIE<br>TINHIAQVCPRTHGA<br>RIKRHDRLVQFLSLNL<br>RKNPKRNVLVEYNFR<br>TVAGIRKPDIIVIEDTR<br>AAILDVQVVGDSSNL<br>EMEYLEKSRKYSNDA<br>TLSMRINALQKLYPT<br>VTSLTFHAVTFNNRG<br>LIAKSTVAALRMLGV<br>PPRCIMILCVISLEKTL<br>EVWRMFNQSTASAR<br>K (SEQ ID NO: 1479) |
| R2 | R2Nvec-A | — | *Nematostella vectensis* | GGTTGGGGCCTTCTCGTGGCGGAGTCGTGAGTAAGGGGTATAGGGGTA<br>AGGGACACCACGGACCGAGAACGGTTACCGCTCAAGGCGAGTGGTGG<br>AAGGCATAAAATCGTAACGCCGCCCTCCGACCTGCTCCTGAAACTAATG<br>CCAACCAACTGACTGTGGGGCTAACCTCCCCAGAGTCAGGATGCTGAG<br>GGGTACTGGGAATATGAATGACAAGAGGGACGGATCGGCCACTGCTGA | GGTTGGG<br>GCCTTCTC<br>GTGGCGG<br>AGTCGTGA<br>GTAAGGG | TGATGG<br>TGGGTT<br>ACTCGC<br>CTCTGT<br>GTAACA | MLRGTGNMNDKRD<br>GSATADPTSALLGAV<br>GDGSLVCNLCGLACK<br>SRGGLSIHRRSKHAT<br>VYHAERQPAPRAKA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCCTACCTCAGCGCTTTTGGGGGCTGTCGGTGATGGCAGCCTGGTATGC | GTATAGGG | GGCAAA | RWTNDEMILVARKQ |
| | | | | AATCTGTGTGGCCTTGCTTGCAAGTCTCGTGGGGGGCTCTCGATTCATC | GTAAGGG | TGAAAG | IASEKSRCSAVVEGM |
| | | | | GAAGGAGCAAGCATGCCACGGTGTACCATGCGGAAAGGCAGCCCGCTC | ACACCACG | CTGCGC | REAVPHRTFDAVKSL |
| | | | | CGCGGGCTAAGGCGAGATGGACGAATGATGAAATGATACTTGTGGCCA | GACCGAG | AAGCAG | KTKNRNYTRILEQIRA |
| | | | | GAAAACAAATAGCTTCGGAAAAGAGTAGGTGTAGCGCAGTAGTTGAAG | AACGGTTA | TCGATG | ECSEEEVIESGVLKDR |
| | | | | GGATGCGAGAAGCAGTTCCACATAGAACTTTTGACGCCGTCAAAAGTCT | CCGCTCAA | AGCCAA | TENVCVQTTSNVPGS |
| | | | | CAAAACCAAGAATAGGAACTACACACGGATTCTGGAGCAGATTCGCGCT | GGCGAGT | AGCCGC | AGRAASVELEGNIQV |
| | | | | GAATGCTCCGAGGAAGAGGTGATTGAATCAGGAGTCCTTAAGGATAGG | GGTGGAA | ACAGCC | GHQLAQKTMAGNN |
| | | | | ACGGAGAACGTGTGTGTGCAAACAACATCTAACGTTCCCGGTTCGGCAG | GGCATAAA | CCCGAC | SRKQPANHTNWAEF |
| | | | | GACGGGCAGCATCGGTGGAGCTAGAGGGTAATATCCAGGTGGGCCATC | ATCGTAAC | TGGGGT | NIEEGNITLRKSKRKA |
| | | | | AACTCGCCCAAAAAACCATGGCAGGCAATAATAGTAGGAAACAGCCTG | GCCGCCCT | ACAGGG | NGMPDATHRPGPPT |
| | | | | CCAATCATACCAACTGGGCTGAGTTCAATATTGAGGAGGGAAATATTAC | CCGACCTG | CAGCCC | VDSLKHPVCLLQGAA |
| | | | | CCTCCGAAAAAGCAAAAGAAAGGCTAATGGTATGCCCGATGCGACCCA | CTCCTGAA | TGGGCT | DKRDEPHTVEQLYYN |
| | | | | CCGCCCCGGCCCACCGACTGTCGACAGTCTTAAGCACCCAGTATGCTTG | ACTAATGC | ATGCCC | IEEGMPLAEEQQWS |
| | | | | TTGCAGGGTGCAGCCGACAAAAGGGACGAACCGCACACAGTGGAACAA | CAACCAAC | GAAGTC | EKLFDAIDSSLLSVEVE |
| | | | | TTGTATTATAACATTGAGGAAGGAATGCCTCTTGCCGAAGAGCAACAGT | TGACTGTG | TTTTGAC | LGRIVPGCPDEETRQ |
| | | | | GGTCAGAAAAGCTTTTCGATGCAATCGACTCATCTTTGTTGTCTGTCGAG | GGGCTAAC | AGGTCC | LIDREFLDFIHSYSREK |
| | | | | GTCGAGCTGGGGAGAATCGTTCCTGGTTGCCCCGACGAAGAGACCCGA | CTCCCCAG | AAACTTC | PPQRGLAKSKPPPKG |
| | | | | CAGCTCATTGATAGAGAATTCTTGGATTTTATCCATTCCTATTCGAGGGA | AGTCAGG | ACCCTTG | PKSLRRQQYRQLQRL |
| | | | | AAAGCCGCCACAAAGAGGTCTCGCTAAGTCCAAACCACCACCCAAAGG | (SEQ ID | CCGCCA | WDKNRSAAAEQALT |
| | | | | ACCAAAGAGCCTCAGACGCCAGCAATATCGGCAACTCCAGAGATTGTG | NO: 1235) | GTAGGG | GKWQEVRTAAGVPL |
| | | | | GGACAAAAACCGATCCGCAGCAGCCGAACAGGCCCTAACAGGTAAATG | | CACCAG | SLMEVPWREIFETPS |
| | | | | GCAAGAAGTTCGGACTGCTGCTGGGGTCCCATTATCGTTGATGGAGGTC | | GGCCAG | TTDVREPAPAGPVL |
| | | | | CCGTGGCGGGAGATTTTCGAAACACCATCTACGACGGACGTCCGAGAG | | GTGCAG | WQLLRPVTIAEVEDA |
| | | | | CCGGCCCCAGCTGGGCCGGTTCTGTGGCAGCTTCTCAGACCAGTGACTA | | GTGGGC | ISSKKSASGPDGVPC |
| | | | | TCGCAGAAGTAGAGGACGCAATTTCCTCCAAGAAATCAGCTAGCGGTCC | | GCTTTGT | AALQTMGAASLAAH |
| | | | | AGATGGAGTGCCTTGTGCCGCCCTTCAAACCATGGGCGCCGCCTCCCTA | | TCTATTT | FNLWLLAGTQPKRLT |
| | | | | GCAGCTCACTTTAACTTGTGGCTGTTGGCCGGTACTCAGCCCAAACGCCT | | GGTTTC | ECRTIFVPKEVNTHLP |
| | | | | AACAGAATGCCGAACAATATTTGTGCCTAAGGAGGTAAATACTCACCTG | | GCTTAAT | LHHRPITIGSVVVRLF |
| | | | | CCCCTCCATCATAGGCCAATCACTATCGGCTCGGTGGTTGTAAGACTCTT | | TTTTGTT | HQILGKPMEAVLPLG |
| | | | | CCACCAGATTCTGGGAAAGCCAATGGAAGCAGTACTGCCATTGGGGTC | | AAATTTT | SGQRGFRKGDGICQ |
| | | | | GGGCCAGCGCGGTTTTCGAAAGGGTGACGGAATATGCCAGAACATCTG | | TCCCGT | NIWLLHTLIRRSTDLL |
| | | | | GCTCCTCCATACTCTAATCAGACGCAGCACTGATTTGCTGAGGCCACTCA | | GCGCCC | RPLKLVFLDVKKAFDS |
| | | | | AGCTGGTCTTCTTGGATGTGAAAAAGGCCTTCGATTCGGTTAGTCACGA | | ACCCTTT | VSHESLLIAAKRLGVP |
| | | | | ATCCCTTTTAATTGCGGCGAAGCGTCTCGGAGTGCCCGGGCCGCTCCTA | | TTAACCC | GPLLTYINELYSRSETV |
| | | | | ACGTACATCAATGAACTGTACTCTCGTTCGGAGACAGTCTTTGAAGTTG | | TTTTAAC | FEVGGESSGSVKVSQ |
| | | | | GGGGCGAGAGCAGTGGCTCTGTTAAAGTATCCCAAGGGGTAAAGCAAG | | ACCAATT | GVKQGDPLSSTLFNC |
| | | | | GGGATCCATTGAGTTCGACGCTCTTCAACTGCGTCATTGACTGGGCGGT | | TTTTTTA | VIDWAVSDLDPHIGV |
| | | | | CTCAGATCTCGACCCCCACATAGGCGTCTTACTAGGGGAGTCTCGAGTC | | CAACCCT | LLGESRVSFLAYADDL |
| | | | | TCCTTTCTAGCTTACGCTGATGACCTGGTTCTCCTATCGGAGACCGAGGC | | CTACTCA | VLLSETEAALTSQLNS |
| | | | | TGCACTGACAAGCCAGCTGAACTCAATTGAAAAGAGTCTAGCGCACTGT | | ATAATCC | IEKSLAHCGLKLSTGD |
| | | | | GGTCTCAAGCTCAGTACGGGGGACAGTGGTAAATCTGCTTCGCTGAACA | | AAATGA | SGKSASLNIVIDGKAK |
| | | | | TCGTGATTGATGGTAAAGCTAAGCGGTGGGTTGTAAACCCTACCCCGTT | | ATAAAA | RWVVNPTPFLRASG |
| | | | | CCTACGTGCGTCTGGTGGCGAAATTCGATCTCTCGTCGCAAATGAGACG | | GCGGCA | GEIRSLVANETYKYLG |
| | | | | TACAAGTACTTGGGCATTAACATCGGAGCCCAGGGCGTGAAAGCTGCT | | TAACAG | INIGAQGVKAAEYNA |
| | | | | GAATACAATGCATTCAAAGAAGCACTCGATAACTTGTCTCGAGCTCCACT | | GTGAAC | FKEALDNLSRAPLKP |
| | | | | TAAGCCGCAGCAGAGGTTATTCCTGCTGAAGACCTATCTGTTGCCGCAA | | AC (SEQ | QQRLFLLKTYLLPQLH |
| | | | | CTACACCACTCACTGGTATTGTCAAGGACAACTGGCAAACTATTGAACA | | ID NO: | HSLVLSRTTGKLLNSL |
| | | | | GCCTCGATGCTCTCGTAAGAAAAGCTGTACGGGGATGGCTTAAATTGCC | | 1358) | DALVRKAVRGWLKL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACACGACACTCATAGGGCCTTCTTTTATGCTCACCAGGCCGACGGGGGA | | | PHDTHRAFFYAHQA |
| | | | | CTCAATGTCCCAAGTCTGTACCATCTAATACCTCTCCTAAGGAGGAGTAG | | | DGGLNVPSLYHLIPLL |
| | | | | GTATGAACGCTTGACGAGGGTCGAAGACCCTGAGATAAGGGAAGTGTC | | | RRSRYERLTRVEDPEI |
| | | | | CCGAACCGACTACTTCAAAAGAGTCTTGGGTGCCGCGGCGGCGGCCAC | | | REVSRTDYFKRVLGA |
| | | | | CACGGTTGCAGGGCATCGAATTGATTCCAAAGTAACGTTGCGCCTAGCT | | | AAAATTVAGHRIDSK |
| | | | | TGGCGCGAGGCCCTTTACGCTTCAGCTGACGGGGGGGGTCTCTCCCAAT | | | VTLRLAWREALYASA |
| | | | | GCCCGTTGGTACCCGAGGTTCACTCCTGGGTTACCGATGTTTCCGGTCTT | | | DGRGLSQCPLVPEVH |
| | | | | CAGACCGGATCGCAGTACATCTCTGCTGTTCGCTTAAGGGGGGCCTTGC | | | SWVTDVSGLQTGSQ |
| | | | | TTCCCACGGCGGTAAGGAAATCGAGGGGTCGCGGGGGTGTTAACTCGA | | | YISAVRLRGALLPTAV |
| | | | | ATTGCGACTGTTGCGGTCGTGGACAACCAGAGTTTCTTGGGCACGTTCT | | | RKSRGRGGVNSNCD |
| | | | | CCAGACGTGTCCTCGGACCTGGGGGTCTCGCATCAGTCGTCACAACCAC | | | CCGRGQPEFLGHVL |
| | | | | GTCCTCTCCCTTATCGCTAAAGCGTGCCGTTCGCGAAGATGGCAGGTGC | | | QTCPRTWGSRISRHN |
| | | | | TGGAAGAGCCGATCATCCAGACTCCTGCGCAGTTGCTCAAGCCAGACTT | | | HVLSLIAKACRSRRW |
| | | | | GGTGATCTGGAACCATCAAGCGGCGTACGTCGTTGACGTTAGCGTACCG | | | QVLEEPIIQTPAQLLK |
| | | | | GGTGATAACACCCCGCTCAGTACGTGTCACAACAGGAAAGTCGCATATT | | | PDLVIWNHQAAYVV |
| | | | | ACTCTGGTGAGAGCGTTCGTGAATGGGTGCGTTCCAAGACTGGGCATA | | | DVSVPGDNTPLSTCH |
| | | | | ATCCTACAGTGTCCTCTGTAGTGATTAACTGGCGCGGTGCCATGGCAAA | | | NRKVAYYSGESVRE |
| | | | | GGAGTCCTACCGCCTTTTGACGAAAGACCTTCGTCTAGCGAAGACCCTG | | | WVRSKTGHNPTVSS |
| | | | | CCTCGTCTGCTGGTACTAAGAGTTCTGGAAGGCGGCCATGGAATCTGGC | | | VVINWRGAMAKESY |
| | | | | TCAATTTCCATCGGTCGACCTTCGCCGTGGGAGTAACTTGATGGTGGGT | | | RLLTKDLRLAKTLPRL |
| | | | | TACTCGCCTCTGTGTAACAGGCAAATGAAAGCTGCGCAAGCAGTCGATG | | | LVLRVLEGGHGIWLN |
| | | | | AGCCAAAGCCGCACAGCCCCCGACTGGGGTACAGGGCAGCCCTGGGCT | | | FHRSTFAVGVT (SEQ |
| | | | | ATGCCCGAAGTCTTTTGACAGGTCCAAACTTCACCCTTGCCGCCAGTAG | | | ID NO: 1480) |
| | | | | GGCACCAGGGCCAGGTGCAGGTGGGCGCTTTGTTCTATTTGGTTTCGCT | | | |
| | | | | TAATTTTTGTTAAATTTTTCCCGTGCGCCCACCCTTTTTAACCCTTTTAACA | | | |
| | | | | CCAATTTTTTTTACAACCCTCTACTCAATAATCCAAATGAATAAAAGCGG | | | |
| | | | | CATAACAGGTGAACAC (SEQ ID NO: 1112) | | | |
| R2 | R2Sm-A | — | *Schistosoma* | ATGTTTTAATTTATTTTTGAACTACTACTGTCTGAGTGCTTCTTACAACCT | ATGTTTTA | TAGCCC | MPVSTGAETDITSSLP |
| | | | *mansoni* | GAAGGCTCAGAAACTACCCACTTTTTGCTGTTTATCCACAACAACAGTTG | ATTTATTTT | CCTTCAC | IPASSIVSPNYTLPDSS |
| | | | | TGAATCTATTCTCCAAATATTCCTTGTGCTTTTGTCAACATTATTCTATACC | TGAACTAC | TCTTAGA | STCLICFAIFPTHNILLS |
| | | | | AACTGTACCACCTACTTCTTCATCTCACGTTTTAATTCTGGTCTAATTTTCT | TACTGTCT | CATTCCC | HATAIHHISCPPTPVQ |
| | | | | CATCATTAGTCACGGAGAGGGCCTATGAACGGTCCGTGACGCGAAATTC | GAGTGCTT | CCACTGT | DGSQQMSCVLCAAA |
| | | | | AATCCACGAATTCGTCCTCTTCTGCTAGTGGTCCCCGAAATACGGTTCCT | CTTACAAC | TGTTGCT | FSSNRGLTQHIRHRHI |
| | | | | CTGGCCTGTCAGTTGTGTTAAAACTATATAATAACGATGCCGGTCTCAAC | CTGAAGGC | TATCTTC | SEYNELIRQRIAVQPT |
| | | | | CGGCGCAGAAACTGACATAACCTCTTCTTTGCCTATTCCTGCATCCTCAA | TCAGAAAC | ATGTTTT | SRIWSPFDDASLLSIA |
| | | | | TCGTCTCGCCAAACTACACACTCCCTGATTCCTCTTCAACCTGCCTTATAT | TACCCACT | TGTGTTA | NHEAHRFPTKNDLY |
| | | | | GTTTCGCTATCTTCCCCACCCACAACATACTCCTCTCCCATGCCACTGCAA | TTTTGCTG | ATTGACT | QHISTVLTRRTAEAVK |
| | | | | TCCACCATATTTCTTGTCCTCCTACTCCAGTGCAAGACGGTTCTCAGCAG | TTTATCCA | GCTCTCT | RRLLHLQWSRSPTAI |
| | | | | ATGTCTTGTGTTCTTTGCGCCGCCGCTTTTTCATCTAACAGGGGACTAAC | CAACAACA | TCTGGG | TTSSNNHTTTDIPNTE |
| | | | | ACAACACATTCGCCACCGGCACATCTCCGAATATAACGAACTAATCAGA | GTTGTGAA | TTGATGT | ARYIFPVDLDEHPPLS |
| | | | | CAACGAATTGCAGTGCAGCCGACGTCTCGCATATGGTCACCATTCGATG | TCTATTCTC | CTGATT | DATTPDASTHPLPELL |
| | | | | ATGCTTCTCTACTATCAATCGCTAACCATGAAGCCCATAGATTCCCCACG | CAAATATT | GTCTCTC | VILTPLPSPTRLQNISE |
| | | | | AAGAATGACTTATACCAACACATCAGCACTGTATTAACACGCAGGACGG | CCTTGTGC | TCTCTTT | SQTSHESNRNSMHT |
| | | | | CAGAGGCCGTCAAACGCCGACTCCTCCACCTACAGTGGTCCAGATCACC | TTTTGTCA | CCATATT | PPTYACDSDESLGVT |
| | | | | CACAGCGATTACTACCTCTTCGAATAATCACACAACCACAGACATCCCCA | ACATTATT | GCTTGC | PSSTIPSCFHSYRDPL |
| | | | | ATACCGAGGCCCGATATATTTTTCCGGTAGACCTAGACGAACATCCACC | CTATACCA | TCTCCCC | AEQRSKLLRASASLLQ |
| | | | | ATTGTCTGATGCCACAACCCCCGACGCATCGACACATCCACTCCCAGAAC | ACTGTACC | GCTTACT | SSCTRIRSSSLLAFLQN |
| | | | | TCCTTGTCATCTTGACACCGCTTCCATCCCCGACTAGACTACAAAACATA | ACCTACTT | TCCAATA | ASTLMDEEHVSTFLN |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCCGAATCACAGACCTCCCATGAATCCAATAGGAACTCAATGCATACACC | CTTCATCT | GTTGTC | SHGEFVFPRTWTPSR |
| | | | | GCCAACGTATGCCTGCGATTCGGATGAGTCACTAGGGGTTACTCCCTCA | CACGTTTT | ATATTAT | PKHPSHAPANVSRKK |
| | | | | TCAACTATCCCCTCATGCTTCCACAGTTATCGGGACCCCCTAGCTGAACA | AATTCTGG | GTCTTTG | RRKIEYAHIQTLFHHR |
| | | | | AAGAAGCAAACTCCTGAGGGCATCCGCCAGCCTACTACAAAGCAGTTGT | TCTAATTTT | TTTACTT | PKDAANTVLDGRWR |
| | | | | ACTCGCATACGGTCCTCCAGCCTGCTCGCCTTCCTCCAAAACGCATCCAC | CTCATCAT | GCCATG | NPYVANHSMIPDFD |
| | | | | ATTAATGGACGAGGAACACGTGTCCACCTTCCTCAATAGTCATGGAGAA | TAGTCACG | TCTAAC | CFWTTVFTKTNSPDS |
| | | | | TTCGTCTTCCCTAGAACATGGACCCCATCCCGACCCAAACACCCCTCCCA | GAGAGGG | GACAAT | REITPIIPMTPSLIDPIL |
| | | | | CGCCCCAGCTAATGTTTCTAGGAAGAAAAGGAGGAAAATAGAGTACGC | CCTATGAA | TACTTTA | PSDVTWALKEMHGT |
| | | | | ACACATCCAGACACTCTTCCACCACCGTCCCAAAGATGCCGCCAACACCG | CGGTCCGT | TCTACCT | AGGIDRLTSYDLMRF |
| | | | | TTCTAGACGGTCGGTGGAGAAACCCCTATGTCGCAAACCATTCAATGAT | GACGCGA | TAGTTG | GKNGLAGYLNMLLA |
| | | | | TCCAGACTTCGACTGCTTCTGGACAACAGTCTTTACTAAAACAAATTCCC | AATTCAAT | GTCCTCT | LAYLPTNLSTARVTFV |
| | | | | CAGACAGCCGGGAGATTACTCCAATCATCCCTATGACTCCCTCTCTCATT | CCACGAAT | TGGTTT | PKSSSPVSPEDFRPIS |
| | | | | GACCCGATCCTCCCCTCTGACGTCACATGGGCGCTGAAAGAAATGCATG | TCGTCCTC | GGTTGC | VAPVATRCLHKILAKR |
| | | | | GCACGGCCGGTGGGATTGATCGTCTAACATCGTACGATCTGATGAGATT | TTCTGCTA | CTTCATG | WMPLFPQERLQFAF |
| | | | | CGGGAAGAATGGTCTTGCTGGATATCTCAACATGCTACTCGCTCTTGCAT | GTGGTCCC | TGTTCAT | LNRDGCFEAVNLLHS |
| | | | | ACCTTCCCACTAATCTCTCAACAGCACGGGTAACTTTCGTCCCCAAGTCA | CGAAATAC | GGCGGA | VIRHVHTRHAGASFA |
| | | | | TCAAGTCCTGTGTCACCTGAGGACTTCCGTCCCATCAGTGTCGCTCCAGT | GGTTCCTC | ATCTGAT | LLDISRAFDTVSHDSII |
| | | | | AGCCACTAGGTGCCTGCACAAAATTCTAGCAAAGAGATGGATGCCGCTC | TGGCCTGT | GTTTATA | RAAKRYGAPELLCRYL |
| | | | | TTTCCACAGGAACGACTTCAGTTCGCTTTCCTAAACCGAGATGGATGCTT | CAGTTGTG | ATGACT | NNYYRRSTSCVNRTE |
| | | | | TGAAGCAGTTAATCTTCTGCACTCGGTCATACGGCACGTCCACACCCGCC | TTAAAACT | ATTCCTA | LHPTCGVKQGDPLSP |
| | | | | ATGCAGGAGCATCCTTCGCCCTGCTCGACATATCACGGGCCTTTGACACT | ATATAATA | CTACCAC | LLFIMVLDELLEGLDP |
| | | | | GTATCACATGACTCCATCATCAGAGCGGCGAAAAGATATGGGGCACCTG | ACG (SEQ | CATTACA | MTHLTVDGESLNYIA |
| | | | | AACTGTTATGCCGCTACCTCAATAACTATTACCGACGTTCAACCAGCTGC | ID NO: | ACTATTA | YADDLVVFAPNAELL |
| | | | | GTCAACCGCACTGAATTGCATCCTACGTGTGGGGTGAAGCAAGGAGAC | 1236) | TTATTAT | QRKLDRISLLLHEAG |
| | | | | CCCCTGTCGCCACTCCTCTTCATCATGGTTCTCGACGAATTACTGGAAGG | | CACTATT | WSINPEKSRTLDLISG |
| | | | | TCTAGATCCAATGACCCACCTAACAGTTGATGGAGAGAGCTTGAACTAC | | ATTAAC | GHSKITALSQTEFTIA |
| | | | | ATAGCTTATGCTGACGATCTCGTAGTTTTCGCTCCAAATGCAGAACTCCT | | ATTATTA | GMRIPPLSAADTEDY |
| | | | | TCAACGGAAACTCGATCGGATCTCCCTACTTCTACACGAGGCTGGATGG | | TTACTTC | LGIKSNFKGRCPVAHI |
| | | | | TCGATTAACCCTGAAAAAAGCCGGACCCTGGACCTAATCTCTGGTGGCC | | TACAATT | DLLNNYLTEISCAPLK |
| | | | | ATTCCAAAATCACAGCGCTCTCTCAGACAGAATTCACCATCGCGGGGAT | | AGTATT | PQQRMKILKDNLLPR |
| | | | | GCGTATACCACCGCTTTCCGCCGCCGACACCTTCGACTATCTGGGTATCA | | ATGGCT | LLYPLTLGIVHLKTLKS |
| | | | | AATCCAACTTCAAGGGCCGATGCCCAGTGGCCCATATTGACTTATTGAA | | ACTCCTT | MDRNIHTAIRKWLRL |
| | | | | CAACTACCTCACGGAAATATCGTGCGCTCCACTTAAGCCGCAGCAGCGC | | TCAGCA | PSDTPLAYFHSPVAA |
| | | | | ATGAAGATCTTGAAAGATAATCTACTCCCTCGACTCCTCTACCCCCTGAC | | CACCAA | GGLGILHLSSSVPFHR |
| | | | | TCTAGGAATAGTACACCTGAAAACCCTGAAGTCAATGGACCGAAATATC | | TAAAAT | RKRLETLLSSPNRLLH |
| | | | | CACACGGCCATAAGGAAATGGTTGCGGCTACCCTCCGACACCCCGCTAG | | CTCAATC | KLPTSPTLASYSHLSQ |
| | | | | CATATTTTCACTCACCCGTCGCTGCCGGAGGCCTAGGGATCCTCCATCTG | | AAACAT | LPVRIGHETVTSREEA |
| | | | | TCCTCATCGGTTCCATTCCACCGTCGAAAACGTCTAGAAACCCTCCTATC | | CTCACTT | SNSWVRRLHSSCDG |
| | | | | TTCACCGAACCGCCTACTGCACAAGTTGCCAACTTCCCCAACACTAGCTT | | ATTAAA | KGLLLAPLSTESHAW |
| | | | | CTTATTCACACCTTAGTCAACTGCCAGTTCGAATTGGGCACGAGACCGTA | | CTCTCTA | LRYPQSIFPSVYINAV |
| | | | | ACGTCTAGAGAAGAGGCTTCCAACAGCTGGGTGAGACGATTACATTCGT | | TTTCCCC | KLRGGLLSTKVRRSR |
| | | | | CCTGCGACGGGAAGGGACTACTCCTAGCACCACTAAGCACCGAGTCCCA | | TTCGTTA | GGRVTNGLNCRGGC |
| | | | | TGCATGGCTGCGCTACCCCCAGTCTATTTTTCCAAGTGTTTACATCAACG | | TAAACTT | AHHETIHHILQHCALT |
| | | | | CCGTTAAATTACGAGGTGGCTTACTATCCACCAAAGTCAGGAGATCTCG | | ACAATTC | HDIRCKRHNELCNLV |
| | | | | CGGAGGTAGAGTGACGAATGGCCTGAACTGTCGAGGCGGTTGCGCCCA | | AGTTTA | AKKLRRQKIHFLQEPC |
| | | | | TCATGAAACAATCCACCACATTCTGCAACATTGCGCGCTCACCCATGACA | | ACCGAA | IPLEKTYCKPDFIIIRDS |
| | | | | TCAGATGCAAACGCCATAACGAACTATGCAACCTTGTGGCAAAGAAACT | | TATCTCT | IAYVLDVTVSDDGNT |
| | | | | GCGTAGGCAAAAAATCCATTTCTTACAGGAGCCCTGCATTCCTCTAGAA | | CTTTTAC | HASRLLKISKYGNERT |
| | | | | AAAACTTACTGCAAACCTGATTTTATAATTATACGTGATTCAATTGCTTAT | | AAATCTT | VASIKRFLTSSGYIITS |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTTCTAGACGTCACTGTATCGGACGACGGAAACACCCACGCCAGCCGCC | | AAGTAT | VRQTPVLTFRGILERA |
| | | | | TGTTAAAAATATCAAAATACGGCAATGAGCGAACCGTCGCATCGATCAA | | GTAATTT | SSQSLRRLCFSSRDLG |
| | | | | GCGATTCCTCACATCCAGTGGATATATCATTACCAGTGTTCGACAAACAC | | TGTGCC | DLCLSAIQGSIKIYNTY |
| | | | | CAGTCCTTACATTCAGAGGTATTCTGGAGAGAGCAAGTTCACAATCCCT | | AAGCCC | MRGTQRLNE (SEQ |
| | | | | ACGACGCCTATGTTTTTCGTCCCGTGACCTCGGTGACCTTTGCCTGAGTG | | ATTTGG | ID NO: 1481) |
| | | | | CGATTCAAGGCTCAATTAAAATATATAATACCTATATGAGAGGAACCCA | | GTCTGT | |
| | | | | ACGGCTGAACGAATAGCCCCCTTCACTCTTAGACATTCCCCCACTGTTGT | | ACAATTT | |
| | | | | TGCTTATCTTCATGTTTTTGTGTTAATTGACTGCTCTCTTCTGGGTTGATG | | GATACTT | |
| | | | | TCTGATTGTCTCTCTCTCTTTCCATATTGCTTGCTCTCCCCGCTTACTTCCA | | AAAAAT | |
| | | | | ATAGTTGTCATATTATGTCTTTGTTTACTTGCCATGTCTAACGACAATTAC | | AAATGT | |
| | | | | TTTATCTACCTTAGTTGGTCCTCTTGGTTTGGTTGCCTTCATGTGTTCATG | | TAT (SEQ | |
| | | | | GCGGAATCTGATGTTTATAATGACTATTCCTACTACCACCATTACAACTA | | ID NO: | |
| | | | | TTATTATTATCACTATTATTAACATTATTATTACTTCTACAATTAGTATTAT | | 1359) | |
| | | | | GGCTACTCCTTTCAGCACACCAATAAAATCTCAATCAAACATCTCACTTAT | | | |
| | | | | TAAACTCTCTATTTCCCCTTCGTTATAAACTTACAATTCAGTTTAACCGAA | | | |
| | | | | TATCTCTCTTTTACAAATCTTAAGTATGTAATTTTGTGCCAAGCCCATTTG | | | |
| | | | | GGTCTGTACAATTTGATACTTAAAAATAAATGTTAT (SEQ ID NO: 1113) | | | |
| R2 | R2Tc | EU854578 | *Triops* | TTTTTGGTCTGGCATTTGATCGTTTCCGCCTCCTCGTGGCGCCAGACTGG | TTTTTGGT | TAGATG | MSQKRRPEKAVPDE |
| | | | *cancriformis* | GTAAGCTGATTTATCAGTGAGCTAAGAGAAACGATCACCGCAGGAGTCC | CTGGCATT | ACTGCC | GATAHDVAQPDKSK |
| | | | | ATCTACCTGCGCTGCACGTGATTTCATTGTGCACTTGGCGAGTTATCCCT | TGATCGTT | CTACCCC | CSVCGETFKGPASVT |
| | | | | TGTGGAGCTCGCTCGTTAGCTTTTGAGATGTCTCAAAAGCGCAGACCGG | TCCGCCTC | TTTGCTG | MHMVKKHPVEFNEL |
| | | | | AGAAAGCAGTCCCCGACGAGGGAGCGACTGCTCATGATGTTGCGCAAC | CTCGTGGC | CCGAAG | KMAKKPVPKKVRWS |
| | | | | CGGATAAGAGTAAGTGTTCTGTTTGTGGGGAGACTTTTAAGGGTCCTGC | GCCAGACT | AACTACT | EEEIFQLARTEAELTL |
| | | | | TTCCGTGACAATGCACATGGTAAAGAAGCACCCAGTCGAATTTAATGAG | GGGTAAG | GAAGAC | QGVRFINVELQKIFPA |
| | | | | CTTAAGATGGCCAAGAAGCCTGTTCCGAAGAAAGTACGATGGTCTGAG | CTGATTTA | TATTGA | REIEGIKGQRKLAKYK |
| | | | | GAGGAGATCTTCCAACTTGCCAGGACAGAGGCCGAACTTACCCTTCAGG | TCAGTGAG | ACTAAC | ELVKDQLDEIGRAPN |
| | | | | GAGTTCGGTTTATTAATGTCGAGCTGCAGAAGATCTTCCCAGCACGCGA | CTAAGAGA | CAACTG | PPEQEIGEDVPSPFKA |
| | | | | GATCGAGGGCATCAAAGGCCAGAGGAAACTGGCTAAGTACAAAGAGCT | AACGATCA | TGTTAA | WLELLLALPKTPNDFL |
| | | | | CGTTAAAGATCAGCTGGACGAAATCGGCCGTGCTCCTAACCCCCCTGAG | CCGCAGGA | GTAAGA | EHKLDNIIVQALKEDV |
| | | | | CAAGAGATCGGAGAGGATGTGCCTAGCCCGTTCAAGGCATGGCTGGAA | GTCCATCT | ACTAAT | NSDQVFNDLNSYLKL |
| | | | | CTTCTGCTTGCGCTCCCCAAGACCCCCAATGATTTTCTAGAACACAAACT | ACCTGCGC | GCCTCTT | ILEPSGRAKSVPGEIIH |
| | | | | TGACAACATTATTGTTCAAGCGCTGAAGGAAGACGTGAACTCCGATCAG | TGCACGTG | TTTCCCT | GDPSGSAKTSVTKAP |
| | | | | GTATTCAATGACCTTAACTCCTATTTAAAGCTGATTCTTGAGCCGAGTGG | ATTTCATT | GCATGT | KPATVSSSRKKRRDA |
| | | | | TAGAGCCAAGTCAGTTCCCGGGGAAATTATACACGGTGATCCCAGTGG | GTGCACTT | ATCCCCT | EFARIQRLYRKNRTSC |
| | | | | GTCTGCTAAGACCTCAGTAACCAAGGCTCCTAAGCCTGCTACAGTTTCTT | GGCGAGTT | GATCAG | INTILDGNTREHEAPK |
| | | | | CTAGCAGGAAAAAACGCAGAGATGCCGAGTTTGCTAGGATCCAGCGTC | ATCCCTTG | TGACTTA | NMEGFWREIFERESP |
| | | | | TCTATCGGAAAAATCGGACATCATGTATAAATACAATCCTTGATGGCAAT | TGGAGCTC | TTTTCTT | DDPDDPDIFLEEEAS |
| | | | | ACAAGAGAGCATGAGGCCCCTAAGAACATGGAAGGATTTTGGAGGGAA | GCTCGTTA | TTCCTGT | DIWKYISFYEMCNLY |
| | | | | ATATTCGAGAGGGAATCCCCGGATGACCCCGATGATCCCGACATTTTCC | GCTTTTGA | TGCGCC | PPPSTAPGPDGFSSK |
| | | | | TTGAGGAAGAAGCCAGTGATATTTGGAAGTACATCTCTTTCTATGAGAT | G (SEQ ID | CTTTGTT | DLRRMTPRVLNKILN |
| | | | | GTGCAACCTTTATCCGCCTCCCTCCACTGCTCCTGGCCCCGATGGGTTTT | NO: 1237) | TAGTTAT | LLLHLRDLPQILKSHR |
| | | | | CCTCTAAGGACCTCCGGCGGATGACGCCAAGAGTCCTCAACAAAATTTT | | TTCCTTT | TVLIPKTDLPTKPGDF |
| | | | | AAACCTACTCCTTCATTTGAGAGATCTTCCTCAGATCCTGAAATCCCATC | | AATTACT | RPITISNILVRHLNKIL |
| | | | | GAACTGTACTAATACCAAAAACCGATTTGCCTACTAAACCCGGGGACTTT | | AGAATT | ANRVSHLIPINERQK |
| | | | | CGTCCCATAACGATCTCAAATATACTAGTCAGACATCTTAATAAGATTCT | | ATCTTTT | AFLPIDGCAENIFTLD |
| | | | | GGCTAATAGAGTGAGCCACCTTATACCAATCAATGAGAGGCAGAAAGC | | CGTTCTC | FILHHARTKIKSLSMA |
| | | | | TTTCCTACCAATTGATGGCTGCGCAGAAAATATTTTCACTTTGGACTTCA | | CGTCTA | ILDISKAFDSVSHHSIF |
| | | | | TACTCCATCATGCGCGGACCAAAATTAAATCGCTGTCAATGGCCATTCTA | | ATTGCTT | RALREARCPIGFIKFIE |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GATATTAGTAAGGCATTTGATAGCGTCTCGCATCATTCCATCTTCCGCGC | | TTTCGGT | NCYGGCFTKLFCGGV |
| | | | | TTTGCGAGAGGCTCGATGCCCCATTGGTTTTATTAAATTCATTGAGAATT | | GTAGGA | KYPSEVSMNRGVKQ |
| | | | | GTTATGGTGGATGTTTTACCAAACTTTTCTGTGGTGGCGTGAAATACCCG | | ACGGCT | GDPLSPVLFNLVIDGL |
| | | | | AGTGAGGTTTCTATGAACCGAGGAGTAAAGCAGGGGGATCCGCTGTCA | | ACCTAA | IRQIPSALGFNVSDQ |
| | | | | CCAGTCCTATTTAACTTAGTCATTGATGGTCTGATCAGGCAAATTCCATC | | AGCTGG | VKVSCIAYADDLILIAT |
| | | | | CGCTCTTGGATTCAACGTAAGTGATCAGGTGAAAGTCAGCTGTATCGCC | | AAGTGG | TRAGLKTLLDLTNSYL |
| | | | | TACGCTGATGACCTGATCCTTATTGCGACCACAAGGGCTGGCCTGAAGA | | GAAGTG | AKRGLSLNPDKCSAL |
| | | | | CCCTGCTTGACTTGACTAACTCCTACCTAGCAAAACGGGGACTTTCGCTC | | TTTTCAA | SIVASGKQKLVYIASS |
| | | | | AACCCGGACAAATGCTCGGCCCTATCGATTGTGGCATCCGGCAAGCAGA | | TGTACTT | EHFDLAGQKMRNLN |
| | | | | AGCTTGTATATATTGCGTCTTCCGAGCATTTTGATCTCGCAGGTCAGAAA | | TGTGATT | VGDSWRYLGIQFSHL |
| | | | | ATGCGCAATTTAAACGTCGGTGACTCTTGGAGATACCTGGGTATTCAAT | | ATAGAA | GRAEKVTPDLTCLINR |
| | | | | TCTCGCATCTCGGTAGAGCCGAAAAGGTCACTCCAGACCTAACATGTCT | | ATATAT | LQKAPLKLQQKLYAL |
| | | | | AATTAATAGACTTCAAAAGGCCCCTTTAAAGCTTCAACAGAAGCTTTATG | | GACCCG | RIYLIPRLIHGLTLSKT |
| | | | | CTCTCCGAATCTATCTTATACCCAGGCTTATCCATGGCCTCACCCTCTCTA | | AGGTGC | NLGELKTLDKLIRKYIR |
| | | | | AGACCAACCTCGGAGAGCTTAAAACGCTGGACAAGCTAATCCGCAAGT | | ATTGTTT | AWLHLPDDTPMGYF |
| | | | | ACATCCGCGCCTGGCTCCATCTCCCAGATGACACTCCGATGGGCTATTTC | | GGCATT | YTPLKAGGLGLPSLRL |
| | | | | TATACCCCCTTAAAAGCTGGTGGACTTGGCCTTCCTTCACTCCGTCTAGT | | TCCTCGA | VILNNRLERILRMKAS |
| | | | | GATCCTTAACAATCGACTTGAACGGATACTAAGGATGAAGGCTTCTCAA | | GAAA | QDIIVRTIAESETLGVE |
| | | | | GACATTATTGTCCGCACTATTGCCGAATCGGAGACGTTGGGGGTCGAGA | | (SEQ ID | IRKLHDLLSIDGTILDT |
| | | | | TTCGAAAGCTTCACGATCTGTTGTCCATTGATGGAACAATTCTGGACACG | | NO: | SVKIHSFWAERLYSSY |
| | | | | AGCGTTAAGATCCATAGCTTCTGGGCAGAAAGACTCTACTCGTCCTATG | | 1360) | DGKCLCNSANFPPG |
| | | | | ATGGTAAATGTCTTTGCAATTCTGCAAATTTTCCCCCCGGAAACAAGTGG | | | NKWIGEDSLNQRSHI |
| | | | | ATCGGTGAAGATTCTCTGAACCAACGCTCGCATATCTTCGCTGATTGCCT | | | FADCLKLRINALPTRS |
| | | | | AAAGCTCCGGATAAATGCGCTCCCAACACGTTCCAGAACAGCACGTGGA | | | RTARGRPLKDKPCRA |
| | | | | AGGCCACTAAAAGATAAACCATGTAGAGCTGGATGTCGGAACAGTGAT | | | GCRNSDGVKVIETLN |
| | | | | GGTGTAAAGGTCATTGAGACACTGAATCACATTACACAGGTGTGTGAG | | | HITQVCERTHGARVK |
| | | | | AGAACCCACGGAGCCCGCGTCAAGCGGCATGATCGCCTAGTGGACTTC | | | RHDRLVDFAVKGLQ |
| | | | | GCGGTGAAAGGACTACAAAGACCCCATCGTGTGGTTCTAAAGGAGCCA | | | RPHRVVLKEPHYKTV |
| | | | | CATTACAAGACAGTAAACGGTGTTCGGAAACCGGACATCGTCATTAAAA | | | NGVRKPDIVIKIPDHT |
| | | | | TCCCCGACCACACATACATTTGTGATTTCCAAGTTGTATCTGATACCTCTT | | | YICDFQVVSDTSCLEL |
| | | | | GTTTAGAGTTGGAGTTCCGGAAGAAAGCCCTCAAGTATGCGGAGGACA | | | EFRKKALKYAEDKGL |
| | | | | AAGGCCTCTGCGATCAACTTACCCGCGACCATCCTGGGGAGCTCTCATT | | | CDQLTRDHPGELSFT |
| | | | | CACCGCAATTACTTTCAATACAAGAGGGCTTATAGCCAAGTCTTCAGTCA | | | AITFNTRGLIAKSSVT |
| | | | | CCGCCCTCCGGAAATTGGGGATGCCACCCAGATCTATCATGACCCTCCA | | | ALRKLGMPPRSIMTL |
| | | | | GAAAATATGTATGGAGGGTTCTCTGGAGATCTGGAGGATTTTTAACCAG | | | QKICMEGSLEIWRIF |
| | | | | ACTACTGCTATGGCCCGCAATTAGATGACTGCCCTACCCCTTTGCTGCCG | | | NQTTAMARN (SEQ |
| | | | | AAGAACTACTGAAGACTATTGAACTAACCAACTGTGTTAAGTAAGAACT | | | ID NO: 1482) |
| | | | | AATGCCTCTTTTTCCCTGCATGTATCCCCTGATCAGTGACTTATTTTCTTTT | | | |
| | | | | CCTGTTGCGCCCTTTGTTTAGTTATTTCCTTTAATTACTAGAATTATCTTTT | | | |
| | | | | CGTTCTCCGTCTAATTGCTTTTTCGGTGTAGGAACGGCTACCTAAAGCTG | | | |
| | | | | GAAGTGGGAAGTGTTTTCAATGTACTTTGTGATTATAGAAATATATGAC | | | |
| | | | | CCGAGGTGCATTGTTTGGCATTTCCTCGAGAAA (SEQ ID NO: 1114) | | | |
| R2 | R2_DAn | — | *Drosophila* | AGAATATGGATTTGATTGTGCAGAGGGGGTGCTATACCGTAACTCGTAA | AGAATATG | TAGCCA | FERRKDPWGYRPPG |
| | | | *ananassae* | GCCATGCAATCAGATCAAGTCGACTCAAAACCTCCTCGTGGTATTCTCTG | GATTTGAT | ATGCAC | TLKQIGATENNEPRN |
| | | | | GGTGCCAGTATTTACTGGTAGCTGATTTGAGCGGCGAAAGGATCCTTGG | TGTGCAGA | GGGTTC | LNRFVRGESTASSLES |
| | | | | GGTTACCGGCCCCCTGGAACCTTAAAACAAATTGGTGCAACTGAAAATA | GGGGGTG | CAGATT | TQFGTSAEVNLAGRV |
| | | | | ACGAGCCTCGGAACCTAAATCGTTTTGTAAGAGGAGAATCCACGGCTTC | CTATACCG | AAGCTT | PCTICEMTFSSKRGLG |
| | | | | CAGCCTGGAGAGCACACAATTTGGAACCAGTGCAGAGGTTAACCTTGCA | TAACTCGT | GCTGCC | VHMSHRHKDDLDA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGGAGGGTGCCCTGTACGATATGTGAAATGACGTTCAGCTCCAAGAGG | AAGCCATG | GAAGCA | QRLRVDKKARWSEE |
| | | | | GGTTTGGGCGTTCACATGTCACATCGGCACAAAGACGATCTTGATGCAC | CAATCAGA | TACCATC | ETLMMARKEVELAA |
| | | | | AACGTCTTCGTGTCGATAAAAAGGCAAGGTGGTCAGAGGAAGAAACCT | TCAAGTCG | AAAATC | SGVRFLNKKLAEIFTH |
| | | | | TGATGATGGCGAGAAAGGAGGTTGAGCTTGCAGCAAGTGGTGTACGAT | ACTCAAAA | GGCATA | RSADAISSYRKRSEYK |
| | | | | TTCTTAATAAGAAGCTAGCGGAGATTTTCACCCACCGCAGTGCCGATGC | CCTCCTCG | AAATTC | AKLEQIRGQSVPTPE |
| | | | | GATATCTTCGTATCGGAAGAGGAGTGAGTACAAGGCAAAACTAGAGCA | TGGTATTC | GCTTAAT | AEEINTTQRRPSNSE |
| | | | | GATAAGGGGGCAATCCGTTCCCACCCCAGAAGCAGAAGAAATCAACAC | TCTGGGTG | AAAGGA | QNRRVPRSEGGPIAP |
| | | | | CACACAGCGCCGCCCTAGTAATAGCGAGCAAAACCGACGAGTACCAAG | CCAGTATT | GGTGGT | TEQTNNEILRVLQGL |
| | | | | ATCAGAAGGGGGACCAATCGCACCAACCGAACAGACGAACAACGAAAT | TACTGGTA | TTTAGTA | APVVCLPRWRAEVL |
| | | | | CCTTAGGGTACTACAGGGTCTAGCACCTGTAGTATGCTTACCCCGGTGG | GCTGA | CGTAGG | QNIVDNAQVSGQET |
| | | | | AGAGCCGAGGTCCTGCAAAATATCGTAGATAATGCGCAGGTCTCGGGA | (SEQ ID | CGTCCC | TLQSLSSYLMEIFPPR |
| | | | | CAGGAAACCACTCTCCAAAGTTTATCCAGTTATCTCATGGAAATTTTTCC | NO: 1238) | GGGACT | NEPHILTRPRTEPRN |
| | | | | GCCACGGAATGAACCGCACATTCTGACGAGGCCCCGAACGGAGCCTCG | | TGTCTC | MRQRRRQQYARVQ |
| | | | | AAATATGAGACAACGTAGAAGGCAGCAGTACGCGAGGGTTCAGCGTAA | | GGGATG | RNWDKHPGRCIKSLL |
| | | | | CTGGGATAAACATCCGGGGCGATGCATAAAGTCCCTACTGGAGGAAGA | | AATCGT | EEDDESVMPNQEV |
| | | | | TGATGAGTCGGTGATGCCAAACCAGGAGGTCATGGAGCCATATTGGAG | | GCATGC | MEPYWRRVMTQPS |
| | | | | ACGGGTAATGACTCAGCCTAGCTCAAGCTCGATAAAACGCGACATGTTT | | GTATAA | SSSIKRDMFNMEHSL |
| | | | | AACATGGAGCATTCACTCGAGAGGGTATGGTCCGCTGTGAACCAGCGC | | TTGGGA | ERVWSAVNQRDLRA |
| | | | | GATCTTAGGGCCACAAAAGTCAAATTATCTAGTTCTCCAGGCCCGGACG | | TCGATA | TKVKLSSSPGPDGITP |
| | | | | GGATCACTCCAAAAACTGCCAGGAGTGTCCCCGAAGGCATTATGCTTCG | | ACAAAT | KTARSVPEGIMLRIM |
| | | | | CATAATGAACTTGATCCTCTGGTGCGGGAATTTGCCGTACTCTATCCGTC | | ACCAAC | NLILWCGNLPYSIRLA |
| | | | | TGGCCCGAACCATCTTCATTCCGAAGAAGGCGACGGCAAATCAACCGCA | | TAAGTT | RTIFIPKKATANQPQ |
| | | | | AGACTATCGTCCTATTTCAGTCCCCTCGGTTATAGTTAGGCAACTAAATG | | ATTACTA | DYRPISVPSVIVRQLN |
| | | | | CCATTTTGGCTTCCCGGTTGAGCGCAGCCATCAACTGGGACACGCGTCA | | ATATATC | AILASRLSAAINWDT |
| | | | | GCGAGGGTTCCTACCTACCGATGGGTGTGCTGATAATACGACGATTGTT | | GAAATA | RQRGFLPTDGCADN |
| | | | | GATTTAGTTTTGAGGGAACATCATAAGCGATTTAAATCGTGCTACATCG | | CATAAA | TTIVDLVLREHHKRFK |
| | | | | GGACCCTCGATGTTAGTAAGGCCTTTGATGCTGTAGCTCACGAAGCGGT | | TATCCCG | SCYIGTLDVSKAFDAV |
| | | | | CTACAACACATTGGCTTCATATGGTGCCCCGAAAGGCTTCATCAACTACT | | TCCTTAC | AHEAVYNTLASYGAP |
| | | | | TACGGAAGGCGTACGAGGGCGGCGGCACAATGCTCGCTGGGAACGGG | | GTATCTT | KGFINYLRKAYEGGG |
| | | | | TGGGTTTCAGAGGCGTTCATTCCTGCCCGAGGAGTGAAGCAGGGTGAC | | TGAAGA | TMLAGNGWVSEAFI |
| | | | | CCTCTGTCTCCCATACTATTCAACTTGGTCATTGACCGGTTGCTTAGGTCC | | TTTCCAT | PARGVKQGDPLSPIL |
| | | | | TTACCCAGTGAGATTGGTGCCAAAGTCGGAAATGCCATGACAAACGCA | | CCTCAG | FNLVIDRLLRSLPSEIG |
| | | | | GCAGCATTCGCAGATGATATAGTCCTTTTTGCGGAAACTCCGATGGGGC | | CGAACA | AKVGNAMTNAAAFA |
| | | | | TTCAGAAATTGTTGGACACCACCGTTTGTTTCCTTTCCTCGGTGGGTCTC | | AAAAAA | DDIVLFAETPMGLQK |
| | | | | ACCCTTAATACTGATAAATGTTTCACGGTCAGTATTAAGGGGCAAGCCA | | AAAAAA | LLDTTVCFLSSVGLTL |
| | | | | AACAAAAGTGTACCGTCGTCGAACGGCGAAGCTTCTTGATTGGCGGGC | | A (SEQ | NTDKCFTVSIKGQAK |
| | | | | GCGAGTGTCCTTCATTGAAGCGTACTGACGAGTGGAAGTACTTAGGGAT | | ID NO: | QKCTVVERRSFLIGG |
| | | | | TAAATTCACTGCGGAGGGGCGGGCCCGGTACGATCCAGCAGAGGACCT | | 1361) | RECPSLKRTDEWKYL |
| | | | | CGGTCCAAAGCTGTTGAGATTGACTCGGGCCCCCCTGAAACCACAACAG | | | GIKFTAEGRARYDPA |
| | | | | AAGTTATTTGCCCTTCGGACCGTCCTTATCCCACAACTCTATCACAAGCT | | | EDLGPKLLRLTRAPLK |
| | | | | GACCCTTGGGAGTGTGACGATAGGCGTTCTGAAGAAATTTGACAAATTA | | | PQQKLFALRTVLIPQL |
| | | | | GTTCGATATACCGCACGGAAGTGGTTGGGGCTTCCGGTGGACGTACCA | | | YHKLTLGSVTIGVLKK |
| | | | | GTTTCTTTTTTCCATGCCCCCCACAAGAGTGGGGGTCTCGGGTTACCATC | | | FDKLVRYTARKWLGL |
| | | | | TCTAAGATGGACAGCACCAATGCTTCGACTAAAGCGATTGAGCAACATA | | | PVDVPVSFFHAPHKS |
| | | | | AAATGGCCTCACCTCGAGCGATCCGAGGTAGCCAGCTCTTTCGTGGAGG | | | GGLGLPSLRWTAPM |
| | | | | AAGAAATGCGGAGGGCCCGGGATAGGCTTCAGGCTGGAAGTGAAGAA | | | LRLKRLSNIKWPHLER |
| | | | | CTGTTAACCCGTTCGCAGGTAGATTCGTACTTGGCAAATAGATTGCACAT | | | SEVASSFVEEEMRRA |
| | | | | GTCTGTTGATGGTTGCGGGCTCCGTGAAGCAGAGCGTTTTGCTCCGCAA | | | RDRLQAGSEELLTRS |
| | | | | CACGGGTGGGTTAGTCAGCCCACGCGTTTGCTAACAGGAAAGGAATAT | | | QVDSYLANRLHMSV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACTGATGGAATCAAACTGCGGATAAATGCCCTACCCTCAAGGTCTCGTA | | | DGCGLREAERFAPQ |
| | | | | CTACGAGGGGAAGGCACGAATTGGAGAGACGGTGCCGTGCAGGATGT | | | HGWVSQPTRLLTGK |
| | | | | GATGCTCCCGAAACAACAAATCACATCTTGCAGCAATGCTATAGAACTC | | | EYTDGIKLRINALPSR |
| | | | | ACGGGAGGAGGATAGCTCGGCACAACGGCGTAGTAAATTTTCTCAAGC | | | SRTTRGRHELERRCR |
| | | | | GGGGACTTGAGCGAAGAGGCTGCGTCGTTCATGTTGAACCAAGTCTGC | | | AGCDAPETTNHILQQ |
| | | | | AGGGCGAAACCGGACTGAATAAACCTGACCTGGTGGCTATCCGACAAA | | | CYRTHGRRIARHNGV |
| | | | | ATCGCATTTATGTGATTGACACTCAGATTGTGACTGACGGACATTCTCTC | | | VNFLKRGLERRGCVV |
| | | | | GACCAAGCGCACCAGCGTAAGGTCGGGAAGTACGATACACCGGACATA | | | HVEPSLQGETGLNKP |
| | | | | CGGACGAATTTGCGGAGATCTTTCGGTGCCTTTGACATTGAGTTCCATTC | | | DLVAIRQNRIYVIDTQ |
| | | | | CGCCACTGTGAACTGGAGGGGAATATGGAGTGGTCAATCAGTAAAACG | | | IVTDGHSLDQAHQRK |
| | | | | GTTGATCGCTTCAGACCTCCTCAGCTCTGGTGATAGCAATATCATCAGTG | | | VGKYDTPDIRTNLRR |
| | | | | TCCGGGTAATCAGTGGTGGTCTCTGGAGCTGGCGGCAGTTCATGTATCT | | | SFGAFDIEFHSATVN |
| | | | | GTCGGGGTACACTCGCGATTGGACTTAGCCAATGCACGGGTTCCAGATT | | | WRGIWSGQSVKRLI |
| | | | | AAGCTTGCTGCCGAAGCATACCATCAAAATCGGCATAAAATTCGCTTAA | | | ASDLLSSGDSNIISVR |
| | | | | TAAAGGAGGTGGTTTTAGTACGTAGGCGTCCCGGGACTTGTCTCGGGAT | | | VISGGLWSWRQFMY |
| | | | | GAATCGTGCATGCGTATAATTGGGATCGATAACAAATACCAACTAAGTT | | | LSGYTRDWT (SEQ ID |
| | | | | ATTACTAATATATCGAAATACATAAATATCCCGTCCTTACGTATCTTTGAA | | | NO: 1483) |
| | | | | GATTTCCATCCTCAGCGAACAAAAAAAAAAAAA (SEQ ID NO: 1115) | | | |
| R2 | R2_DM | X51967 | *Drosophila melanogaster* | TTGGGGATCATGGGGTATTTGAGAGCAGAGGGGGAGTATTCTTCTGTA | TTGGGGAT | TAGCTA | MTTRPSVDIFPEDQY |
| | | | | ATTCGTAAGTCATATCATATGATGTGCGGAAGGGGAATTTTACTCTGTA | CATGGGGT | AATCGTT | EPNAAATLSRVPCTV |
| | | | | ACTCACAAGTCTCTCCTTTACTCAAGTCGACTCAAAACCTCCTCGTGGTG | ATTTGAGA | TGGTTC | CGRSFNSKRGLGVH |
| | | | | GTCCCGGTAATGCTAAACTCGTTTAGCAGCTAATTTGAGCGGAAAAACT | GCAGAGG | AAAACA | MRSRHPDELDEERRR |
| | | | | TTTCCGATGGGCTGGTTCCCCAGAGGAAATTTATTCATATTGGAACTACA | GGGAGTAT | TTTGCTT | VDIKARWSDEEKWM |
| | | | | AGCACAAATAACGAGCCTCGGATACCTTTACACAATCTGATGACGACCC | TCTTCTGT | GCTGTC | MARKEVELTANGCK |
| | | | | GACCCTCCGTGGATATCTTCCCGGAGGACCAATATGAACCAAACGCAGC | AATTCGTA | TTGGCA | HINKQLAVYFANRSV |
| | | | | GGCTACTCTATCTAGGGTTCCCTGCACAGTATGTGGCCGGTCCTTTAACA | AGTCATAT | TAACATC | EAIKKLRQRGDYKEKI |
| | | | | GCAAGAGAGGACTCGGTGTTCACATGCGATCTCGGCACCCAGACGAAC | CATATGAT | AATAAA | EQIRGQSALAPEVAN |
| | | | | TTGATGAAGAACGTCGACGTGTCGATATAAAGGCAAGATGGAGTGATG | GTGCGGA | GGCATA | LTIRRRPSRSEQDHQ |
| | | | | AAGAGAAGTGGATGATGGCGAGAAAGGAGGTTGAGCTCACAGCAAAT | AGGGGAA | AACATC | VTTSETTPITPFEQSN |
| | | | | GGATGTAAACACATAAACAAGCAACTAGCGGTGTATTTTGCAAACCGCA | TTTTACTCT | GCAAAA | REILRTLRGYSPVECH |
| | | | | GCGTCGAAGCCATCAAAAAGCTAAGACAGAGGGGCGATTATAAGGAGA | GTAACTCA | TAATGG | SKWRAQELQTIIDRA |
| | | | | AAATAGAGCAGATAAGAGGGCAATCAGCTCTCGCCCCGGAAGTTGCTA | CAAGTCTC | TTATAAT | HLEGKETTLQCLSLYL |
| | | | | ATCTAACCATAAGGCGCCGCCCTAGTAGAAGTGAGCAAGACCACCAAGT | TCCTTTACT | TAAATG | LGIFPAQGVRHTLTR |
| | | | | AACAACATCGGAAACAACTCCAATCACTCCCTTCGAACAGTCGAACAGG | CAAGTCGA | GCTATG | PPRRPRNRRESRRQQ |
| | | | | GAAATTTTGCGGACACTACGCGGGTATAGCCCCGTAGAATGCCATTCCA | CTCAAAAC | AGGATG | YAVVQRNWDKHKG |
| | | | | AATGGAGAGCCCAAGAGTTGCAAACTATCATTGATAGGGCACATCTCGA | CTCCTCGT | GTTTTAG | RCIKSLLNGTDESVM |
| | | | | GGGAAAGGAAACCACTCTCCAATGCTTATCGCTATATCTCCTGGGAATTT | GGTGGTCC | TACGTA | PSQEIMVPYWREVM |
| | | | | TTCCGGCACAGGGTGTACGACACACACTGACGAGACCTCCTCGGAGACC | CGGTAATG | GGCGTT | TQPSPSSCSGEVIQM |
| | | | | TCGGAACAGGAGAGAAAGCAGAAGGCAGCAGTACGCTGTCGTCCAGC | CTAAACTC | GCGGAA | DHSLERVWSAITEQD |
| | | | | GTAACTGGGATAAGCATAAAGGAAGATGCATCAAGTCCTTGCTAAATG | GTTTAGCA | CTTCGG | LRASRVSLSSSPGPDG |
| | | | | GAACTGATGAGTCGGTAATGCCAAGCCAAGAAATAATGGTTCCCTACTG | GCTAATTT | TTCATAT | ITPKSAREVPSGIMLR |
| | | | | GAGAGAAGTAATGACTCAGCCTAGCCCAAGCTCTTGCAGTGGAGAAGT | GAGCGGA | AGAGCA | IMNLILWCGNLPHSI |
| | | | | GATACAAATGGATCACTCGCTTGAGAGGGTATGGTCTGCTATTACAGAG | AAAACTTT | ATGAAT | RLARTVFIPKTVTAKR |
| | | | | CAGGACCTTCGGGCGTCAAGAGTCTCATTATCCTCGTCTCCGGGGCCTG | TCCGATGG | CGTGCA | PQDFRPISVPSVLVR |
| | | | | ACGGGATAACTCCAAAATCTGCCAGGGAGGTGCCGTCAGGTATTATGCT | GCTGGTTC | TGCTAG | QLNAILATRLNSSIN |
| | | | | GCGCATAATGAACCTAATTCTATGGTGCGGTAATCTACCACACTCCATAC | CCCAGAGG | GAAAAC | WDPRQRGFLPTDGC |
| | | | | GACTGGCCAGAACCGTCTTCATCCCGAAGACGGTGACGGCGAAGCGAC | AAATTTAT | TGACCA | ADNATIVDLVLRHSH |
| | | | | CGCAAGACTTTCGTCCAATATCAGTGCCTTCAGTCCTGGTAAGACAGCTA | TCATATTG | CACACA | KHFRSCYIANLDVSKA |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AATGCAATATTGGCAACCCGGTTGAACTCATCAATCAATTGGGACCCGC<br>GCCAGCGGGGCTTCTTACCAACCGACGGATGCGCCGATAATGCGACGA<br>TAGTCGACTTAGTCTTGAGGCATAGCCATAAGCACTTTAGATCTTGCTAC<br>ATCGCAAATTTAGATGTAAGCAAGGCATTTGATTCTCTATCACATGCATC<br>TATATACGACACCTTACGTGCTTATGGTGCGCCAAAGGGCTTCGTTGACT<br>ACGTACAGAACACGTACGAGGGCGGTGGTACCAGTCTCAATGGGGACG<br>GTTGGAGTTCAGAGGAATTCGTCCCTGCTAGAGGAGTGAAGCAGGGTG<br>ACCCTTTGTCTCCTATTCTATTTAACTTGGTAATGGACAGGTTACTTAGAA<br>CCTTACCCAGCGAAATTGGTGCCAAAGTCGGAAATGCCATTACTAACGC<br>GGCCGCGTTTGCAGATGATTTGGTACTATTTGCGGAAACTCGGATGGGG<br>CTTCAAGTATTGTTGGACAAGACGTTGGATTTTCTATCTATCGTCGGCCT<br>CAAACTTAATGCCGACAAATGTTTTACCGTTGGCATTAAGGGCCAGCCG<br>AAACAGAAGTGTACCGTGTTAGAGGCACAGAGCTTCTACGTAGGCTCG<br>AGTGAGATTCCATCACTGAAGCGCACGGACGAGTGGAAGTACTTAGGC<br>ATCAACTTCACTGCAACCGGGAGGGTTCGATGCAATCCGGCCGAGGAC<br>ATTGGTCCAAAGCTACAAAGATTGACAAAGGCCCCCCTCAAACCACAAC<br>AGAGGTTGTTCGCCCTTCGGACTGTCCTTATCCCACAGCTCTACCACAAG<br>TTAGCCCTTGGGAGTGTGGCGATAGGCGTCCTAAGAAAAACTGATAAA<br>CTTATAAGATATTATGTGCGAAGATGGCTAAATCTTCCGCTGGATGTGC<br>CGATAGCATTTGTTCATGCACCCCCAAAAAGTGGAGGTCTCGGAATTCC<br>ATCACTAAGATGGGTAGCTCCAATGTTAAGGCTAAGACGCTTGAGTAAC<br>ATTAAATGGCCTCACCTCACGCAAAACGAGGTAGCCAGCTCTTTCCTCG<br>AAGCCGAAAAACAACGGGCCCGAGATAGATTATTAGCTGAACAAAATG<br>AACTGTTATCGCGTCCGGCAATAGAAAAATATTGGGCGAACAAGTTGTA<br>CCTCTCAGTTGATGGTAGCGGACTCCGTGAAGGCGGCCATTATGGCCCG<br>CAACACGGGTGGGTTAGTCAACCCACGCGTTTATTAACAGGAAAGGAAT<br>ATATGGACGGTATTCGTCTGCGGATAAATGCCCTACCCACAAAGTCTCG<br>TACTACAAGGGGAAGGCACGAATTGGAACGACAGTGTCGTGCAGGATG<br>TGATGCTCCCGAAACAACAAACCACATAATGCAAAAATGCTACCGCTCG<br>CATGGGAGGCGGGTAGCTAGACACAACTGCGTAGTAAATCGAATCAAG<br>CGGGGACTTGAGGAGAGAGGCTGCGTGGTCATTGTTGAACCAAGTCTG<br>CAGTGCGAATCCGGCCTTAATAAACCAGACCTGGTGGCACTACGACAAA<br>ATCACATTGATGTGATCGACACACAAATTGTGACAGACGGACACTCTAT<br>GGATGATGCGCACCAGCGCAAAATCAATAGATACGACAGACCGGACAT<br>ACGAACTGAATTGCGTCGCAGATTCGAAGCCGCAGGTGACATTGAATTC<br>CATTCTGCCACCCTGAACTGGAGGGGGATCTGGAGTGGTCAATCCGTTA<br>AAAGATTGATAGCAAAGGGTCTCCTCAGCAAATATGATAGTCATATCAT<br>TAGCGTCCAGGTTATGAGAGGCAGTCTCGGTTGTTTTAAACAGTTCATG<br>TACCTGAGCGGGTTTTCCCGAGATTGGACTTAGCTAAATCGTTTGGTTCA<br>AAACATTTGCTTGCTGTCTTGGCATAACATCAATAAAGGCATAAACATCG<br>CAAAATAATGGTTATAATTAAATGGCTATGAGGATGGTTTTAGTACGTA<br>GGCGTTGCGGAACTTCGGTTCATATAGAGCAATGAATCGTGCATGCTAG<br>GAAAACTGACCACACACAGTGTTGGCAGACCTAGTATCTTTCGAAGATT<br>TCCATACCTCCGCGATCAAAAAAAAAAAAAAAAAAAAA (SEQ ID NO:<br>1116) | GAACTACA<br>AGCACAAA<br>TAACGAGC<br>CTCGGATA<br>CCTTTACA<br>CAATCTG<br>(SEQ ID<br>NO: 1239) | GTGTTG<br>GCAGAC<br>CTAGTAT<br>CTTTCGA<br>AGATTTC<br>CATACCT<br>CCGCGA<br>TCAAAA<br>AAAAAA<br>AAAAAA<br>AAAAAA<br>(SEQ ID<br>NO:<br>1362) | FDSLSHASIYDTLRAY<br>GAPKGFVDYVQNTY<br>EGGGTSLNGDGWSS<br>EEFVPARGVKQGDPL<br>SPILFNLVMDRLLRTL<br>PSEIGAKVGNAITNA<br>AAFADDLVLFAETRM<br>GLQVLLDKTLDFLSIV<br>GLKLNADKCFTVGIK<br>GQPKQKCTVLEAQSF<br>YVGSSEIPSLKRTDEW<br>KYLGINFTATGRVRC<br>NPAEDIGPKLQRLTK<br>APLKPQQRLFALRTV<br>LIPQLYHKLALGSVAI<br>GVLRKTDKLIRYYVRR<br>WLNLPLDVPIAFVHA<br>PPKSGGLGIPSLRWV<br>APMLRLRRLSNIKWP<br>HLTQNEVASSFLEAE<br>KQRARDRLLAEQNEL<br>LSRPAIEKYWANKLYL<br>SVDGSGLREGGHYG<br>PQHGWVSQPTRLLT<br>GKEYMDGIRLRINAL<br>PTKSRTTRGRHELER<br>QCRAGCDAPETTNHI<br>MQKCYRSHGRRVAR<br>HNCVVNRIKRGLEER<br>GCVVIVEPSLQCESGL<br>NKPDLVALRQNHIDV<br>IDTQIVTDGHSMDD<br>AHQRKINRYDRPDIR<br>TELRRRFEAAGDIEFH<br>SATLNWRGIWSGQS<br>VKRLIAKGLLSKYDSHI<br>ISVQVMRGSLGCFKQ<br>FMYLSGFSRDWT<br>(SEQ ID NO: 1484) |
| R2 | R2_DPe | — | *Drosophila persimilis* | AAGATATGGATCTGAATAATAGCGTAGAAGGGGAGTCATTCCGTAATTC<br>GTAAATCGTAAAAATCAGATCAAGTTGATTCAAGACCTCCTCGTGGTAT<br>CTTCTGGATGCTATTAGACTGAAGTTCTTTTGGTCTAATAGTAACTAACT | AAGATATG<br>GATCTGAA<br>TAATAGCG | TAGCCT<br>ATACACT<br>ATGTTG | SSFGLIVTNLNSETVL<br>WGCQPLGQFSLIGT<br>NMQNTTPRIINTNSL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGAACAGCGAAACAGTCCTATGGGGTTGCCAGCCCCTTGGACAGTTCAG | TAGAAGG | GAGAGA | TNQIPTVSSLGAQSE |
| | | | | TTTGATTGGCACTAATATGCAAAATACAACGCCTCGGATAATAAACACTA | GGAGTCAT | AGACGC | HSAQVNPNSGYQCTI |
| | | | | ATTCGTTGACGAACCAAATCCCTACGGTCTCTAGCCTAGGGGCCCAATCT | TCCGTAAT | TTGCTAC | CESSFRSKSGLGVHM |
| | | | | GAACATAGTGCACAGGTTAACCCAAACAGTGGTTACCAATGCACGATAT | TCGTAAAT | CTAGGC | SRRHKDEFDQLRLRT |
| | | | | GTGAATCGTCTTTCCGTAGCAAAAGCGGACTAGGCGTTCACATGTCACG | CGTAAAAA | AAAATG | DRKAQWSEEELSM |
| | | | | TCGGCACAAGGACGAGTTTGATCAACTTCGTCTGCGTACCGACCGTAAG | TCAGATCA | TGAAAT | MARKEIELAANGERY |
| | | | | GCACAATGGAGTGAGGAAGAGTTGAGTATGATGGCAAGAAAAGAGAT | AGTTGATT | TAGGTA | LNKKLAEVFTNRSVD |
| | | | | CGAGCTCGCAGCAAATGGAGAAAGATATCTAAATAAGAAGCTAGCGGA | CAAGACCT | TAAACA | AIKKCRQRERYKTKIE |
| | | | | AGTATTTACGAACCGTAGCGTCGACGCTATCAAGAAATGTCGACAGAGG | CCTCGTGG | TCGTGG | QLKGQAVPLPEALES |
| | | | | GAGAGATATAAGACCAAAATCGAACAGCTAAAGGGTCAAGCTGTTCCTC | TATCTTCT | TTGTAA | ETIQRRPSIRERDLLV |
| | | | | TCCCAGAAGCATTAGAATCTGAAACCATACAGCGCCGCCCTAGTATACG | GGATGCTA | AACTTG | TPPNTLGTTPTELSNS |
| | | | | CGAGCGAGATCTCCTAGTAACGCCACCTAACACTCTCGGAACCACTCCA | TTAGACTG | AGGTGG | EILAVLQGYPPVVCN |
| | | | | ACCGAACTGTCGAACAGTGAAATCCTGGCAGTACTACAGGGGTACCCAC | A (SEQ ID | GTTTTTA | DQWRVEVLQSIVDG |
| | | | | CTGTAGTATGCAATGACCAATGGAGAGTTGAGGTTTTGCAATCCATCGT | NO: 1240) | GTACGT | AQASGKEITLQRLSTY |
| | | | | AGATGGTGCGCAGGCCTCGGGTAAGGAAATTACTCTTCAGCGCTTGTCT | | ATGCGT | LMEVFPSQNDRPIQT |
| | | | | ACTTACCTTATGGAAGTATTTCCCTCACAGAATGACCGCCCCATTCAAAC | | GATTACT | RPPRRPRNRRQGRR |
| | | | | GAGACCTCCACGGAGACCTCGTAATAGGAGACAAGGTAGGAGACAGCA | | TCGTAAT | QQYALTQRNWDKH |
| | | | | GTACGCCTTAACACAGCGTAACTGGGACAAGCACAAAGGTCGTTGTATA | | CATGAA | KGRCIKAILDGTEGTA |
| | | | | AAAGCCATTTTGGATGGAACTGAGGGGACAGCAACTATGCCAAGTCAA | | TCGTGC | TMPSQGIMGSYWR |
| | | | | GGTATCATGGGGTCCTATTGGAGACAAGTCATGACACAAACAAGCCCAA | | ATGCTA | QVMTQTSPTYSGTN |
| | | | | CATATAGTGGTACGAACACCACGTTCCGGACGGAACACCCACTTGAAGG | | GTGGGG | TTFRTEHPLEGVWSP |
| | | | | GGTTTGGTCCCCGATAACACTAGGGGACCTAAGGGTACACAGAGTGTC | | TTTGGC | ITLGDLRVHRVSLTKS |
| | | | | ATTGACGAAATCTCCAGGACCTGATGGAATTACTCCAAGAACTGTCAGG | | CTCCACT | PGPDGITPRTVRSIPS |
| | | | | AGTATTCCGTCAGGAGTTATGCTTCGCATAATGAACCTGATACTTTGGTG | | AGTATCT | GVMLRIMNLILWCG |
| | | | | CGGAAAGTTGCCTGTCTCCATCCGACAGGCACGAACCATCTTCATTCCG | | TTGAAG | KLPVSIRQARTIFIPKV |
| | | | | AAGGTGGGGAATGCTTCTCGACCGCAAGACTTTCGTCCAATTACGGTAC | | ATTTTCC | GNASRPQDFRPITVQ |
| | | | | AATCTGTTATGGTAAGGATTTTAAATGCCATTTTGGCTTCCCGGTTGACC | | TTCCTCA | SVMVRILNAILASRLT |
| | | | | TCATCAGTCGACTGGGATCCGCGTCAGCGAGGTTTCCTTCCAACCGACG | | GCGATC | SSVDWDPRQRGFLP |
| | | | | GATGTGCCGATAATACGACGATAGTCGACTTAATCTTAAGGGATCACCA | | AAAAAA | TDGCADNTTIVDLILR |
| | | | | TAAACGTTGTAAATCACTTTATATCGCAACTTTAGATATAAGCAAAGCAT | | AA (SEQ | DHHKRCKSLYIATLDI |
| | | | | TTGACTCGGTGTCTCATGCAGCAGTTAGCGCCACTCTAACTGCATATGGT | | ID NO: | SKAFDSVSHAAVSAT |
| | | | | GCCCCTAAAGAATTCGTTGACTACGTACAAAATTCGTACGAGGTCTGTG | | 1363) | LTAYGAPKEFVDYVQ |
| | | | | GCACAACGCTCAATGGGGACGGATGGAGATCAGAGGAATTCATACCTG | | | NSYEVCGTTLNGDG |
| | | | | CTCGAGGTGTCAGACAGGGTGACCCGCTATCTCCCATAATATTCAACTT | | | WRSEEFIPARGVRQG |
| | | | | GATCATCGATCAGTTGCTTAGGTCCTACCCCAATGAGATTGGTGCCACA | | | DPLSPIIFNLIIDQLLRS |
| | | | | ATCGGTGATCACACAACAAACGCGGCCGCGTTCGCAGATGATATTGTCT | | | YPNEIGATIGDHTTN |
| | | | | TATTTGCGGAAACTCGTTTAGGCCTTCAAACAATGCTAGACACGACTGTC | | | AAAFADDIVLFAETRL |
| | | | | GATTTTCTATCTTCAGTCGGGCTTACCCTTAACTCGGATAAATGTTTTACA | | | GLQTMLDTTVDFLSS |
| | | | | GTTGGAATAAAGGGGCAACCGAAACAGAAGTGTACTGTGGTCATCCCA | | | VGLTLNSDKCFTVGIK |
| | | | | GAGACCTTCCGTATCGGTTCGCGCTCGTGTCCTGCATTGAAGCGCACAG | | | GQPKQKCTVVIPETF |
| | | | | ACGAGTGGAAGTATTTAGGCATAACATTCACTGCACAAGGGAGGACCA | | | RIGSRSCPALKRTDE |
| | | | | GGTACAGTCCAGCCGACGACCTAGGTCCGAAGCTGTTGAGGCTGACAA | | | WKYLGITFTAQGRTR |
| | | | | GGTCCCCCCTAAAACCACAACAGAAATTGTTCGCACTCAGAACAGTTCTT | | | YSPADDLGPKLLRLTR |
| | | | | ATCCCACAACTTTACCATAAGCTGACCCTAGGTAGTGTGATGATAGGTG | | | SPLKPQQKLFALRTVL |
| | | | | TTCTGAGAAAGTGTGACATACTGGTACGTTCGACCGTAAGGAAGTGGTT | | | IPQLYHKLTLGSVMIG |
| | | | | AGGGCTTCCTCTGGACGTGTCAACTGCATTCTTCCATGCTCCTCATACTT | | | VLRKCDILVRSTVRK |
| | | | | ATGGGGGCCTCGGAATCCCTTCAGTTCGTTGGGTAGCGCCAATGCTACG | | | WLGLPLDVSTAFFHA |
| | | | | TATGAAAAGATTGAGCAATATTAAGTGGGCCCACCTCGCGCAATCCGAG | | | PHTYGGLGIPSVRWV |
| | | | | GCGGCCAGCTCATTTCTTACCGACGAATTGAATAAGGCCCGGGGTAGAA | | | APMLRMKRLSNIKW |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTCTGGCTGGACTGAATGAGTTGACATCGCGTACAGAGATCGAAACGTA<br>CTGGGCGAACAGGTTGTATATGTCTGTTGATGGTCGCGGCTTACGTGAA<br>GCGGGACTTTTTCGTCCCCAACACGGCTGGGTGTGTCAGCCCACGCGTT<br>TGCTAACAGGTCAAGATTACCGAAACAGTATCAAGCTGCGAATAAATGC<br>CCTACCATCGAGGTCTCGTACCACGAGGGGCAGAAATGAATTGGAACG<br>GCAATGTCGTGCAGGTTGTGATGCTCCCGAAACAACAAACCACATCCTG<br>CAGAATTGTTACCGTACGCATGGGAGGCGGGTAGCAAGACATAACTGT<br>GTAGTCAATAACCTTAAGAGGATTCTTGAGGAGAAGGGCCACACAGTA<br>CACGTCGAACCAAGTTTGCAGCTGGAAACCTCGGTAAGTAAACCAGACC<br>TGGTGTGTATCCGTGACAATCACGCTTGCGTGATTGATGCGCAGATTAT<br>AACGGATGGACTGTTTCTCGACGATGTGCACCATCGCAAAGTTGAGAAA<br>TATAAAAGACCGGAAGTTATATCTGCACTGCGGAGAGAATTCGGAGTG<br>TCGGGCAACGTCGAAGTCCTATCCGCGACGTTAAACTGGCGTGGGATCT<br>GGAGCAATCAATCCGTTAGAAGATTGATAGCAAAGGGTCTCATCTCATC<br>CGGTGACAGCAATGTCATTAGCGCCAGAGTGGTAACAGGCGGACTATA<br>TTGCTTCAGACAGTTCATGTATCTCGCAGGTTACACTCGAGATTGGACTT<br>AGCCTATACACTATGTTGGAGAGAAGACGCTTGCTACCTAGGCAAAATG<br>TGAAATTAGGTATAAACATCGTGGTTGTAAAACTTGAGGTGGGTTTTTA<br>GTACGTATGCGTGATTACTTCGTAATCATGAATCGTGCATGCTAGTGGG<br>GTTTGGCCTCCACTAGTATCTTTGAAGATTTTCCTTCCTCAGCGATCAAA<br>AAAAA (SEQ ID NO: 1117) | | | AHLAQSEAASSFLTD<br>ELNKARGRTLAGLNE<br>LTSRTEIETYWANRLY<br>MSVDGRGLREAGLF<br>RPQHGWVCQPTRLL<br>TGQDYRNSIKLRINAL<br>PSRSRTTRGRNELER<br>QCRAGCDAPETTNHI<br>LQNCYRTHGRRVAR<br>HNCVVNNLKRILEEK<br>GHTVHVEPSLQLETS<br>VSKPDLVCIRDNHAC<br>VIDAQIITDGLFLDDV<br>HHRKVEKYKRPEVIS<br>ALRREFGVSGNVEVL<br>SATLNWRGIWSNQS<br>VRRLIAKGLISSGDSN<br>VISARVVTGGLYCFR<br>QFMYLAGYTRDWT<br>(SEQ ID NO: 1485) |
| R2 | R2_DPs | — | *Drosophila pseudoobscura* | CAATTGGAAAGATATGGGTCTGAATAATAGCGTAGAAGGGGAGTCATT<br>CCGTAATTCGTAAATCGTAAAAATCAGATCAAGTTGATTCAAGACCTCCT<br>CGTGGTATCTTCTGGATGCTATTAGACTGAAGTTCTTTTGGTCTAATAGT<br>AACTAACTTGAACAGCGAAACAGTCCTATGGGGCTGCCAGCCCCTTGGA<br>CAGTTCAGTTTGATTGGCACTAATATGCAAAATACAACGCCTCGGATAA<br>TAAACACTAATTCGTTGACGAACCAAATCCCTACGGTCTCTAGCCTAGG<br>GGCCCAATCTGAACATAGTGCACAGGTTAACCCAAACAGTGGTTACCAA<br>TGCACGATATGTGAATCGTCTTTCCGTAGCAAAAGCGGACTAGGCGTTC<br>ACATGTCACGTCGGCACAAGGACGAGTTTGATCAACTTCGTCTGCGTAC<br>CGACCGTAAGGCACAATGGAGTGAGGAAGAGTTGAGTATGATGGCAA<br>GAAAAGAGATCGAGCTCGCAGCAAATGGAGAAAGATATCTAAATAAGA<br>AGCTAGCGGAAGTATTTACGAACCGTAGCGTCGACGCTATCAAGAAATG<br>TCGACAGAGGGAGAGATATAAGACCAAAATCGAACAGCTAAAGGGTCA<br>AGCTGTTCCTCTCCCAGAAGCATTAGAATCTGAAACCATACAGCGCCGC<br>CCTAGTATACGCGAGCGAGATCTCCTAGTAACGCCACCTAACACTCTCG<br>GAACCACTCCAACCGAACTGTCGAACAGGGAAATCCTGGCAGTACTACA<br>GGGGTACCCACCTGTAGTATGCAATGACCAATGGAGAGTTGAGGTTTTG<br>CAATCCATCGTAGATGGTGCGCAGGCCTCGGGTAAGGAAATTACTCTTC<br>AGCGCTTGTCTACTTACCTTATGGAAGTATTTCCCTCACAGAATGACCGC<br>CCCATTCAAACGAGACCTCCACGGAGACCTCGTAATAGGAGACAAGGTA<br>GGAGACAGCAGTACGCCTTAACACAGCGTAACTGGGACAAGCACAAAG<br>GTCGTTGTATAAAAGCCATTTTGGATGGAACTGAGGGGACAGCAACTAT<br>GCCAAGTCAAGGTATCATGGGGTCCTATTGGAGACAAGTCATGACACAA<br>ACAAGCCCAACATATAGTGGTACGAACACCACGTTCCGGACGGAACACC<br>CACTTGAAGGGGTTTGGTCCCCGATAACACTAGGGGACCTAAGGTAC<br>ACAGAGTGTCATTGACGAAATCTCCAGGACCTGATGGGATTACTCCAAG<br>AACTGTCAGGAGTATTCCGTCAGGAGTTATGCTTCGCATAATGAACCTG | CAATTGGA<br>AAGATATG<br>GGTCTGAA<br>TAATAGCG<br>TAGAAGG<br>GGAGTCAT<br>TCCGTAAT<br>TCGTAAAT<br>CGTAAAAA<br>TCAGATCA<br>AGTTGATT<br>CAAGACCT<br>CCTCGTGG<br>TATCTTCT<br>GGATGCTA<br>TTAGACTG<br>A (SEQ ID<br>NO: 1241) | TAGCCT<br>ATACACT<br>ATGTTG<br>GAGAGA<br>AGACGC<br>TTGCTAC<br>CTAGGC<br>ATAATG<br>TGAAAT<br>TAGGTA<br>TAAACA<br>TCGTGG<br>TTGTAA<br>AACTTG<br>AGGTGG<br>GTTTTTA<br>GTACGT<br>ATGCGT<br>GATTACT<br>TCGTAAT<br>CATGAA<br>TCGTGC<br>ATGCTA<br>GTGGGG<br>TTTGGC<br>CTCCACT<br>AGTATCT | SSFGLIVTNLNSETVL<br>WGCQPLGQFSLIGT<br>NMQNTTPRIINTNSL<br>TNQIPTVSSLGAQSE<br>HSAQVNPNSGYQCTI<br>CESSFRSKSGLGVHM<br>SRRHKDEFDQLRLRT<br>DRKAQWSEEELSM<br>MARKEIELAANGERY<br>LNKKLAEVFTNRSVD<br>AIKKCRQRERYKTKIE<br>QLKGQAVPLPEALES<br>ETIQRRPSIRERDLLV<br>TPPNTLGTTPTELSNR<br>EILAVLQGYPPVVCN<br>DQWRVEVLQSIVDG<br>AQASGKEITLQRLSTY<br>LMEVFPSQNDRPIQT<br>RPPRRPRNRRQGRR<br>QQYALTQRNWDKH<br>KGRCIKAILDGTEGTA<br>TMPSQGIMGSYWR<br>QVMTQTSPTYSGTN<br>TTFRTEHPLEGVWSP<br>ITLGDLRVHRVSLTKS<br>PGPDGITPRTVRSIPS<br>GVMLRIMNLILWCG |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATACTTTGGTGCGGAAAGTTGCCTGTCTCCATCCGACAGGCACGAACCA<br>TCTTCATTCCGAAGGTGGGGAATGCTTCTCGACCGCAAGACTTTCGTCCA<br>ATTACGGTACAATCTGTTATGGTAAGGATTTTAAATGCCATTTTGGCTTC<br>CCGGTTGACCTCATCAGTCGACTGGGATCCGCGTCAGCGAGGTTTCCTT<br>CCAACCGACGGATGTGCCGATAATACGACGATAGTCGACTTAATCTTAA<br>GGGATCACCATAAACGTTGTAAATCACTTTATATCGCAACTTTAGATATA<br>AGCAAAGCATTTGACTCGGTGTCTCATGCAGCAGTTAGCGCCACTCTAA<br>CTGCATATGGTGCCCCTAAAGAATTCGTTGACTACGTACAAAATTCGTAC<br>GAGGTCTGTGGCACAACGCTCAATGGGGACGGATGGAGATCAGAGGA<br>ATTCATACCTGCTCGAGGTGTCAGACAGGGTGACCCGCTATCTCCCATA<br>ATATTCAACTTGATCATCGATCAGTTGCTTAGGTCCTACCCCAATGAGAT<br>TGGTGCCACAATCGGTGATCACACAACAAACGCGGCCGCGTTCGCAGAT<br>GATATTGTCTTATTTGCGGAAACTCGTTTAGGCCTTCAAACAATGCTAGA<br>CACGACTGTCGATTTTCTATCTTCAGTCGGGCTTACCCTTAACTCGGATA<br>AATGTTTTACAGTTGGAATAAAGGGGCAACCGAAACAGAAGTGTACTGT<br>GGTCATCCCAGAGACCTTCCGTATCGGTTCGCGCTCGTGTCCTGCATTGA<br>AGCGCACAGACGAGTGGAAGTATTTAGGCATAACATTCACTGCACAAG<br>GGAGGACCAGGTACAGTCCAGCCGACGACCTAGGTCCGAAGCTGTTGA<br>GGCTGACAAGGTCCCCCCTAAAACCACAACAGAAATTGTTCGCACTCAG<br>AACAGTTCTTATCCCACAACTTTACCATAAGCTGACCCTAGGTAGTGTGA<br>TGATAGGTGTTCTGAGGAAGTGTGACATACTGGTACGTTCGACCGTAAG<br>GAAGTGGTTAGGGCTTCCTCTGGACGTGTCAACTGCATTCTTCCATGCTC<br>CTCATATTTATGGGGGCCTCGGAATCCCTTCAGTTCGTTGGGTAGCGCC<br>AATGCTACGTATGAAAAGATTGAGCAATATTAAGTGGGCCCACCTCGCG<br>CAATCCGAGGCGGCCAGCTCATTTCTTACCGACGAATTGAATAAGGCCC<br>GGGGTAGAACTCTGGCTGGACTGAATGAGTTGACATCGCGTTCGGAGA<br>TCGAAACGTACTGGGCGAACAGGTTGTATATGTCTGTTGATGGTCGCGG<br>CTTACGTGAAGCGGGACTTTTTCGTCCCCAACACGGCTGGGTGTGTCAG<br>CCCACGCGTTTGCTAACAGGTCAAGATTACCGAAACGGTATCAAGCTGC<br>GAATAAATGCCCTACCATCGAGGTCTCGTACCACGAGGGGCAGAAATG<br>AATTGGAACGGCAATGTCGTGCAGGTTGTGATGCTCCCGAAACAACAAA<br>CCACATCCTGCAGAATTGTTACCGTACGCATGGGAGGCGGGTAGCAAG<br>ACATAACTGTGTAGTCAATAACCTTAAGAGGATTCTTGAGGAGAAGGGC<br>CACACAGTACACGTCGAACCAAGTTTGCAGCTGGAAACCTCGGTAAGTA<br>AACCAGACCTGGTGTGTATCCGTGACAATCACGCTTGCGTGATTGATGC<br>GCAGATTATAACGGATGGACTGTTTCTCGACGATGTGCACCATCGCAAA<br>GTTGAGAAATATAAAAGACCGGAAGTTATATCTGCACTGCGGAGAGAA<br>TTCGGAGTGTCGGGCAACGTCGAAGTCCTATCCGCGACGTTAAACTGGC<br>GTGGGATCTGGAGCAATCAATCCGTTAGAAGATTGATAGCAAAGGGTC<br>TCATCTCATCCGGTGACAGCAATGTCATTAGCGCCAGAGTGGTAACAGG<br>CGGACTATATTGCTTCAGACAGTTCATGTATCTCGCAGGTTACACTCGAG<br>ATTGGACTTAGCCTATACACTATGTTGGAGAGAAGACGCTTGCTACCTA<br>GGCATAATGTGAAATTAGGTATAAACATCGTGGTTGTAAAACTTGAGGT<br>GGGTTTTTAGTACGTATGCGTGATTACTTCGTAATCATGAATCGTGCATG<br>CTAGTGGGGTTTGGCCTCCACTAGTATCTTTGAAGATTTTCCTTCCTCAG<br>CGATCAAAAAAAAAAAAAAAAAAAAAAA (SEQ ID NO: 1118) | | TTGAAG<br>ATTTTCC<br>TTCCTCA<br>GCGATC<br>AAAAAA<br>AAAAAA<br>AAAAAA<br>AAAAAA<br>(SEQ ID<br>NO:<br>1364) | KLPVSIRQARTIFIPKV<br>GNASRPQDFRPITVQ<br>SVMVRILNAILASRLT<br>SSVDWDPRQRGFLP<br>TDGCADNTTIVDLILR<br>DHHKRCKSLYIATLDI<br>SKAFDSVSHAAVSAT<br>LTAYGAPKEFVDYVQ<br>NSYEVCGTTLNGDG<br>WRSEEFIPARGVRQG<br>DPLSPIIFNLIIDQLLRS<br>YPNEIGATIGDHTTN<br>AAAFADDIVLFAETRL<br>GLQTMLDTTVDFLSS<br>VGLTLNSDKCFTVGIK<br>GQPKQKCTVVIPETF<br>RIGSRSCPALKRTDE<br>WKYLGITFTAQGRTR<br>YSPADDLGPKLLRLTR<br>SPLKPQQKLFALRTVL<br>IPQLYHKLTLGSVMIG<br>VLRKCDILVRSTVRK<br>WLGLPLDVSTAFFHA<br>PHIYGGLGIPSVRWV<br>APMLRMKRLSNIKW<br>AHLAQSEAASSFLTD<br>ELNKARGRTLAGLNE<br>LTSRSEIETYWANRLY<br>MSVDGRGLREAGLF<br>RPQHGWVCQPTRLL<br>TGQDYRNGIKLRINA<br>LPSRSRTTRGRNELER<br>QCRAGCDAPETTNHI<br>LQNCYRTHGRRVAR<br>HNCVVNNLKRILEEK<br>GHTVHVEPSLQLETS<br>VSKPDLVCIRDNHAC<br>VIDAQIITDGLFLDDV<br>HHRKVEKYKRPEVIS<br>ALRREFGVSGNVEVL<br>SATLNWRGIWSNQS<br>VRRLIAKGLISSGDSN<br>VISARVVTGGLYCFR<br>QFMYLAGYTRDWT<br>(SEQ ID NO: 1486) |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| R2 | R2_DSe | — | *Drosophila* | GGGATCAGGGGTAATTGCGAGCAGAGGGGGAGTATTTTTCTGTAATTC | GGGATCA | TAGCTA | FERQNFSDGLVPQRK |
| | | | *sechellia* | GTAAGTCATATCATATGGTGTGCGGAAGGGGAATTTTACTCTGTAACTC | GGGGTAAT | AAACGT | FIHIGTTNRNNEPRS |
| | | | | ACAAGTCTCTCCTTTACTCAAGTCGACTCAAAACCTCCTCGTGGTGGTCC | TGCGAGCA | TTGGTTC | NLRNLMTTRPSVDIF |
| | | | | CCGGTAATGCTAAACTTGTTTAGCAGCTAATTTGAGCGGCAAAACTTTTC | GAGGGGG | AAAACA | PEDQYEPNAAATLSR |
| | | | | CGATGGGTTGGTTCCCCAGAGGAAATTTATTCATATTGGAACTACAAAT | AGTATTTT | TTTGCTT | VPCTVCGRSFNSKRG |
| | | | | AGAAATAACGAGCCTCGGAGCAATTTACGCAATCTGATGACGACCCGAC | TCTGTAAT | GCTGTC | LGVHMRSRHPDELD |
| | | | | CCTCCGTGGACATCTTCCCGGAGGACCAATATGAACCAAACGCAGCGGC | TCGTAAGT | TTGGCA | EERRRVDIKARWSEE |
| | | | | TACTCTATCTAGGGTACCCTGCACAGTATGTGGCCGGTCCTTTAACAGCA | CATATCAT | TAACATC | EKWMMARKEVELTA |
| | | | | AGAGAGGACTCGGTGTTCACATGCGATCTCGGCACCCAGACGAACTTG | ATGGTGTG | AATAAA | NGHKHINKQLAVYFA |
| | | | | ATGAAGAACGTCGACGTGTCGATATAAAGGCAAGATGGAGTGAGGAA | CGGAAGG | GGCATA | NRSVEAIKKLRQRGD |
| | | | | GAGAAGTGGATGATGGCGAGAAAGGAGGTTGAGCTCACAGCAAATGG | GGAATTTT | AACATC | YKEKIEQIRRQSALVP |
| | | | | ACATAAACACATAAACAAGCAACTAGCGGTGTATTTTGCAAACCGCAGC | ACTCTGTA | GCAAAT | EVANLTIRRRPSRSEQ |
| | | | | GTCGAAGCCATCAAAAAGCTAAGACAAAGGGGCGATTATAAGGAGAAA | ACTCACAA | AATGGT | NHQVTTSETTPITPFE |
| | | | | ATAGAGCAGATAAGAAGGCAATCAGCTCTCGTCCCGGAAGTTGCAAATC | GTCTCTCC | AATATAT | QSNREILRTLRGYSPV |
| | | | | TAACCATAAGGCGCCGCCCTAGTAGAAGTGAGCAAAACCACCAAGTAA | TTTACTCA | AAATTG | ECHSKWRAQELQTII |
| | | | | CAACATCAGAAACAACTCCAATCACACCCTTCGAACAGTCGAACAGGGA | AGTCGACT | GCTATG | DRAELEGKETTLQCLS |
| | | | | AATTTTGCGGACACTGCGTGGGTATAGCCCCGTAGAATGCCATTCCAAA | CAAAACCT | AGGATG | LYLLGIFPAQGVRHTL |
| | | | | TGGAGAGCCCAAGAGCTACAAACGATCATTGACAGGGCAGAGCTCGAG | CCTCGTGG | GTTTTAG | TRPPRRPRNRRESRR |
| | | | | GGAAAGGAAACCACTCTCCAATGCTTATCGCTATATCTCCTAGGAATTTT | TGGTCCCC | TACGTA | QQYAVVQRNWDKH |
| | | | | TCCGGCACAGGGTGTACGTCACACTCTGACGAGACCTCCTCGGAGGCCT | GGTAATGC | GGCGTT | KGRCIKSLLNGTDESV |
| | | | | CGAAATAGGAGAGAAAGCAGAAGGCAGCAGTATGCTGTCGTCCAGCGT | TAAACTTG | GCGGAA | MPSQEVMVPYWRE |
| | | | | AACTGGGATAAGCATAAAGGAAGATGCATCAAGTCCTTGCTAAATGGA | TTTAGCAG | CTTCGG | VMTQPSPSSCSREVI |
| | | | | ACTGATGAGTCGGTAATGCCAAGCCAAGAAGTAATGGTTCCTTACTGGA | CTAA (SEQ | TTCAGAT | QMDHSLERVWSAIT |
| | | | | GAGAAGTAATGACTCAGCCTAGCCCAAGCTCTTGCAGTAGAGAAGTGAT | ID NO: | AGAGCA | EHDLRASRISLSSSPG |
| | | | | ACAAATGGATCACTCGCTTGAGAGGGTTTGGTCTGCTATTACAGAGCAC | 1242) | ATGAAT | PDGITPKTAREVPSGI |
| | | | | GACCTTCGGGCATCAAGAATCTCATTATCTTCATCTCCGGGGCCTGACG | | CGTGCA | MLRIMNLILWCGNL |
| | | | | GGATAACTCCAAAAACAGCCAGGGAGGTGCCGTCAGGTATTATGTTGC | | TGCTAG | PHSIRLARTVFIPKTVT |
| | | | | GAATAATGAACCTAATTCTATGGTGCGGCAATCTACCACACTCTATCCGA | | GAAACT | AKRPQDFRPISVPSVL |
| | | | | CTGGCCAGAACCGTCTTCATCCCGAAGACGGTGACGGCGAAGCGACCG | | GAAGTG | VRQLNAILATRLNSSI |
| | | | | CAAGACTTTCGTCCAATATCGGTGCCTTCAGTCCTGGTAAGACAGCTAA | | TTGACA | NWDPRQRGFLPTDG |
| | | | | ATGCAATATTGGCAACCCGGTTGAACTCATCAATCAATTGGGACCCGCG | | GACCTA | CADNATIVDLVLRHS |
| | | | | CCAGCGGGGCTTCTTACCTACCGACGGATGTGCCGATAACGCGACGATA | | GTATCTT | HKHFRSCYIANLDVS |
| | | | | GTTGACTTAGTCTTGAGGCATAGCCATAAGCACTTTAGATCTTGCTACAT | | TCGATA | KAFDSLSHASIYDTLR |
| | | | | TGCAAATTTAGATGTAAGCAAGGCATTCGATTCTTTATCGCATGCATCTA | | GATTTCC | AYGAPKGFVDYVQN |
| | | | | TATATGACACCTTACGTGCTTATGGTGCGCCAAAGGGCTTCGTTGACTAC | | ATACCTC | TYEGGGTSLNGDGW |
| | | | | GTACAGAATACGTACGAGGGTGGCGGTACCAGTCTCAATGGGGACGGT | | CGCGAT | SSEEFVPARGVKQGD |
| | | | | TGGAGTTCAGAGGAATTCGTCCCTGCTAGAGGAGTGAAGCAGGGTGAC | | CAAAAA | PLSPILFNLVMDRLLR |
| | | | | CCTTTGTCTCCTATTCTATTTAACTTGGTAATGGACAGGTTACTTAGAAAC | | AAAAAA | NLPSEIGARVGNAIT |
| | | | | CTACCCAGCGAAATTGGTGCCAGAGTCGGAAATGCCATTACTAACGCGG | | AAAAAA | NAAAFADDLVLFAET |
| | | | | CCGCGTTTGCAGATGATTTGGTACTATTTGCTGAAACTCGAATGGGACTT | | AAAA | RMGLQVLLDRTLDFL |
| | | | | CAAGTATTGTTGGACAGAACGTTGGATTTTCTATCTCTCGTCGGCCTCAA | | (SEQ ID | SLVGLKLNADKCFTV |
| | | | | ACTTAATGCCGACAAATGTTTTACCGTTGGCATTAAGGGCCAGCCGAAA | | NO: | GIKGQPKQKCTVLEA |
| | | | | CAGAAGTGTACCGTGCTAGAGGCACAGAGCTTTTACGTAGGCTCAAGG | | 1365) | QSFYVGSREIPSLKRT |
| | | | | GAGATTCCATCATTGAAGCGAACGGACGAGTGGAAGTACTTAGGCATC | | | DEWKYLGINFTATGR |
| | | | | AACTTCACTGCAACCGGGAGGGTTCGATGCAATCCGGCCGAGGACATT | | | VRCNPAEDIGPKLQR |
| | | | | GGTCCGAAGCTACAAAGATTGACAAAGGCCCCCCTCAAACCACAACAGA | | | LTKAPLKPQQRMFAL |
| | | | | GGATGTTCGCCCTTAGGACTGTCCTTATCCCACAGCTCTATCACAAGTTA | | | RTVLIPQLYHKLALGS |
| | | | | GCCCTTGGGAGTGTGGCGATAGGCATCCTACGAAAAACTGACAAACTA | | | VAIGILRKTDKLIRYYV |
| | | | | ATACGATACTATGTGCGAAGATGGCTAAATCTTCCGCTGGATATACCGA | | | RRWLNLPLDIPIAFIH |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TAGCATTCATTCACGCACCCCCAAAAAGTGGAGGTCTCGGAATTCCATC | | | APPKSGGLGIPSLRW |
| | | | | ACTTAGATGGGTAGCTCCAATGTTAAGGCTAAGACGTTTGAGTAATATT | | | VAPMLRLRRLSNIKW |
| | | | | AAATGGCCTCACCTCACGCAAAACGAGGTAGCCAGCTCTTTCCTCGAAG | | | PHLTQNEVASSFLEA |
| | | | | CAGAAAAACAACGGGCCCGAGATAGATTATTAGCAGAACAAAATGAAT | | | EKQRARDRLLAEQNE |
| | | | | TGTTATCGCGTCCGGCAATAGAAAAATATTGGGCGAACAAATTGTACCT | | | LLSRPAIEKYWANKLY |
| | | | | CTCAGTTGATGGTAGCGGACTCCGTGAAGCAGGCCATTGGGGCCCGCA | | | LSVDGSGLREAGHW |
| | | | | ACACGGGTGGGTTAATCAACCCACGCGTTTACTAACAGGAAAGGAATAT | | | GPQHGWVNQPTRLL |
| | | | | ATAGACGGTATTCGTCTGCGGATAAATGCCCTACCCACGAAGTCTCGTA | | | TGKEYIDGIRLRINALP |
| | | | | CTACAAGGGGAAGGCACGAATTGGAACGACAGTGTCGTGCAGGATGTG | | | TKSRTTRGRHELERQ |
| | | | | ACGCTCCCGAAACAACAAACCATATTATGCAAAAATGTTACCGATCGCA | | | CRAGCDAPETTNHI |
| | | | | TGGGAGGCGCATAGCTAGACACAACTGCGTAGTAAATCGAATCAAGCG | | | MQKCYRSHGRRIAR |
| | | | | GGGACTTGAGGAGAGAGGCTGCGTAGTCATTGTTGAACCAAGTCTGCA | | | HNCVVNRIKRGLEER |
| | | | | GTGCGAATCCGGTCTTAATAAACCAGACCTGGTGGCACTACGACAAAAT | | | GCVVIVEPSLQCESGL |
| | | | | CACATTGATGTGATCGACATACAAATTGTGACAGACGGACACTCTATGG | | | NKPDLVALRQNHIDV |
| | | | | ATGATGCACACCAGCGCAAAATCAATAGATACGACAGACCGGACATAC | | | IDIQIVTDGHSMDDA |
| | | | | GAACTGAGTTGCGTCGCAGATTCGAAGCCGCAGGTGACATTGAATTCCA | | | HQRKINRYDRPDIRT |
| | | | | TTCTGCCACCCTGAACTGGAGGGGGATCTGGAGTGGTCAATCCGTTAAA | | | ELRRRFEAAGDIEFHS |
| | | | | AGATTGATAGCGAAGGGTCTCCTCAGCAAATATGATAGTCATATCATTA | | | ATLNWRGIWSGQSV |
| | | | | GCGTCCAGGTTATGAGAGGCAGTCTCGGTTGTTTTAAACAGTTCATGTA | | | KRLIAKGLLSKYDSHII |
| | | | | CCTGAGCGGGTTTTCCCGAGATTGGACTTAGCTAAAACGTTTGGTTCAA | | | SVQVMRGSLGCFKQ |
| | | | | AACATTTGCTTGCTGTCTTGGCATAACATCAATAAAGGCATAAACATCGC | | | FMYLSGFSRDWT |
| | | | | AAATAATGGTAATATATAAATTGGCTATGAGGATGGTTTTAGTACGTAG | | | (SEQ ID NO: 1487) |
| | | | | GCGTTGCGGAACTTCGGTTCAGATAGAGCAATGAATCGTGCATGCTAG | | | |
| | | | | GAAACTGAAGTGTTGACAGACCTAGTATCTTTCGATAGATTTCCATACCT | | | |
| | | | | CCGCGATCAAAAAAAAAAAAAAAAAAAA (SEQ ID NO: 1119) | | | |
| R2 | R2_DSi | — | *Drosophila* | GGGATCTGGGGTAATTGCGAGCAGAGGGGGAGTATTTTTCTGTAATTC | GGGATCTG | TAGCTA | TCLAANLSGKNFSDG |
| | | | *simulans* | GTAAGTCATATCATATGGTGTGCGGAAGGGGAATTTTACTCTGTAACTC | GGGTAATT | AAACGT | LVTQRKFTHIGTTNT |
| | | | | ACAAGTCTCTCCTTTACTCAAGTCGACTCAAAACCTCCTCGTGGTGGTCC | GCGAGCA | TTGGTTC | NNEPRISLHNLMTTR |
| | | | | CCGGTAATGCTAAACTTGTTTAGCAGCTAATTTGAGCGGCAAAAACTTTT | GAGGGGG | AAAACA | PSVDIFPEDQYEPNA |
| | | | | CCGATGGGCTGGTTACCCAGAGGAAATTTACTCATATTGGAACTACGAA | AGTATTTT | TTTGCTT | AATLSRVPCTVCGRS |
| | | | | CACAAATAACGAGCCTCGGATATCTTTACACAATCTGATGACGACCCGA | TCTGTAAT | GCTGTC | FNSKRGLGVHMRSR |
| | | | | CCCTCCGTGGATATCTTCCCGGAGGACCAATATGAACCAAACGCAGCGG | TCGTAAGT | TTGGCA | HPDELDEERRRVDIK |
| | | | | CTACTCTATCTAGGGTTCCCTGCACAGTATGTGGCCGGTCCTTTAACAGC | CATATCAT | TAACATC | ARWSEEEKWMMAR |
| | | | | AAGAGAGGACTCGGTGTTCACATGCGATCTCGGCACCCAGACGAACTT | ATGGTGTG | AATAAA | KEVELTANGHKHMN |
| | | | | GATGAAGAACGTCGACGTGTCGATATAAAGGCAAGGTGGAGTGAGGA | CGGAAGG | GGCATA | KQLAVYFANRSVEAI |
| | | | | AGAGAAGTGGATGATGGCGAGAAAGGAGGTTGAGCTCACAGCAAATG | GGAATTTT | AACATC | KKLRQRGDYKEKIEQI |
| | | | | GACATAAACACATGAACAAGCAACTAGCGGTGTATTTTGCAAACCGCAG | ACTCTGTA | GCAAAA | RGQSALVPEVANLTI |
| | | | | CGTCGAAGCCATCAAAAAGCTAAGACAGAGGGGCGATTATAAGGAGAA | ACTCACAA | TAATGG | RRRPSRSEQNHQVTT |
| | | | | AATAGAGCAGATAAGAGGGCAATCTGCTCTCGTCCCGGAAGTTGCAAAT | GTCTCTCC | TTATATA | SETTPITPFEQSNREIL |
| | | | | CTAACCATAAGGCGCCGCCCTAGTAGAAGTGAGCAAAACCACCAAGTA | TTTACTCA | TAAATG | RTLRGYSPVECHSKW |
| | | | | ACAACATCAGAAACAACTCCAATCACTCCCTTCGAACAGTCGAACAGGG | AGTCGACT | GCTATG | RAQELQTIIDRAELEG |
| | | | | AAATTTTGCGGACACTGCGTGGGTATAGCCCCGTAGAATGCCATTCCAA | CAAAACCT | AGGATG | KETTLQCLSLYLLGIFP |
| | | | | ATGGAGAGCCCAAGAGCTACAAACGATCATTGACAGGGCAGAGCTCGA | CCTCGTGG | GTTTTAG | AQGVRHTLTRPPRRP |
| | | | | GGGAAAGGAAACCACTCTCCAATGCTTATCGCTATATCTCCTGGAATTT | TGGTCCCC | TACGTA | RNRRESRRQQYAVV |
| | | | | TTCCGGCACAGGGTGTACGACACACGCTGACGAGACCTCCTCGGAGAC | GGTAATGC | GGCGTT | QRNWDKHKGRCIKS |
| | | | | CTCGGAATAGGAGAGAAAGCAGAAGGCAGCAGTATGCTGTCGTCCAGC | TAA (SEQ | GCGGAA | LLNGTDESVMPSQEV |
| | | | | GTAACTGGGATAAGCATAAAGGAAGATGCATCAAGTCCTTGCTAAATG | ID NO: | CTTCGG | MVPYWREVMTQPS |
| | | | | GAACTGATGAGTCGGTAATGCCAAGCCAAGAAGTAATGGTTCCCTACTG | 1243) | TTCAGAT | PSSCSGEVIQMDHSL |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAGAGAAGTAATGACTCAGCCTAGCCCAAGCTCTTGCAGTGGAGAAGT | | AGAGCA | ERVWSAITEHDLRAS |
| | | | | GATACAAATGGATCACTCGCTTGAGAGGGTTTGGTCTGCTATTACGGAG | | ATGAAT | RISLSSSPGPDGITPKS |
| | | | | CATGACCTTCGGGCGTCAAGAATCTCATTATCTTCATCTCCGGGGCCTGA | | CGTGCA | AREVPSGIMLRIMNLI |
| | | | | CGGGATAACTCCAAAATCTGCCAGGGAGGTGCCGTCAGGTATTATGTTG | | TGCTAG | LWCGNLPHSIRLART |
| | | | | CGAATAATGAACCTAATTCTATGGTGCGGTAATCTACCACACTCTATCCG | | GAAAAC | VFIPKTVTAKRPQDF |
| | | | | ACTGGCCAGAACCGTCTTCATCCCGAAAACGGTGACGGCGAAGCGACC | | TGACCA | RPISVPSVLVRQLNAI |
| | | | | GCAAGACTTTCGTCCAATATCGGTGCCTTCAGTCCTGGTAAGACAGCTA | | CACGCA | LATRLNSSINWDPRQ |
| | | | | AATGCCATATTGGCAACCCGGTTGAACTCATCAATCAATTGGGACCCGC | | GTGTTG | RGFLPTDGCADNATI |
| | | | | GCCAGCGGGGCTTCTTACCTACCGACGGATGTGCCGATAATGCGACGAT | | GCAGCC | VDLVLRHSHKHFRSC |
| | | | | AGTTGACTTAGTCTTGAGGCATAGCCATAAGCACTTTAGATCTTGCTACA | | CTAGTAT | YIANLDVSKAFDSLSH |
| | | | | TAGCTAATTTAGATGTAAGCAAGGCATTCGATTCTTTATCGCATGCATCT | | CTTTCGA | ASIYDTLRAYGAPKGF |
| | | | | ATATATGACACCTTACGTGCTTATGGTGCGCCAAAGGGCTTCGTTGACT | | TAGATTT | VDYVQNTYEGGGTSL |
| | | | | ACGTACAGAATACGTACGAGGGTGGCGGTACCAGTCTCAATGGGGACG | | CCATACC | NGDGWSSEEFVPAR |
| | | | | GTTGGAGTTCAGAGGAATTCGTCCCTGCTAGAGGAGTGAAGCAGGGTG | | TCCGCG | GVKQGDPLSPILFNL |
| | | | | ACCCTTTGTCTCCTATTCTATTTAACTTGGTAATGGACAGGTTACTTAGAA | | ATCAAA | VMDRLLRNLPSEIGA |
| | | | | ACCTACCCAGCGAAATTGGTGCCAAAGTCGGAAATGCCATTACTAACGC | | AAAAAA | KVGNAITNAAAFAD |
| | | | | GGCCGCGTTTGCAGATGATTTGGTACTATTTGCTGAAACTCGAATGGGA | | AAAAAA | DLVLFAETRMGLQVL |
| | | | | CTTCAAGTATTGTTGGACAAAACGTTGGATTTTCTATCTCTCGTCGGCCT | | AAAAAA | LDKTLDFLSLVGLKLN |
| | | | | CAAACTTAATGCCGACAAATGTTTTACCGTTGGCATTAAGGGCCAGCCG | | AA (SEQ | ADKCFTVGIKGQPKQ |
| | | | | AAACAGAAGTGTACCGTGCTAGAGGCACAGAGCTTCTACGTAGGCTCG | | ID NO: | KCTVLEAQSFYVGSR |
| | | | | AGGGAGATTCCATCACTGAAGCGAACGGACGAGTGGAAGTACTTAGGC | | 1366) | EIPSLKRTDEWKYLGI |
| | | | | ATCAACTTCACTGCAACTGGGAGGGTTCGATGCAATCCGGCCGAGGAC | | | NFTATGRVRCNPAE |
| | | | | ATTGGTCCAAAGCTACAAAGATTGACAAAGGCCCCCCTCAAACCACAAC | | | DIGPKLQRLTKAPLKP |
| | | | | AGAGGATGTTCGCCCTTAGGACTGTCCTTATCCCACAGCTCTATCACAAG | | | QQRMFALRTVLIPQL |
| | | | | TTAGCCCTTGGGAGTGTGGCGATAGGCGTCCTACGAAAAACTGACAAAT | | | YHKLALGSVAIGVLRK |
| | | | | TAATAAGATATTATGTGCGAAGATGGCTAAATCTTCCGCTGGATGTGCC | | | TDKLIRYYVRRWLNL |
| | | | | GATAGCATTCATTCATGCACCCCCAAAAAGTGGAGGTCTCGGAATTCCA | | | PLDVPIAFIHAPPKSG |
| | | | | TCACTAAGATGGGTAGCTCCAATGTTAAGGCTAAGACGATTGAGTAATA | | | GLGIPSLRWVAPMLR |
| | | | | TTAAATGGCCTCACCTCACGCAAAACGAGGTAGCCAGCTCTTTCCTCGA | | | LRRLSNIKWPHLTQN |
| | | | | AGCCGAAAAACAACGGGCCCGAGATAGATTATTAGCAGAACAAAATGA | | | EVASSFLEAEKQRAR |
| | | | | ATTGTTATCGCGTCCGGCAATAGAAAAATATTGGGCGAACAAATTGTAC | | | DRLLAEQNELLSRPAI |
| | | | | CTCTCAGTTGATGGCAGCGGACTCCGTGAAGCGGGCCATTGGGGACCG | | | EKYWANKLYLSVDGS |
| | | | | CAACACGGGTGGGTTAATCAACCCACGCGTTTACTAACAGGAAAGGAAT | | | GLREAGHWGPQHG |
| | | | | ATATAGACGGTATTCGTCTGCGGATAAATGCCCTACCCACGAAGTCTCG | | | WVNQPTRLLTGKEYI |
| | | | | TACTACAAGGGGAAGGCACGAATTGGAACGACAGTGTCGTGCAGGATG | | | DGIRLRINALPTKSRT |
| | | | | TGACGCTCCCGAAACAACAAACCACATAATGCAAAAATGTTACCGATCG | | | TRGRHELERQCRAGC |
| | | | | CATGGGAGGCGCGTAGCTAGACACAACTGCGTAGTAAATCGAATCAAG | | | DAPETTNHIMQKCY |
| | | | | CGGGGACTTGAGGAGAGAGGCTGCGTGGTCATTGTTGAACCAAGTCTG | | | RSHGRRVARHNCVV |
| | | | | CAGTGCGAATCCGGCCTTAATAAACCGGACCTGGTGGCACTACGACAA | | | NRIKRGLEERGCVVIV |
| | | | | GATCACATTGATGTGATCGACATACAAATTGTGACAGACGGACACTCTA | | | EPSLQCESGLNKPDL |
| | | | | TGGATGATGCACACCAGCGCAAAATCAATAGATACGACAGACCGGACA | | | VALRQDHIDVIDIQIV |
| | | | | TACGAACTGAATTGCGTCGCAGATTCGAAGCCGCAGGTGACATTGAATT | | | TDGHSMDDAHQRKI |
| | | | | CCATTCTGCCACCCTGAACTGGAGGGGGATCTGGAGTGGTCAATCCGTT | | | NRYDRPDIRTELRRRF |
| | | | | AAAAGATTGATAGCAAAGGGTCTCCTCAGCAAATATGATAGTCATATCA | | | EAAGDIEFHSATLNW |
| | | | | TTAGCGTCCAGGTTATGAGAGGCAGTCTCGGTTGTTTTAAACAGTTCAT | | | RGIWSGQSVKRLIAK |
| | | | | GTACCTGAGCGGGTTTTCCCGAGATTGGACTTAGCTAAAACGTTTGGTT | | | GLLSKYDSHIISVQVM |
| | | | | CAAAACATTTGCTTGCTGTCTTGGCATAACATCAATAAAGGCATAAACAT | | | RGSLGCFKQFMYLSG |
| | | | | CGCAAAATAATGGTTATATATAAATGGCTATGAGGATGGTTTTAGTACG | | | FSRDWT (SEQ ID |
| | | | | TAGGCGTTGCGGAACTTCGGTTCAGATAGAGCAATGAATCGTGCATGCT | | | NO: 1488) |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGGAAAACTGACCACACGCAGTGTTGGCAGCCCTAGTATCTTTCGATAG | | | |
| | | | | ATTTCCATACCTCCGCGATCAAAAAAAAAAAAAAAAAAAAAAA (SEQ ID | | | |
| | | | | NO: 1120) | | | |
| R2 | R2_DYa | — | *Drosophila* | GGGAACATGGGGTAAAGGTGAGTAGAGGGGGAGTATTTTTTATACTCT | GGGAACAT | TAGCTTA | FERRIFPKGLVPLTKD |
| | | | *yakuba* | GCAACTCATAAGTCTTGCCTTTACTCAAGTCGACTCAAAACCTCCTCGTG | GGGGTAA | AAACGT | NHIGTTNLQNEPRIFT |
| | | | | GTGTTTCCCGGTAATGTTAAACTTGTTTAGCAGCTAATTTGAGCGGCGA | AGGTGAGT | TTGGTTC | NDLLTTRPSVDHVPE |
| | | | | ATCTTTCCGAAAGGGTTGGTTCCCCTGACGAAGGATAATCATATTGGTA | AGAGGGG | ACATAC | DQYEPNAAATLSRVP |
| | | | | CCACAAATTTACAAAACGAGCCTCGGATATTTACTAATGATCTGTTGACG | GAGTATTT | ATCTGCC | CTVCDRSFNSKRGLG |
| | | | | ACCCGACCCTCCGTGGATCACGTCCCGGAGGACCAATATGAACCAAACG | TTTATACT | TGCTGC | VHMRSRHPDELDEE |
| | | | | CAGCGGCTACTCTATCAAGGGTTCCCTGCACAGTATGTGACCGGTCCTTT | CTGCAACT | CTTGGC | RRRVDIKARWSEEEK |
| | | | | AACAGTAAGAGAGGACTCGGTGTTCACATGCGATCTCGGCACCCAGAC | CATAAGTC | ACAATA | WMMARKEVELMAN |
| | | | | GAACTTGATGAAGAACGTCGACGTGTCGATATAAAAGCAAGGTGGAGT | TTGCCTTT | TCAAAA | GFKHINKQLAVYFAN |
| | | | | GAGGAAGAGAAGTGGATGATGGCGAGAAAGGAGGTCGAGCTCATGGC | ACTCAAGT | AGGCAT | RSVEAIKKLRQRGDY |
| | | | | AAATGGTTTTAAACACATAAACAAGCAACTAGCGGTGTATTTTGCAAAC | CGACTCAA | AAACAT | KEKIEQIRGQSALAPE |
| | | | | CGTAGCGTCGAAGCCATTAAAAAGCTGAGACAGAGGGGCGATTATAAG | AACCTCCT | CGCACA | VANLTIRRRPSRSEQ |
| | | | | GAGAAAATAGAGCAGATAAGAGGGCAATCCGCTCTCGCCCCAGAAGTT | CGTGGTGT | TATTGGT | DHQVPTSEASPITPLE |
| | | | | GCTAATCTAACCATAAGGCGCCGCCCTAGTAGAAGTGAGCAAGACCACC | TTCCCGGT | TATTTAC | QSNREILRTLRGYSPV |
| | | | | AAGTACCAACGTCAGAAGCATCTCCAATCACTCCGCTCGAACAGTCGAA | AATGTTAA | GGCTAT | VCPSKWRAQELQTII |
| | | | | CAGGGAAATTTTGCGGACGCTGCGTGGGTATAGCCCCGTAGTATGCCCT | ACTTGTTT | GAGGAT | DRAEFEGKETTLQCLS |
| | | | | TCCAAATGGAGAGCCCAAGAACTACAAACTATCATTGATAGGGCGGAAT | AGCAGCTA | GGTTTTA | LYLQGIFPVQGVRHT |
| | | | | TTGAGGGAAAGGAAACCACTCTCCAATGCTTATCGCTCTACCTCCAGGG | A (SEQ ID | GTACGT | LTRPPRRPRNRRESR |
| | | | | AATTTTTCCGGTACAGGGTGTACGACACACGCTGACGAGGCCTCCTCGG | NO: 1244) | AGGCGT | RQQYAVIQRNWDKH |
| | | | | AGACCTCGGAATAGGAGGGAAAGCAGAAGGCAGCAGTACGCTGTCATC | | TGCGGA | KGRCIKSLLNGTDESV |
| | | | | CAGCGAAACTGGGATAAGCATAAAGGAAGGTGCATTAAGTCCCTGCTT | | ACTTCG | MPSREFMEPYWREV |
| | | | | AATGGAACTGATGAATCGGTAATGCCAAGCCGAGAATTTATGGAGCCCT | | GTTCGG | MTQPSPSSCNGEVIR |
| | | | | ACTGGAGAGAAGTAATGACTCAGCCTAGCCCAAGCTCTTGCAATGGAG | | ATAGAG | TDHSLETVWSAITEQ |
| | | | | AAGTGATTCGTACGGATCACTCGCTTGAGACGGTATGGTCTGCAATAAC | | CAATGA | DLRASRVSLSSSPGPD |
| | | | | GGAACAAGACCTTAGGGCATCAAGAGTTTCATTATCTTCATCTCCGGGG | | ATCGTG | GVTPKTAREVPSGIM |
| | | | | CCTGACGGGGTAACTCCAAAAACTGCCAGGGAGGTGCCGTCAGGTATT | | CATGCT | LRIMNLILWCGNLPH |
| | | | | ATGCTACGCATAATGAACCTAATTCTATGGTGCGGTAACTTACCTCATTC | | AGGAAC | SIRLARTIFIPKTVTAK |
| | | | | TATCCGACTGGCCAGAACCATCTTCATCCCGAAGACGGTGACGGCAAAG | | TGACCA | RPQDFRPISVPSVLVR |
| | | | | CGACCGCAAGACTTTCGTCCAATATCGGTGCCTTCCGTCCTGGTAAGAC | | AATAAC | QLNAILATRLTSSIDW |
| | | | | AGCTAAATGCCATCTTGGCAACCCGATTGACCTCATCAATCGATTGGGA | | AGCAGC | DPRQRGFSPTDGCA |
| | | | | CCCGCGCCAGCGGGGCTTCTCACCAACCGACGGTTGCGCCGATAATGCG | | CCTAGT | DNATIVDLVLRHSHK |
| | | | | ACGATAGTTGACTTAGTCCTGAGGCATAGCCATAAGTACTTTAAATCTTG | | ATCTTTC | YFKSCYIANLDVSKAF |
| | | | | CTACATCGCCAACTTAGATGTTAGCAAGGCATTTGACTCATTGTCACATG | | GAAGAT | DSLSHAAIYGTLRAYG |
| | | | | CAGCAATATATGGGACATTACGAGCTTATGGTGCGCCGAAGGGTTTTGT | | TTCCATA | APKGFVDYVQKTYEG |
| | | | | TGACTATGTACAGAAGACGTACGAGGGAGGTGGTATCAGTCTCAACGG | | CCTTTGC | GGISLNGEGWCSEEF |
| | | | | GGAAGGTTGGTGTTCAGAGGAATTCGTGCCTGCTAGAGGAGTGAAGCA | | GATCAA | VPARGVKQGDPLSPI |
| | | | | GGGCGACCCTTTGTCCCCCATTCTATTTAACTTGGTCATCGACCGGTTAC | | AAAAAA | LFNLVIDRLLRALPSEI |
| | | | | TTAGAGCCCTACCTAGCGAGATTGGTACCAAGGTCGGAAATGCCATGAT | | AAAAAA | GTKVGNAMINAAAF |
| | | | | AAACGCTGCTGCATTTGCAGATGATTTGGTACTATTTGCGGAAACTCGG | | AAAAA | ADDLVLFAETRMGL |
| | | | | ATGGGACTTCAAACTTTGTTGGACAAGACTGTGGACTTTTTATCCACCGT | | (SEQ ID | QTLLDKTVDFLSTVGL |
| | | | | CGGCCTTAAACTTAATGCTGATAAGTGCTTTACTGTCGGTATTAAGGGA | | NO: | KLNADKCFTVGIKGQ |
| | | | | CAGCCGAAACAGAAGTGTACTGTGCTAGAGGCACAGAGCTTCTGCGTA | | 1367) | PKQKCTVLEAQSFCV |
| | | | | GGCTCGAGAGAGATTCCAACACTGAAGCGTACTGACGAGTGGAAGTAT | | | GSREIPTLKRTDEWK |
| | | | | CTCGGTATACATTTCACTGCAAGTGGGAGGGTTCGATGCAATCCGGCAG | | | YLGIHFTASGRVRCN |
| | | | | AGGACATTGGTCCAAAGCTACAAAGATTGTCAGAGGCCCCCCTTAAGCC | | | PAEDIGPKLQRLSEAP |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACAACAGAGGTTGTTCGCCCTTCGGACTGTCCTGATCCCACAACTCTATC | | | LKPQQRLFALRTVLIP |
| | | | | ACAAGTTATCCCTTGGGAGTGTGACGATAGGCGTCTTACGAAAGACTGA | | | QLYHKLSLGSVTIGVL |
| | | | | CAAGCTAATACGTTTCTATGTGCGAAGATGGCTAAATCTTCCGTCGGAT | | | RKTDKLIRFYVRRWL |
| | | | | GTGCCGATAGCATTCGTTCATGCCCCCCCAAAATGTGGGGGTCTCGGAA | | | NLPSDVPIAFVHAPP |
| | | | | TTCCATCACTAAGATGGGTAGCACCAATGTTACGACTTAGACGATTGAG | | | KCGGLGIPSLRWVAP |
| | | | | CAACATAAAATGGCCCCACCTCGTACAATCCGAGGAAGCCAGCTCCTTC | | | MLRLRRLSNIKWPHL |
| | | | | ATCGAAGCGGAAAAACAAAGGGCCCGAGGTAGATTGATAGCTGAACAA | | | VQSEEASSFIEAEKQR |
| | | | | AATGAATTGTTATCGCGTCCGGCAATAGAAAAGTATTGGGCGAACAGG | | | ARGRLIAEQNELLSRP |
| | | | | TTGTACCTCTCCGTTGATGGTGGCGGACTCCGTGAAGCGGGCCACTATG | | | AIEKYWANRLYLSVD |
| | | | | GTCCCCAACACGGGTGGGTTAGTCAGCCCACGCGTTTACTAACAGGAAA | | | GGGLREAGHYGPQH |
| | | | | GGAATATTTAGACGGTATTCGGCTGCGGATAAATGCCCTACCCACAAAG | | | GWVSQPTRLLTGKEY |
| | | | | TCTCGCACTACGAGGGGAAGGCACGAATTGGAGAGGCAGTGTCGTGCA | | | LDGIRLRINALPTKSR |
| | | | | GGATGTGATGCTCCCGAAACAACAAACCACATTATGCAAAAATGCTATC | | | TTRGRHELERQCRAG |
| | | | | GTTCGCATGGGAGGCGAGTAGCTAGACACAACTGCGTAGTAAATCGAA | | | CDAPETTNHIMQKCY |
| | | | | TCAAGCGGGGACTTGAGGAGAGAGGCTGCGTGGTCATTGCCGAACCAA | | | RSHGRRVARHNCVV |
| | | | | GTCTGCAGTGCGAATCCGGCCTTAATAAACCGGACCTGGTGGTACTCCG | | | NRIKRGLEERGCVVIA |
| | | | | ACAAAATCACATTGATGTGATTGACGTGCAGGTTGTGACAGACGGACAT | | | EPSLQCESGLNKPDL |
| | | | | TCTATGGACGAAGCGCATCAGCGCAAAATCAATAGATACGACAGACCG | | | VVLRQNHIDVIDVQV |
| | | | | GACATACGAACTGAATTGCGTCGCCGATTCGAAGCCGCAGGTGACATC | | | VTDGHSMDEAHQRK |
| | | | | GAGTTTCATTCTGCCACCCTAAACTGGAGGGGGATTTGGAGTGGTCAAT | | | INRYDRPDIRTELRRR |
| | | | | CCGTAAAACGATTGATTGCGAAGGGTCTCCTCAGCAAATATGATAGTCA | | | FEAAGDIEFHSATLN |
| | | | | TATCATTAGCGTCCAGGTTATGAGAGGCAGTCTTGGCTGTTTTAGACAG | | | WRGIWSGQSVKRLI |
| | | | | TTCATGTACCTTAGCGGGTTTTCTCGTGATTGGACGTAGCTTAAAACGTT | | | AKGLLSKYDSHIISVQ |
| | | | | TGGTTCACATACATCTGCCTGCTGCCTTGGCACAATATCAAAAAGGCATA | | | VMRGSLGCFRQFMY |
| | | | | AACATCGCACATATTGGTTATTTACGGCTATGAGGATGGTTTTAGTACGT | | | LSGFSRDWT (SEQ ID |
| | | | | AGGCGTTGCGGAACTTCGGTTCGGATAGAGCAATGAATCGTGCATGCT | | | NO: 1489) |
| | | | | AGGAACTGACCAAATAACAGCAGCCCTAGTATCTTTCGAAGATTTCCAT | | | |
| | | | | ACCTTTGCGATCAAAAAAAAAAAAAAAAAAA (SEQ ID NO: 1121) | | | |
| R2 | R2_KF | GU949558 | *Kalotermes* | GAGAGGTCACTGTTGCTGATCAGCTGGACACCTAGCTGACTGCGTGCAT | GAGAGGT | TAATGTC | MEVPLTSSLGSGATQ |
| | | | *flavicollis* | GCGTGCACGCCGCGCGCCGCCTCCTCGTGGTACCGCTGGTAACGCAGG | CACTGTTG | CCTTTTG | APGTPELLGEHTVER |
| | | | | GTCACTGAGACTACCTGCGGCTAAAGGCGCGCGCGAGGGATTGTAAGT | CTGATCAG | GCTTGC | PGLDQGHSYGLLMD |
| | | | | CCACCACCTCCACGTGGTTCCCCGCGGGCAACGGCATAGTTCATCTGCC | CTGGACAC | CCCCACC | DVELPVRLPFFGPLIC |
| | | | | GGCCAAGCGTGCCGTTCCCTCGATCCTCCTCTGATTAGGGATAGGAGGG | CTAGCTGA | TGCTTAA | PGCRTLLTSEETISSH |
| | | | | GGGCGGTGGCTCCCGCCGACGACCTGGCAAACACCTTGGACACGCTAA | CTGCGTGC | AGGAAC | HRRVHPDARTRWVC |
| | | | | GATAATAGGCCGTCCTCCGGGCCGGCCGAATCATAAGCACACAATGGA | ATGCGTGC | TGGCAG | YGCDSPFMTYRAIKC |
| | | | | AGTCCCTCTAACATCAAGCCTCGGATCTGGGGCAACCCAAGCTCCCGGG | ACGCCGCG | GAAAGA | HLPKCSGRKVVTGDH |
| | | | | ACCCCAGAATTATTAGGGGAGCACACCGTTGAACGACCTGGCCTTGATC | CGCCGCCT | GAGTGA | ICNGCTKRFESQRGLS |
| | | | | AAGGACATTCTTATGGTTTGTTAATGGATGACGTAGAGCTGCCGGTGAG | CCTCGTGG | TCCGTG | LHKRRAHPGLRNEE |
| | | | | GTTACCATTTTTTGGGCCTCTCATATGCCCAGGATGCAGGACGCTGCTCA | TACCGCTG | CCATAG | MLEPPVRAERRPNA |
| | | | | CCTCTGAGGAAACGATTAGCAGCCATCATAGGAGGGTCCACCCTGATGC | GTAACGCA | AAATAT | HKSSIWSIDEIRILEQY |
| | | | | CCGGACGAGGTGGGTCTGCTATGGTTGTGATTCCCCATTTATGACATAC | GGGTCACT | GGTTAT | EAAYVGDLHINMKIA |
| | | | | CGGGCCATTAAATGTCACTTACCTAAATGCTCTGGCAGGAAGGTAGTGA | GAGACTAC | CCGGGG | AHLPFKTNKQVSNYR |
| | | | | CAGGGGATCACATCTGTAATGGCTGCACAAAGCGGTTTGAGTCTCAGA | CTGCGGCT | CAAGTC | NDRRKKSRTATDASQ |
| | | | | GAGGTCTCTCACTGCATAAAAGGAGAGCCCATCCGGGTCTTCGGAACG | AAAGGCG | ACTAGC | QGLGPNDGNRGIVP |
| | | | | AGGAAATGCTTGAGCCTCCTGTGAGAGCTGAGCGACGCCCTAACGCAC | CGCGCGA | AATATG | SGQSSPLFLEGSDAE |
| | | | | ATAAATCCTCAATATGGAGCATTGATGAGATTCGTATCCTGGAGCAATA | GGGATTGT | GGACTT | GDEDVFNVLVPPTLG |
| | | | | TGAGGCTGCCTACGTCGGCGATCTCCACATCAACATGAAGATAGCTGCT | AAGTCCAC | CTCCGG | GLEPAGQVHSLSEGE |
| | | | | CACCTGCCGTTCAAAACCAATAAACAAGTGAGCAACTATCGGAACGATC | CACCTCCA | GTCCGT | TSPLVGEADPCFMG |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GCCGTAAAAAGTCCAGAACGGCGACTGACGCGAGCCAACAGGGACTTG | CGTGGTTC | GCGGTC | GTPSAGEASGSTLLG |
| | | | | GTCCCAATGACGGCAATAGAGGAATTGTCCCCAGCGGGCAGTCATCCCC | CCCGCGGG | CTTCCAA | PDPTPADGYSLVRKD |
| | | | | GTTATTTTTAGAGGGCTCTGACGCCGAGGGGGACGAGGATGTTTTTAAT | CAACGGCA | CATGAG | LQLSVQTSPLLAVGS |
| | | | | GTCCTAGTGCCGCCCACCCTAGGGGGTCTTGAACCTGCTGGACAGGTTC | TAGTTCAT | CTGGAC | VGTESVQFERGVLSC |
| | | | | ATTCACTCTCTGAGGGGGAAACTTCGCCGCTGGTCGGCGAAGCGGATCC | CTGCCGGC | GTAGTC | GTPPEFLHPEQFAHC |
| | | | | CTGTTTTATGGGTGGCACGCCGTCTGCCGGAGAGGCCTCGGGCTCAACC | CAAGCGTG | CACTCTA | ANNDPVLNASEEQV |
| | | | | TTGTTGGGTCCGGATCCCACCCCGGCAGATGGATATTCTCTGGTCAGGA | CCGTTCCC | TGACTT | HAPLGEEANDLPDN |
| | | | | AAGACTTACAGCTCAGTGTGCAGACATCCCCGTTATTAGCAGTGGGCTC | TCGATCCT | GAACGA | NHPSELGVDPEDPTC |
| | | | | TGTCGGCACTGAGTCTGTGCAATTTGAACGTGGGGTGTTATCGTGCGGT | CCTCTGAT | TACGGG | SPATEQVQPSSEEEA |
| | | | | ACGCCACCAGAATTTTTACACCCGGAACAGTTTGCACATTGTGCAAACA | TAGGGATA | GGCGTA | DDPFAQFKAWRRRV |
| | | | | ATGACCCGGTTTTGAACGCGTCAGAGGAGCAGGTGCACGCCCCACTAG | GGAGGGG | TCTCCCC | ASYALKIETGVLPAQV |
| | | | | GGGAAGAAGCCAATGACCTCCCTGACAACAACCATCCGTCGGAGCTGG | GGCGGTG | CGGAAG | DDLLRRLRDGDTQSK |
| | | | | GGGTTGACCCCGAAGACCCGACGTGTAGTCCCGCAACGGAACAGGTCC | GCTCCCGC | AGGTCG | VTCEEVEEVVLSLTRT |
| | | | | AACCCTCTTCTGAGGAAGAAGCCGATGACCCGTTTGCGCAATTCAAGGC | CGACGACC | CCTAGG | ILGGTAPKKRVEGRT |
| | | | | GTGGCGAAGAAGGGTGGCTTCCTATGCCTTGAAGATCGAGACCGGGGT | TGGCAAAC | CGACTT | KWTYKSRTNHEARK |
| | | | | TCTTCCAGCCCAAGTAGATGACCTCCTTCGGAGACTGAGGGATGGGGAC | ACCTTGGA | AGAA | RIMYARCQDLYRRRP |
| | | | | ACACAGTCTAAGGTAACGTGCGAGGAGGTGGAGGAAGTGGTTTTATCC | CACGCTAA | (SEQ ID | QRPVERAVGYQAEES |
| | | | | CTCACTAGAACGATACTGGGTGGCACGGCACCCAAAAAGCGCGTTGAG | GATAATAG | NO: | LLDNQDERPSHGAFE |
| | | | | GGTCGAACGAAGTGGACGTACAAAAGTCGAACCAACCATGAGGCTCGC | GCCGTCCT | 1368) | TFYTGLWGKSGQCNI |
| | | | | AAGCGTATAATGTACGCTAGATGCCAGGACTTATATCGCAGGCGGCCTC | CCGGGCCG | | TMPPGVPRHTGHVL |
| | | | | AGCGACCTGTGGAGAGGGCCGTCGGATACCAGGCGGAGGAATCTCTTC | GCCGAATC | | REVTPKDIYSRLRKLK |
| | | | | TTGACAACCAAGATGAGAGACCATCCCACGGAGCCTTTGAAACCTTCTA | ATAAGCAC | | KDYAPGPDGVTKLKV |
| | | | | TACTGGGCTCTGGGGTAAGTCCGGTCAATGCAATATCACAATGCCTCCT | ACA (SEQ | | QSMGAYPSLLAKVY |
| | | | | GGTGTGCCTCGGCACACCGGGCATGTACTGAGGGAAGTTACGCCAAAG | ID NO: | | NLVMLTGYFSSCWK |
| | | | | GACATCTACTCGAGGCTGAGGAAACTAAAGAAAGACTATGCACCCGGC | 1245) | | EHKTSLIPKDRGSPM |
| | | | | CCGGATGGCGTAACTAAATTGAAGGTGCAGAGCATGGGAGCATATCCC | | | DVSNWRPITIGSLLSR |
| | | | | TCACTTCTTGCAAAGGTATATAATCTGGTGATGCTAACCGGTTACTTCTC | | | IYTGLIERRLRTVSDIH |
| | | | | CAGTTGTTGGAAGGAACATAAGACCTCTCTAATTCCTAAGGATAGAGGA | | | QRQVGFMPVNGCA |
| | | | | AGCCCAATGGATGTCAGTAATTGGAGACCGATTACGATTGGCTCCTTAC | | | ANLFIFDECIRQAKKE |
| | | | | TCAGTCGGATTTATACGGGTCTCATAGAACGGAGGCTGAGGACAGTTTC | | | GTIVGSLIDVAKAFDT |
| | | | | TGACATCCACCAAAGGCAGGTAGGGTTTATGCCCGTCAATGGTTGTGCC | | | VPHEAILRALSSQGV |
| | | | | GCCAACTTGTTTATATTTGATGAATGCATCCGACAAGCCAAAAAAGAGG | | | DEHTMAHIRDMYSG |
| | | | | GGACAATTGTCGGCAGTCTTATAGACGTCGCCAAAGCATTTGATACCGT | | | IRTRINGKGSDIPLVR |
| | | | | ACCCCATGAAGCCATCCTACGGGCGTTGAGCTCGCAAGGTGTAGATGA | | | GVKQGDPLSPMLFN |
| | | | | GCACACGATGGCTCACATAAGAGACATGTATTCCGGTATCCGTACGCGG | | | MVMDPLIRDLQRKG |
| | | | | ATCAACGGCAAAGGGAGCGATATCCCTCTGGTGAGAGGAGTGAAGCAA | | | FRIGGHEIGALAFAD |
| | | | | GGTGATCCTCTATCCCCAATGCTCTTTAATATGGTGATGGACCCTCTCAT | | | DIVLLADSIDGAQDH |
| | | | | ACGAGACCTACAGAGGAAGGGCTTCAGAATTGGCGGCCACGAGATAGG | | | VDQVGRYMNKLGM |
| | | | | GGCGTTGGCCTTTGCGGATGACATCGTCTTGTTGGCGGACTCCATTGAT | | | TLNPRKSSSFLITAMR |
| | | | | GGGGCCCAGGATCATGTAGATCAGGTTGGGCGCTACATGAATAAACTG | | | KTWICRDPGLSIGETK |
| | | | | GGCATGACCCTCAATCCACGAAAATCGTCCTCCTTCCTCATCACTGCGAT | | | VPGARPSSALKYLGV |
| | | | | GAGGAAGACCTGGATATGTAGGGACCCGGGCTTGTCAATAGGGGAGA | | | NYTLSEGLESGALIDK |
| | | | | CTAAGGTGCCTGGCGCCAGACCCTCCTCTGCACTTAAATATCTCGGAGT | | | LMQAVNRARGLALK |
| | | | | AAACTACACACTCTCGGAAGGCCTGGAGAGTGGTGCCTTGATAGACAA | | | PLQKVNLILERIIPKFL |
| | | | | GCTCATGCAGGCCGTTAACAGAGCACGAGGTTTGGCCCTTAAACCGCTG | | | YGIILGGPSLTRLHAA |
| | | | | CAAAAGGTCAACCTCATACTTGAACGAATAATCCCCAAATTTTTGTATGG | | | DKCVRMAVKEILHLH |
| | | | | TATCATCCTTGGCGGGCCTAGTTTGACTAGGCTGCATGCAGCCGACAAG | | | PSTTDHVLYARKKDG |
| | | | | TGTGTCAGGATGGCTGTAAAGGAGATCCTGCACCTCCATCCTAGTACAA | | | GMGIPRLAHLVRLAS |
| | | | | CAGACCATGTACTATATGCCAGAAAAAAGGATGGGGGAATGGGGATTC | | | LRSGLALLASGDVAV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CCCGACTGGCTCACCTTGTCCGCCTAGCCAGTCTCAGGTCGGGGTTAGC | | | QAAGMAGDLEGRCK |
| | | | | TCTGTTAGCGAGTGGGGACGTTGCCGTTCAAGCAGCGGGGATGGCAGG | | | KVANDLRLNWPVTL |
| | | | | CGACCTGGAAGGCCGCTGCAAGAAAGTCGCAAATGATTTGCGGCTTAA | | | RDVVRASNKFKSQES |
| | | | | TTGGCCGGTGACGCTGAGAGATGTGGTGAGAGCCAGCAATAAATTTAA | | | KDWERLASQGHGVK |
| | | | | ATCTCAAGAATCAAAAGATTGGGAGCGTCTGGCCTCCCAGGGTCACGG | | | DFRNDRLGNCWLYD |
| | | | | AGTCAAGGACTTCCGGAATGACCGTCTTGGGAATTGCTGGCTCTATGAT | | | PTVLSSSRYTDALRLR |
| | | | | CCGACGGTGTTGTCCAGCAGCAGATACACTGATGCTCTCAGGCTGAGGA | | | TNTFGVNVALRRADK |
| | | | | CTAACACGTTCGGCGTCAACGTTGCCCTAAGGAGGGCCGACAAGGACC | | | DLEVNCRRCHGKPET |
| | | | | TTGAGGTCAACTGTCGGCGATGCCACGGGAAACCTGAAACCTTAGGGC | | | LGHVLGECVAGKGM |
| | | | | ACGTGCTCGGAGAGTGTGTGGCAGGTAAGGGTATGAGGATACAACGAC | | | RIQRHDKMAAFVAT |
| | | | | ACGACAAGATGGCGGCCTTTGTGGCTACAAAATGTGAAGAAAAGGGGT | | | KCEEKGYQTTREQLF |
| | | | | ACCAGACGACCCGCGAACAGCTATTCTCCATCGAGCAGGGAAAACTCAA | | | SIEQGKLKPDLVVIDG |
| | | | | ACCTGACCTCGTCGTAATAGACGGGGAAAGGGCTCTCATTGTCGACGTA | | | ERALIVDVTVRFESG |
| | | | | ACAGTCCGCTTTGAGAGTGGGAACGCCCTCTCACGGGGAGCCTCTGAG | | | NALSRGASEKIEKYQP |
| | | | | AAGATCGAAAAGTATCAGCCTTTGGCTGACTATTTTGTCTCTCAGGGGG | | | LADYFVSQGAVREAN |
| | | | | CTGTTCGAGAAGCCAACGTGTTACCGATTGTTGTCGGTTCCAGGGGAGC | | | VLPIVVGSRGAITQAT |
| | | | | AATCACCCAGGCCACATTGAAGTCCCTAGCTACGCTAGGGTTAGATGTG | | | LKSLATLGLDVERVGK |
| | | | | GAACGTGTTGGCAAGTACCTCGCCATCTGTGCCGTTGCCTCCAGCGTTG | | | YLAICAVASSVEIACM |
| | | | | AGATCGCATGCATGCACCTGGATTACACATAATGTCCCTTTTGGCTTGCC | | | HLDYT (SEQ ID NO: |
| | | | | CCCACCTGCTTAAAGGAACTGGCAGGAAAGAGAGTGATCCGTGCCATA | | | 1490) |
| | | | | GAAATATGGTTATCCGGGGCAAGTCACTAGCAATATGGGACTTCTCCGG | | | |
| | | | | GTCCGTGCGGTCCTTCCAACATGAGCTGGACGTAGTCCACTCTATGACTT | | | |
| | | | | GAACGATACGGGGGCGTATCTCCCCCGGAAGAGGTCGCCTAGGCGACT | | | |
| | | | | TAGAA (SEQ ID NO: 1122) | | | |
| R2 | R2_RL | GU949555 | *Reticul-* | CTCACTGCTGTCATGCCATTGTTAATGCGTTGGGTGATGGCGGGTGATG | CTCACTGC | TGAGTT | MMADYNNSVDHAL |
| | | | *itermes* | GGAGACGAGTTACAGCAGAGCTGGCTTCACGGGGGGGGCTGTAGTTGC | TGTCATGC | AGATAT | EDNTRLIFARDAVLA |
| | | | *lucifugus* | CCGAACCAGTCTGCTTCTGAGTGCCTCCACGTGGCCTCGCTGGAAACGT | CATTGTTA | ATATGA | RVCGPFDNLECGLCG |
| | | | | CGGAGCTGCTTACGGCTAACCCGTAGACAACTCCGGCGGCCAAACTCAG | ATGCGTTG | CGACTG | VLLTSLQGVREHCHR |
| | | | | AAAACGGCCTTACTACCAGGGTCATCCCTCGCGGCGGCGCTAAGACCTT | GGTGATG | ATTCTTC | AHHNLDLTFQCTKCD |
| | | | | ACTGTATGTACTACGGACTACAGTTGAGTAGCGCGGGAGAGCACTTGAT | GCGGGTG | CCTAACT | KGFSSYRGICCHFSKC |
| | | | | GTGAGGGTAGCAACTTGTTGCTACTTCGACTGTCTCCCTGAAGATTTCCG | ATGGGAG | AAAATA | IGARISVSEGPLSCSEC |
| | | | | AAGGGGTGCCGCAAGTCCATGGGGGCGGTCCTGCTGTGGGAGTTATCT | ACGAGTTA | TAATTTG | EREFDSKRALSTHER |
| | | | | TGCACCCGGGAAGCCCTCAGTGGATAAATACTCCAAAATGGCTTAGCCA | CAGCAGA | GAATGT | HMHPGIRNAKRLKD |
| | | | | CCTCACGTGGAGAGAGGGGAATTAGGGGTTTACTCCTAAGGGCCGATG | GCTGGCTT | GCATTA | FNPRGGGKTIHGN |
| | | | | CCTCCAATCGGATTTCCCCGGGCAACGGCTATTATCAGCCGGCTAAGTTC | CACGGGG | CTTATAC | TKWTEEEVQLLVSLS |
| | | | | GGACCCTCATCTACTGATGGGATACTCTCTCTCCCCCCGCCTGCGTGATT | GGGGCTG | TTTATTG | KRFEGYKSINKEISLIL |
| | | | | AGTTGGGAATGCACGCGGGCGGGTGATTCTGACAAGCCCAGCCCAAAA | TAGTTGCC | TATTTAT | TSKTCKQISDKRRYLN |
| | | | | GTTCTTACCACGACGTACCCGGGGGTGTCACCCGAACTAATATATTTTCC | CGAACCAG | TGACAT | LHNGNGGLAAAEAV |
| | | | | GCCGATCGGTTCGCTGTGGGGGGATGTCGGGGCCTGGTGGCCGGGAA | TCTGCTTC | CCGTAG | LEFCEDSHPEVTESD |
| | | | | CCGTCAGCCGCTCTTTGAGTGTCCTGCGTAACCCGGAGGCGGTGACGTC | TGAGTGCC | TAGTCT | GAVLSEIMDEECHQS |
| | | | | GAAGGGCTAGGCTAGCACGGTCCAGACCCCTGAACGCCTGGGGAGACG | TCCACGTG | GTTTAGT | SVTMRSSIVHGDIGR |
| | | | | GGCCCACCACCTGAGTAGGAGTGGGTCCTTTACCTCATTTGAGGTGTCT | GCCTCGCT | GGATTT | EVQGKELVRIPPDNS |
| | | | | CCTCGTTCTTGTAGGGGGCGAAGGACGAGGAATGCATCCGTCCCTCCAG | GGAAACGT | AGATCG | VMGNCVVLLRKLAT |
| | | | | GATGCTGGTGGTTTCCGTCTGGTGGGCTCATGCTGAAACGCGCAGGTGC | CGGAGCTG | TTAACCA | DKRSDLDLSKDKELRI |
| | | | | CGATTTGTCGAAGAGGACATATGGGGTAACCCATAGAACCTAGGCAGG | CTTACGGC | TTCTGTG | DIEKATKANRESADG |
| | | | | AGTAATCCCTTAGCTGGGGGGGTCAGCTGGTGGGTCCTGTCAATTTATC | TAACCCGT | ACGTCG | RVIQSVAGNEIDPDT |
| | | | | CTCCCCTCCATGCCAGAGCCGGTCCGAGGTTAGAGACGGACTCATTTTC | AGACAACT | CTGATG | FQWKELLLGQVRGF |
| | | | | TCCTTTTTATATGTCATGATGGCCGATTATAATAATTCTGTTGATCATGCA | CCGGCGGC | TCTATAT | PRVDENSELFDLDDK |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTTGAGGATAATACTAGATTGATATTTGCGCGTGACGCAGTACTTGCGA | CAAACTCA | GTACCA | LTKELSSDSPVWNDN |
| | | | | GAGTATGTGGACCTTTTGATAACTTGGAGTGCGGGTTGTGTGGGGTGCT | GAAAACG | GTGGCA | CELIVSDLCQVLCKKK |
| | | | | CCTGACGTCCCTTCAGGGCGTTCGAGAGCATTGCCACCGGGCGCACCAT | GCCTTACT | GAATGC | YELGRQHHVRKGKR |
| | | | | AACTTGGATTTGACTTTTCAATGTACTAAATGCGATAAAGGGTTTTCCTC | ACCAGGGT | TGACTA | HRGIHHKREKFRECQ |
| | | | | GTATAGGGGAATTTGTTGTCATTTTTCAAAGTGTATAGGAGCTCGTATAT | CATCCCTC | AGAACA | KIFRKSPRKLAEYLYR |
| | | | | CTGTTTCAGAGGGCCCCCTTAGTTGTTCAGAATGTGAAAGGGAATTTGA | GCGGCGG | AAATAA | DKDLSHISKDASTPQ |
| | | | | CTCTAAAAGAGCTCTTTCAACCCACGAGAGGCATATGCACCCAGGGATT | CGCTAAGA | TTTTAAA | GIEQYYSQLWGEPEL |
| | | | | AGGAATGCTAAGAGGCTCAAAGATTTTAATCCGCGGGGGGGGGGTGGT | CCTTACTG | CAATAG | LESNTIEEKLPSSSLFD |
| | | | | AAAACTATTCACGGCAATACTAAGTGGACTGAAGAGGAGGTCCAGTTG | TATGTACT | ACAGCA | CLPPITPEEVEGRIHKI |
| | | | | CTTGTATCACTTAGCAAGAGATTTGAGGGGTATAAGTCTATCAATAAAG | ACGGACTA | CTAAGA | RPSSAPGLDGVRKIH |
| | | | | AAATTAGCCTTATTTTAACATCAAAAACTTGTAAACAAATTTCTGATAAA | CAGTTGAG | AATTCTG | LVGKGITLVLVKLYNL |
| | | | | CGTCGCTATTTAAATTTGCATAATGGAAATGGGGGGCTAGCTGCAGCGG | TAGCGCGG | CAAACT | LFLTGGYPECWKRNR |
| | | | | AAGCTGTATTAGAATTTTGTGAAGATAGTCACCCTGAAGTTACTGAGAG | GAGAGCA | GGAACG | TVFIPKIGKDLSEVGG |
| | | | | CGATGGGGCGGTGCTTTCTGAAATCATGGATGAGGAATGTCATCAGTCA | CTTGATGT | TGGCCC | WRPLTIGSLLARMYS |
| | | | | TCGGTAACTATGAGGTCAAGCATCGTACATGGCGACATTGGTCGTGAG | GAGGGTA | ACGGTA | AFLERRIRRVTSLSLS |
| | | | | GTTCAAGGGAAGGAATTGGTCCGGATCCCGCCTGATAATAGTGTAATG | GCAACTTG | GGCCAA | QRGFTNIQGCHVNLT |
| | | | | GGGAATTGTGTTGTTCTACTTAGGAAACTTGCTACTGACAAAAGAAGTG | TTGCTACT | TATACC | ILKEGIRQAKVKNGG |
| | | | | ATTTGGACTTGAGTAAGGATAAAGAGTTGCGCATTGACATTGAGAAGG | TCGACTGT | GGAAAG | VIVSVDIEKAFDTIPHS |
| | | | | CGACGAAAGCTAACAGAGAAAGCGCAGACGGTAGGGTAATTCAATCTG | CTCCCTGA | GGAAAA | VIFSRLASQGVPPLLR |
| | | | | TGGCTGGTAATGAGATCGATCCCGATACTTTTCAATGGAAAGAATTGCT | AGATTTCC | TGACAC | KIISNMYKDVYTVIEG |
| | | | | GCTTGGGCAGGTACGGGGGTTTCCACGAGTTGATGAGAACTCTGAATT | GAAGGGG | ATCCCCC | QCIPIKRGVKQGDPL |
| | | | | ATTTGATTTGGATGACAAATTGACTAAGGAATTATCTTCCGACAGCCCCG | TGCCGCAA | CTTAAA | SPLLFNIAIDPVLRSLE |
| | | | | TGTGGAATGACAACTGCGAACTTATTGTGTCGGACTTATGTCAGGTCTT | GTCCATGG | (SEQ ID | EFQGGLPLGNSAIKIL |
| | | | | ATGCAAAAAGAAATATGAGTTAGGTAGGCAGCATCACGTTAGGAAAGG | GGGCGGT | NO: | AFADDIILGASSAGQ |
| | | | | AAAGAGGCATCGGGGTATACATCATAAGAGGGAGAAATTTAGGGAATG | CCTGCTGT | 1369) | AQQMVDMLGIGLTS |
| | | | | CCAGAAGATATTTAGAAAGTCCCCCAGAAAGCTTGCCGAATATCTCTAC | GGGAGTTA | | CGLGVSHRKCFGFQI |
| | | | | CGTGATAAGGACCTGTCTCATATCAGTAAAGACGCTAGCACTCCGCAGG | TCTTGCAC | | VNKNKTWTIVDPMI |
| | | | | GTATAGAGCAATACTATTCTCAGTTATGGGGGGAACCTGAATTACTAGA | CCGGGAA | | TLNGSSLPFSGPEDRL |
| | | | | ATCCAACACAATTGAAGAAAAGTTACCGTCCAGTTCCTTATTTGACTGTC | GCCCTCAG | | PYLGVDINPWDRKSR |
| | | | | TTCCCCCCATCACGCCGGAGGAGGTTGAGGGAAGAATCCATAAGATTC | TGGATAAA | | YDAGQRLISAAKRGS |
| | | | | GACCGTCTTCCGCCCCAGGGTTGGATGGGGTACGCAAGATCCATCTTGT | TACTCCAA | | QLSLKPQQKINLITAF |
| | | | | CGGTAAAGGGATAACCCTGGTCCTTGTTAAACTCTACAACTTGCTATTTT | AATGGCTT | | LLPKFLYILIEDPPSPA |
| | | | | TGACTGGGGGATATCCTGAGTGTTGGAAGCGGAACAGGACCGTCTTTA | AGCCACCT | | YLKSIDHDLRQIYKNIL |
| | | | | TACCGAAGATTGGGAAAGATCTGAGTGAGGTGGGAGGATGGAGACCG | CACGTGGA | | HLPNCVSTAFMYSPK |
| | | | | TTGACAATTGGTTCCCTATTAGCTCGGATGTATTCAGCCTTCCTAGAGAG | GAGAGGG | | RDGGLGLPRLSCLVPL |
| | | | | GAGGATTAGGAGGGTGACCTCCTTGTCCTTGTCGCAGAGGGGCTTTACG | GAATTAGG | | AHLKAGIKLGSLQDSL |
| | | | | AATATCCAAGGTTGTCACGTTAATTTGACTATCCTCAAAGAAGGCATTCG | GGTTTACT | | VREITTSDRFVRTMG |
| | | | | ACAGGCCAAAGTCAAGAACGGGGGAGTTATAGTCTCAGTAGACATAGA | CCTAAGGG | | SVAHSLWASWSLTL |
| | | | | GAAGGCTTTTGACACAATCCCTCATTCTGTAATTTTCTCCCGCTTGGCGTC | CCGATGCC | | QDIYKLKSALKRREAK |
| | | | | TCAAGGTGTTCCTCCCCTTCTTAGGAAAATTATTTCCAATATGTATAAGG | TCCAATCG | | AWESCVSQGQGAA |
| | | | | ATGTCTACACTGTGATTGAGGGGCAGTGTATTCCAATAAAGAGAGGAG | GATTTCCC | | QFRGDSIGNNWLHN |
| | | | | TTAAACAAGGGGATCCTCTTTCTCCACTACTTTTCAATATTGCCATCGATC | CGGGCAAC | | PGTYRPGQYIEALKLR |
| | | | | CTGTGTTGCGCAGTTTGGAGGAGTTTCAGGGGGGTCTCCCACTTGGTAA | GGCTATTA | | ANLTGVRVNLKRSGY |
| | | | | CTCGGCTATTAAGATCTTGGCCTTTGCTGATGATATTATATTAGGAGCTA | TCAGCCGG | | NVPITCRFCKDIPETQ |
| | | | | GTTCGGCGGGTCAGGCGCAGCAGATGGTGGATATGTTGGGAATAGGAC | CTAAGTTC | | AHVLGLCPKTKGMRI |
| | | | | TTACTTCGTGTGGGTTGGGAGTATCCCATAGAAAATGTTTTGGATTTCAA | GGACCCTC | | QRHDSIVNRVRDKLK |
| | | | | ATCGTGAATAAAAACAAGACCTGGACAATTGTTGACCCGATGATCACAC | ATCTACTG | | TKSPVALMHEQNFT |
| | | | | TCAATGGTTCTTCATTACCCTTCTCAGGGCCAGAGGACAGGTTGCCTTAT | ATGGGATA | | VEEGQVFKPDIVTILG |
| | | | | CTCGGGGTGGATATAAACCCATGGGATAGGAAATCACGGTATGACGCT | CTCTCTCTC | | EVGYVIDVTVRYDDR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGACAGAGACTTATTTCGGCGGCCAAACGAGGCTCTCAACTATCCCTTA<br>AGCCTCAGCAAAAGATAAATTTAATAACAGCTTTTCTTTTGCCAAAGTTT<br>CTGTACATTCTGATTGAAGATCCGCCTTCGCCTGCCTATCTGAAATCCAT<br>CGATCATGACCTGAGGCAGATATATAAGAATATTTTGCACCTCCCTAACT<br>GTGTGTCAACCGCCTTTATGTACTCTCCCAAGAGGGATGGTGGTTTGGG<br>GCTACCGCGTCTGTCCTGTCTAGTTCCACTTGCCCATTTAAAAGCCGGGA<br>TCAAGCTCGGTTCCCTCCAAGATTCTTTGGTTAGGGAAATTACCACCTCA<br>GACAGGTTTGTACGTACAATGGGTTCGGTAGCTCACTCCCTTTGGGCAT<br>CATGGTCTCTAACGTTGCAGGATATCTATAAACTTAAGTCCGCACTGAAA<br>CGTAGGGAAGCTAAGGCATGGGAGAGTTGTGTGTCTCAGGGACAAGG<br>AGCAGCGCAATTTCGCGGGGACTCAATTGGAAACAACTGGCTCCATAAT<br>CCGGGAACCTATCGACCTGGACAGTATATCGAAGCACTTAAGCTTCGTG<br>CTAATTTAACAGGGGTTAGAGTCAACTTGAAGCGTTCAGGCTATAATGT<br>TCCAATAACTTGTAGGTTCTGTAAGGATATACCTGAAACGCAGGCTCAT<br>GTTCTTGGACTTTGTCCAAAGACCAAGGGAATGAGAATACAAAGGCAC<br>GATTCAATTGTGAATAGGGTGCGAGATAAACTTAAGACTAAGTCGCCCG<br>TTGCTCTCATGCATGAGCAAAACTTCACCGTTGAGGAAGGCCAGGTGTT<br>CAAACCAGATATAGTGACGATTTTGGGAGAGGTGGGTTACGTAATTGAT<br>GTGACAGTACGGTATGACGATAGAGATTACATCAAGGATGCCTCTGTG<br>GAAAAAATCAGGAAATACGAGGCCCTTAAAGGGTACCTGAAGGATTTA<br>TATCCACAGCTGAATAAGGTAGAGGTTTTGCCTCTTGTCTTTGGTAGCAG<br>AGGGGCCGTGCCAGGTAGTACTGTTCACAACATGGGATTGTTAGGTTTT<br>ACGAAACGTGAAATGGTCCACATCTCTCGCAAAGTTATAGCCGACTCAC<br>TGATAATCTCTAATTTTTTAGAGGTTTATTGAGTTAGATATATATGACGA<br>CTGATTCTTCCCTAACTAAAATATAATTTGGAATGTGCATTACTTATACTT<br>TATTGTATTTATTGACATCCGTAGTAGTCTGTTTAGTGGATTTAGATCGT<br>TAACCATTCTGTGACGTCGCTGATGTCTATATGTACCAGTGGCAGAATG<br>CTGACTAAGAACAAAATAATTTTAAACAATAGACAGCACTAAGAAATTC<br>TGCAAACTGGAACGTGGCCCACGGTAGGCCAATATACCGGAAAGGGAA<br>AATGACACATCCCCCCTTAAA (SEQ ID NO: 1123) | CCCCCGCC<br>TGCGTGAT<br>TAGTTGGG<br>AATGCACG<br>CGGGCGG<br>GTGATTCT<br>GACAAGCC<br>CAGCCCAA<br>AAGTTCTT<br>ACCACGAC<br>GTACCCGG<br>GGGTGTCA<br>CCCGAACT<br>AATATATT<br>TTCCGCCG<br>ATCGGTTC<br>GCTGTGG<br>GGGGATG<br>TCGGGGCC<br>TGGTGGCC<br>GGGAACC<br>GTCAGCCG<br>CTCTTTGA<br>GTGTCCTG<br>CGTAACCC<br>GGAGGCG<br>GTGACGTC<br>GAAGGGC<br>TAGGCTAG<br>CACGGTCC<br>AGACCCCT<br>GAACGCCT<br>GGGGAGA<br>CGGGCCCA<br>CCACCTGA<br>GTAGGAGT<br>GGGTCCTT<br>TACCTCAT<br>TTGAGGTG<br>TCTCCTCG<br>TTCTTGTA<br>GGGGGCG<br>AAGGACG<br>AGGAATGC<br>ATCCGTCC<br>CTCCAGGA<br>TGCTGGTG<br>GTTTCCGT<br>CTGGTGG | | DYIKDASVEKIRKYEA<br>LKGYLKDLYPQLNKV<br>EVLPLVFGSRGAVPG<br>STVHNMGLLGFTKRE<br>MVHISRKVIADSLIIS<br>NFLEVY (SEQ ID NO:<br>1491) |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | GCTCATGC | | |
| | | | | | TGAAACGC | | |
| | | | | | GCAGGTGC | | |
| | | | | | CGATTTGT | | |
| | | | | | CGAAGAG | | |
| | | | | | GACATATG | | |
| | | | | | GGGTAACC | | |
| | | | | | CATAGAAC | | |
| | | | | | CTAGGCAG | | |
| | | | | | GAGTAATC | | |
| | | | | | CCTTAGCT | | |
| | | | | | GGGGGGG | | |
| | | | | | TCAGCTGG | | |
| | | | | | TGGGTCCT | | |
| | | | | | GTCAATTT | | |
| | | | | | ATCCTCCC | | |
| | | | | | CTCCATGC | | |
| | | | | | CAGAGCCG | | |
| | | | | | GTCCGAGG | | |
| | | | | | TTAGAGAC | | |
| | | | | | GGACTCAT | | |
| | | | | | TTTCTCCTT | | |
| | | | | | TTTATATG | | |
| | | | | | TC (SEQ ID NO: 1246) | | |
| R2 | R2_RU | GU949554 | *Reticul-itermes urbis* | CACACTGCTGTCATGCCATTGTTAATTCGTTGGGTGATGGCGGGTGATG | CACACTGC | TGAGTT | MMADYNNSVDHAL |
| | | | | GGAGACGAGTTACAGCAGAGCTGGCTTCACGGGGGGGCTGTAGTGGC | TGTCATGC | AGATAT | EDDTRFIFARDSVLAR |
| | | | | CCGAACCAGTCTGCTTCTGAGTGCCCCCAAGTGGCCTCGCTGGAAACGT | CATTGTTA | ATATAA | VCGHFDNLKCELCGV |
| | | | | CGGAGCTGCTTACGGTTAACCCGTAGACAACTCCGGCGGCCAAACTCAG | ATTCGTTG | CGACTG | LLTSLQGVREHCHRS |
| | | | | AAAACGGCCTTACTACCAGGGCCATCCCTTGCGGTTGCGCTAAGACCTT | GGTGATG | ATTCTTC | HHNLDLTFQCTKCDK |
| | | | | ACTGTATGTACTACGGACTACAGTTGAGTAGCGCGGGAGAGCACTCGA | GCGGGTG | CCTAACT | GFSSYRGICCHFSKCR |
| | | | | TGTGAGGGTAGCAACTTGTTGCTTCTTCGACTGTCTCCCTGAAGAGTTCC | ATGGGAG | AAAATA | GARISVSEGPLSCSEC |
| | | | | GAAGAGGTGCCGCAAGTCCATGGGGGCGACCCGGCTGTGGGAGTTATC | ACGAGTTA | TAATTTG | ERKFDSKRALSTHER |
| | | | | CTGCACCCGGGAAGCCCTCAGTGGATAAATACTCCAAAATGGCTTAGCC | CAGCAGA | GAATGT | HMHPGIRNAKRLKD |
| | | | | ACCTCACGTGGAGAGAGGGGAATTAGGGGTTTACTCCTAAGGGCCGAT | GCTGGCTT | GCATTA | FNPRGGGKTIHGNTK |
| | | | | GCCTCCAATCGGATTTCCCAGGGCAACGGCTATTATCAGCCGGCTAAGT | CACGGGG | CTTATAC | WTEEEVQLLVSLSKR |
| | | | | TCGGACCCTCATCTACCGATGGGATACTCTCTCTCCCCCCGCCTGCGTGA | GGGCTGTA | TTTATTG | FEGYKSINKEISLILTSK |
| | | | | TTAATTGGGAATGCACGAGGGCGGGTGATTCTGACAAGCCCAGCCCAA | GTGGCCCG | TATTTAT | TCKQISDKRRYLNLH |
| | | | | AAGTTCTTACCACGACGTACCCGGGGGTGTCACCCGAACTAATATATTTT | AACCAGTC | TGACAT | NGNGGLAAAEAVLV |
| | | | | CCACCGATCGGTTCGCTGTGGGGGGATGTCGGGGCCTGGTGGCCAGGA | TGCTTCTG | CCGTAG | FCDDSHLEVTDSDGA |
| | | | | ACCGTCAGCCGCTCTTTGAGTGTCCTGCGTAACCCGGAGGCGGTGACGT | AGTGCCCC | TAGTCT | VLSEIMDEEYYQSSLT |
| | | | | CGAAGGGCTAGGCTAGCACGGTCCAGACCCCTGAACGCCTGGGGAGAC | CAAGTGGC | GTTTAGT | MRSSIVHGDIGREVQ |
| | | | | GGGCCCACCACCTGTGTAGGAGTGGGTCCTTTACCTCATTTGAGGTGTC | CTCGCTGG | GGATTT | GKDLVRIPPDNSVM |
| | | | | TCCTCGGTCTAGTAGGGGGCGAAGGACGAGGGATGCATCCGTCCCTCC | AAACGTCG | AGATCG | GNCVVLLRKLATEKR |
| | | | | AGGATGCTGGTGGTTTCCGTCTGGTGGGCTCATGCTGAAACCCGCAGGT | GAGCTGCT | TTAACCA | SDLDLSKDKELRIDIEK |
| | | | | GCCGATTTGTCGAAGAGGACATATGGGGTAACCCATAGAACCTAGGCA | TACGGTTA | TTCTGTG | ATKANRESADGRVIQ |
| | | | | GGAGTAATCCCTTAGCTGGGGGGGTCAGCTGGTGGGTCCTGTCAATTTA | ACCCGTAG | ACGTCG | SVADNEIDPDTFQW |
| | | | | TCCTCCCCTCCATGCCAGAGCCGGTCCGAGGTTAGAGACGGACTCATTT | ACAACTCC | CTGATG | KELLLGQVRGFPRVD |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TCTCCTTTTTATATGTCATGATGGCCGATTATAATAATTCTGTTGATCATG | GGCGGCC | TCTACAT | ENSELFDLDDKLTSEL |
| | | | | CACTTGAGGATGATACTAGATTTATATTTGCGCGTGATTCAGTACTTGCG | AAACTCAG | GTACCA | SSDSPVWNDNCELIV |
| | | | | AGAGTATGTGGACATTTCGATAACTTGAAGTGTGAGTTATGTGGAGTGC | AAAACGGC | GTGGCA | SDLCHVLCKNKYELG |
| | | | | TCCTTACGTCCCTTCAGGGCGTTCGGGAGCATTGCCACCGGTCGCACCA | CTTACTAC | GAATGC | RQHHVRKGKRHRGI |
| | | | | TAACTTGGATTTGACTTTTCAATGTACTAAATGCGATAAAGGGTTTTCCT | CAGGGCCA | TGACTA | HHKREKFRECQKIFR |
| | | | | CGTATAGGGGAATTTGTTGTCATTTTTCGAAGTGTAGAGGAGCTCGTAT | TCCCTTGC | AGAACA | KSPRKLAEYLYRDKDL |
| | | | | ATCTGTTTCAGAGGGCCCCCTTAGTTGTTCAGAATGTGAGAGGAAATTT | GGTTGCGC | AAATAA | SHISKDVSTPQGIEQY |
| | | | | GACTCTAAAAGAGCTCTTTCAACCCACGAGAGGCATATGCACCCAGGGA | TAAGACCT | TTTTAAA | YSQLWGKPELLESNT |
| | | | | TTAGGAATGCTAAGAGGCTCAAAGATTTTAATCCGCGGGGGGGTGGTA | TACTGTAT | CAATAG | TEEMLPSSSLFDCLPP |
| | | | | AAACTATTCACGGCAATACTAAGTGGACCGAAGAGGAGGTCCAATTGCT | GTACTACG | ACAGCA | ITPEEVEGRIHKIRPSS |
| | | | | TGTATCACTTAGCAAGAGATTTGAAGGGTATAAGTCTATCAATAAAGAA | GACTACAG | CTAAGA | APGLDGVGKIHLVGK |
| | | | | ATTAGCCTTATTTTAACATCAAAAACTTGTAAACAAATTTCTGATAAACG | TTGAGTAG | AATTCTG | GITLVLAKLYNLLFLTG |
| | | | | TCGCTATTTAAATTTGCATAATGGAAATGGGGGGCTAGCGGCAGCGGA | CGCGGGA | CAAACT | GYPECWKRNRTVFIP |
| | | | | AGCTGTATTAGTATTTTGTGATGATAGTCACCTTGAAGTTACTGACAGCG | GAGCACTC | GGAACG | KIGKDLSEVGGWRPL |
| | | | | ATGGGGCGGTGCTTTCTGAAATCATGGATGAGGAATATTATCAGTCATC | GATGTGAG | TGGCCC | TIGSLLARMYSAFLER |
| | | | | GCTAACTATGAGGTCAAGCATCGTACATGGCGACATTGGTCGTGAGGTT | GGTAGCAA | ACGGTA | RIRRVTSLSSSQRGFT |
| | | | | CAAGGGAAGGATTTGGTCCGGATCCCGCCTGATAATAGTGTAATGGGG | CTTGTTGC | GGCCAA | NIQGCHVNLTILKEGI |
| | | | | AATTGTGTTGTTCTACTTAGAAAACTTGCTACTGAAAAAAGAAGTGATTT | TTCTTCGA | TATACC | RQAKVKNGGVIVSV |
| | | | | GGACTTGAGTAAGGATAAAGAGTTGCGCATTGACATTGAGAAGGCGAC | CTGTCTCC | GGAAAG | DIEKAFDTIPHSVIFSR |
| | | | | GAAAGCTAACAGAGAAAGCGCAGATGGTAGGGTAATTCAATCTGTGGC | CTGAAGAG | GGAAAA | LASQGVPPLLRKIISN |
| | | | | TGATAATGAGATCGATCCCGATACTTTTCAATGGAAAGAATTGCTTCTTG | TTCCGAAG | TGACAA | MYKDVYTVIEGQCIPI |
| | | | | GGCAGGTACGGGGGTTTCCACGAGTTGATGAGAACTCTGAATTATTTGA | AGGTGCCG | ATCCCCC | KRGVKQGDPLFPLLF |
| | | | | TTTGGATGACAAATTGACTAGTGAATTATCTTCCGACAGCCCCGTGTGG | CAAGTCCA | CTTAAA | NIAIDPVLRSLEEFQG |
| | | | | AATGACAACTGCGAACTTATTGTGTCGGACTTATGTCACGTCTTATGCAA | TGGGGGC | (SEQ ID | GLPLGNSAIKILAFDD |
| | | | | AAATAAATATGAGTTAGGTAGGCAGCATCACGTTAGGAAAGGAAAGAG | GACCCGGC | NO: | DIILGASSAGQAQQ |
| | | | | GCATCGGGGTATACATCATAAGAGGGAGAAATTTAGGGAATGCCAGAA | TGTGGGA | 1370) | MVDMLGIGLTSCGL |
| | | | | GATATTTAGAAAGTCCCCCAGAAAGCTTGCCGAATATCTCTACCGCGAT | GTTATCCT | | GVSHRKCFGFQIVNK |
| | | | | AAGGACCTGTCTCATATCAGTAAAGACGTTAGCACTCCGCAGGGTATAG | GCACCCGG | | NKTWAIVDPMITLN |
| | | | | AGCAATACTATTCTCAGTTATGGGGGAAACCTGAATTACTAGAATCCAA | GAAGCCCT | | GSSLPFSGPEDRLPYL |
| | | | | CACAACTGAAGAAATGTTACCTTCCAGTTCCTTATTTGACTGTCTTCCTCC | CAGTGGAT | | GVDTNPWDRKSRYD |
| | | | | CATCACGCCGGAGGAGGTTGAGGGGAGAATCCATAAGATTCGACCGTC | AAATACTC | | AGQRLISAAKRGSQL |
| | | | | TTCCGCCCCAGGGTTGGATGGGGTAGGCAAGATCCATCTTGTCGGTAAA | CAAAATGG | | SLKPQQKINLITTFLLP |
| | | | | GGGATAACCCTGGTCCTTGCTAAACTCTACAACTTGCTATTTTTGACTGG | CTTAGCCA | | KFLYILIEDPPSPAYLK |
| | | | | GGGATATCCTGAGTGTTGGAAGCGGAACAGGACCGTCTTCATACCGAA | CCTCACGT | | SIDHDLRQIYKNILHL |
| | | | | GATCGGGAAAGATCTGAGTGAGGTGGGAGGATGGAGACCGCTGACAA | GGAGAGA | | PNCVSTAFMYSPKRD |
| | | | | TTGGCTCCCTATTAGCTCGGATGTATTCAGCCTTCCTAGAGAGGAGGATT | GGGGAATT | | GGLGLPRLSCLVPLA |
| | | | | AGAAGGGTGACTTCCTTGTCCTCGTCACAGAGGGGCTTTACGAATATTC | AGGGGTTT | | HIKAGIKLGSLQDSLV |
| | | | | AAGGTTGTCACGTTAATTTGACTATCCTCAAAGAAGGCATTCGACAGGC | ACTCCTAA | | REITTSDRFVRTMGS |
| | | | | CAAAGTTAAGAACGGGGGAGTTATAGTTTCAGTAGACATAGAGAAGGC | GGGCCGAT | | VSHSIGASWPLTLQD |
| | | | | TTTTGACACAATCCCCCATTCTGTAATTTTTTCCCGCTTGGCGTCTCAAGG | GCCTCCAA | | IYKLKSALKRREAKA |
| | | | | TGTTCCTCCCCTTCTTAGGAAAATTATTTCCAATATGTATAAGGATGTTTA | TCGGATTT | | WESCVSQGQGAAQF |
| | | | | CACCGTGATTGAGGGACAGTGTATTCCAATAAAGAGAGGAGTTAAACA | CCCAGGGC | | RGDSIGNNWLHNPG |
| | | | | AGGGGATCCTCTTTTTCCACTACTTTTCAATATTGCCATCGATCCTGTGTT | AACGGCTA | | TFRPGQYIEALKLRAN |
| | | | | GCGCAGTTTGGAGGAGTTTCAGGGGGGTCTCCCACTTGGTAACTCGGCT | TTATCAGC | | STGVRVNLKRSGYNV |
| | | | | ATTAAGATCTTGGCCTTTGATGATGATATTATATTAGGAGCTAGTTCGGC | CGGCTAAG | | PITCRFCKDIPETQAH |
| | | | | GGGTCAGGCGCAGCAGATGGTGGATATGTTGGGAATAGGACTTACTTC | TTCGGACC | | VLGLCPKTKGMRILR |
| | | | | GTGTGGGTTGGGAGTATCCCATAGAAAATGTTTTGGATTTCAAATCGTG | CTCATCTA | | HDSIVNRVRDKLKTK |
| | | | | AATAAAAACAAGACCTGGGCAATTGTTGACCCAATGATCACACTCAATG | CCGATGGG | | SPVALMHEQNFTVE |
| | | | | GTTCTTCATTACCCTTCTCAGGGCCAGAAGACAGGCTGCCTTATCTCGGG | ATACTCTC | | EGQVFKPDIVTILGEV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GTGGATACAAACCCATGGGATAGGAAATCACGGTATGACGCTGGACAGAGACTTATTTCGGCTGCCAAACGAGGCTCTCAACTATCCCTTAAGCCTCAGCAAAAGATAAATTTAATAACAACTTTTCTTTTGCCGAAGTTTTTGTACATTCTGATTGAAGATCCGCCTTCGCCTGCCTATCTGAAATCCATCGATCATGACCTGAGGCAGATATATAAGAATATTTTGCACCTCCCTAACTGCGTGTCAACCGCCTTTATGTACTCTCCCAAGAGGGATGGTGGCTTGGGGCTACCGCGTCTGTCCTGTCTTGTTCCTCTTGCCCATATAAAAGCCGGGATCAAGCTTGGTTCCCTCCAAGATTCTTTGGTTAGGGAAATTACCACCTCAGACAGGTTTGTACGTACGATGGGTTCGGTATCTCACTCCATTGGGGCATCATGGCCTCTAACGTTGCAGGATATCTATAAACTTAAGTCCGCACTGAAACGTAGGGAAGCTAAGGCATGGGAGAGTTGTGTGTCTCAGGGACAAGGAGCAGCGCAATTTCGAGGGGACTCAATTGGAAACAACTGGCTCCATAATCCGGGAACCTTTCGACCTGGACAGTATATCGAAGCACTTAAGCTTCGTGCTAATTCAACAGGGGTTAGAGTCAACTTGAAGCGTTCAGGCTATAATGTTCCAATAACTTGTAGGTTCTGTAAGGATATACCTGAAACGCAGGCTCATGTTCTTGGACTTTGTCCAAAGACCAAGGGAATGAGAATACTAAGGCACGACTCAATTGTGAATAGGGTGCGAGATAAACTTAAGACTAAGTCGCCCGTTGCTCTCATGCATGAGCAAAATTTCACTGTTGAGGAAGGCCAGGTGTTCAAACCAGATATAGTGACGATTTTGGGAGAGGTGGGTTACGTAATTGATGTGACGGTACGGTATGAAGATAGAGATTACATCAAGGATGCCTCTGTGGAAAAAATCAGGAAATACGAGGCCCTTAAAGGGTACTTGAAGGATCTGTATCCACAGCTGAATAAGGTAGAGGTATTGCCTCTTGTCTTTGGTAGCAGAGGGGCCGTGCCAGGTAGTACTGTTCACAACATGGGATTGTTAGGTTTTACGAAACGTGAAATGGTCCACATCTCTCGCAAAGTTATTACCGACTCACTGATAATAATCTCTAATTTTTTAGAGGTTTATTGAGTTAGATATATATAACGACTGATTCTTCCCTAACTAAAATATAATTTGGAATGTGCATTACTTATACTTTATTGTATTTATTGACATCCGTAGTAGTCTGTTTAGTGGATTTAGATCGTTAACCATTCTGTGACGTCGCTGATGTCTACATGTACCAGTGGCAGAATGCTGACTAAGAACAAAATAATTTTAAACAATAGACAGCACTAAGAAATTCTGCAAACTGGAACGTGGCCCACGGTAGGCCAATATACCGGAAAGGGAAAATGACAAATCCCCCCTTAAA (SEQ ID NO: 1124) | TCTCCCCCCGCCTGCGTGATTAATTGGGAATGCACGAGGGCGGGTGATTCTGACAAGCCCAGCCCAAAAGTTCTTACCACGACGTACCCGGGGGTGTCACCCGAACTAATATATTTTCCACCGATCGGTTCGCTGTGGGGGGATGTCGGGGCCTGGTGGCCAGGAACCGTCAGCCGCTCTTTGAGTGTCCTGCGTAACCCGGAGGCGGTGACGTCGAAGGGCTAGGCTAGCACGGTCCAGACCCCTGAACGCCTGGGGAGACGGGCCCACCACCTGTGTAGGAGTGGGTCCTTTACCTCATTTGAGGTGTCTCCTCGGTCTAGTAGGGGGCGAAGGACGAGGGATGCATCCGTCCCTCCAGGATGCTGGTGGTTTCCGTCTGG | | GYVIDVTVRYEDRDYIKDASVEKIRKYEALKGYLKDLYPQLNKVEVLPLVFGSRGAVPGSTVHNMGLLGFTKREMVHISRKVITDSLIIISNFLEVY (SEQ ID NO: 1492) |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | TGGGCTCA | | |
| | | | | | TGCTGAAA | | |
| | | | | | CCCGCAGG | | |
| | | | | | TGCCGATT | | |
| | | | | | TGTCGAAG | | |
| | | | | | AGGACATA | | |
| | | | | | TGGGGTAA | | |
| | | | | | CCCATAGA | | |
| | | | | | ACCTAGGC | | |
| | | | | | AGGAGTA | | |
| | | | | | ATCCCTTA | | |
| | | | | | GCTGGGG | | |
| | | | | | GGGTCAGC | | |
| | | | | | TGGTGGGT | | |
| | | | | | CCTGTCAA | | |
| | | | | | TTTATCCTC | | |
| | | | | | CCCTCCAT | | |
| | | | | | GCCAGAGC | | |
| | | | | | CGGTCCGA | | |
| | | | | | GGTTAGAG | | |
| | | | | | ACGGACTC | | |
| | | | | | ATTTTCTCC | | |
| | | | | | TTTTTATAT | | |
| | | | | | GTC (SEQ | | |
| | | | | | ID NO: | | |
| | | | | | 1247) | | |
| R2 | RaR2 | FJ461304 | *Rhyncho-* | CAGAACGTGGAGAAACGGAATAACTACCCAGATCCGTTGGTTAACCGG | CAGAACGT | TAGAAA | MSNYNETNTSGGDN |
| | | | *sciara* | TGGCAAAGTTAATCAAGGTTGCCATAGGCTTAATAACCCTATGGAAATG | GGAGAAA | TGTGTG | PRMATQTTGSLSSGP |
| | | | *americana* | TTTCCACACACCTCCACGTGGTGCCTGCCGGAAATTGTTCTAGGGTGAA | CGGAATAA | CGATAA | INQHTCELCCRTFGT |
| | | | | CAAGCTAAGTIGTGAGAAACGGGCTCCACCACAATATGGAGCCTGCCA | CTACCCAG | GGTGTG | RAGLGQHVRKTHPIE |
| | | | | GGGCGCGAGACTCAGGACTCTCCATGTACAAAGTGGTTAGTTGCAAAA | ATCCGTTG | AATAGA | SNQSINVERKKRRWS |
| | | | | AGAGTGCGCCTAGCATGACTGATAATTTTTCACTGAAATAACGTTGAAC | GTTAACCG | AGGGTT | PEEIRRMANMEAQA |
| | | | | TTTATCTGTGTCATGTGCACAACACTATGGTGTCTGATCAAGCACCATCA | GTGGCAAA | CACCAA | TINNIKHLTQYLATYL |
| | | | | GTGGTGGACCTGCTAATGTATTAGTAGAACGTGTCCAGGCGATAATGCA | GTTAATCA | GAGGGA | PQRTLNAIKGRRRDA |
| | | | | CACACGGCCTCCGGGCCCATCGCTTTTTTTGAGATTCCCTAGAAACTTCA | AGGTTGCC | GACCTA | EYKELVTGIIANLRSN |
| | | | | GTGTGTGCGACAACTGTATAACCCATAAGGGATGGACAAAGGTTATACT | ATAGGCTT | GTTTGG | SSTQQTNQVCNESE |
| | | | | AGGGGGTAAAAACCCTAATCGGCTAATGGCAAATGGGATGTAGAAATG | AATAACCC | ACCTCA | MSQRSKILQSIRESVR |
| | | | | CCAAAGATTACTCGCACCGAATAATGGTGGCCGAAAAGCGGGTAATCG | TATGGAAA | GAAATG | DLRSRRNKYAKALQE |
| | | | | AATGAAATGGTAATGCTGTAGCGGAAACATGATCACATTCTGTGACAGT | TGTTTCCA | GGGTCA | LGEAALCGKMLNEE |
| | | | | AAACCATTAGACCTAGGGGGAACTATGATTAACAAGATACCAGCTTACA | CACACCTC | TAGGAG | QLIHCIKSMFNTAKC |
| | | | | TGGAAGCAATGAAATGTAAGTCACAGTAGTGATAAGTGGTGAAGAGTC | CACGTGGT | TGATAG | PKGPRFRKTATHSGT |
| | | | | TTGTAATCACCGTAACTAGGCCAGGTTCTGGGGATGCCATGAACTTAGG | GCCTGCCG | GTTGTA | NKQQRQQRYARVQ |
| | | | | GGGAGTATGGTTAGCAGATCTACCAGCTAACACTATTACTGATAATATG | GAAATTGT | AAGCCG | KLYKMNRKVAAKMV |
| | | | | TAAGCCGCAGTAGCGCTAAGTGGTGTACAGATTTGCAACCACCGTAACT | TCTAGGGT | TTGGGG | LEETDKIQIKLPDHDP |
| | | | | AAGTTCTGTTTCGATGGACTAGGGGGAATCATGATTAACAAGATACCAA | GAACAAGC | AATCCG | MFKFWESEFKEGEG |
| | | | | CTTACATGGAAGTTATGAAATGTAAGTCACAGTAGTGATAAGTGGTGAA | TAAGTTGT | GCTACA | MPERMPKDLKESPD |
| | | | | GAGTCTTGTAATCACCGTAACTAGGCCAGATGTAGTCAAAGCACATGTT | GAGAAAC | CATGGT | LKAIWDPVTEEEVRK |
| | | | | TAGGGGGAACAAGGTTAACATTGGTAAAAGACCAATGCAACCTCCGTA | GGGCTCCA | ATCTCA | AKVANNTAAGPDGI |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACTAAACGTGAAGGCACAAAACTAAAAGTCCAGTGGATGACAGGTGAG | CCACAATA | GGAGCC | QPKSWNRISLKYKTLI |
| | | | | GTCATCACTGGACCCAAATGTTTTAAGCTCATCATAACAACACGGTGAA | TGGAGCCT | ATTCATG | YNLLLYYEKVPHKLKV |
| | | | | AAATCCAGCATTTATTTGCCTGATTGAGTAGCTTCCACACTATTCCAAAG | GCCAGGG | CGCTGA | SRTVFIPKKKDGSSDP |
| | | | | CCGAACCTATCTGGGTTTTTCTTGAAAGGCCGTATAGGGCATATGTCGA | CGCGAGAC | TCTCATT | GEFRPLTICSVVLRGF |
| | | | | GAAATAAGTCCAAGGTGAGGTAGTGTGGCCCTGTACCCAGGGGTAAGG | TCAGGACT | AAGGCG | NKILVQRLVSLYKYDE |
| | | | | TACTATACGGTCGAGTGGCTCAGTAGGCCTAACTAGCCACTGAGTCACT | CTCCATGT | TAATAA | RQTAYLPIDGVGTNI |
| | | | | ATAATGACTAGTTATGAGCAACTACAATGAAACAAACACGAGTGGTGG | ACAAAGTG | ACTGTG | HVLAAILNDSNTKLSE |
| | | | | GGATAACCCTCGGATGGCCACTCAAACCACTGGATCGCTATCCAGTGGA | GTTAGTTG | AAACAG | LHVALLDITKAFNRLH |
| | | | | CCAATTAACCAGCACACATGTGAACTATGTTGTAGGACATTTGGTACAC | CAAAAAGA | ATCCTG | HTSIIKSLVGKGFPYG |
| | | | | GTGCCGGATTGGGACAACATGTGAGAAAAACCCATCCAATTGAGTCCAA | GTGCGCCT | ATAATG | FITFIRRMYTGLQTM |
| | | | | CCAAAGCATTAATGTAGAACGAAAGAAAAGAAGATGGTCACCTGAAGA | AGCATGAC | CCGTGC | MQFEGHCKMTQVN |
| | | | | GATAAGACGTATGGCGAATATGGAAGCCCAAGCTACCATAAACAACATC | TGATAATT | TACCAA | RGVYQGDPLSGPIFLL |
| | | | | AAACACTTAACTCAATACCTTGCAACTTACCTTCCTCAAAGAACTTTGAA | TTTCACTG | ATGATG | AIEKGLQALDKEVGY |
| | | | | CGCTATTAAAGGAAGGAGAAGAGATGCTGAGTATAAAGAACTGGTGAC | AAATAACG | TAACGA | DIGDVRVNAGAYAD |
| | | | | CGGCATTATAGCAAATCTTCGGAGTAATTCCAGTACACAACAAACCAAT | TTGAACTT | GGCGGA | DTDLVAGTRLGLQD |
| | | | | CAGGTCTGTAATGAAAGTGAAATGTCACAACGCAGTAAGATACTGCAAA | TATCTGTG | AATAAA | NINRFSSTIKQVGLEV |
| | | | | GTATACGAGAAAGCGTACGTGACTTGAGAAGTAGACGTAATAAATATG | TCATGTGC | ATTAATC | NPRKSMTLSLVPSGK |
| | | | | CGAAAGCATTACAAGAGCTTGGGGAAGCAGCATTGTGCGGTAAAATGT | ACAACACT | TGGGGC | EKKMKVETGKPFRA |
| | | | | TGAACGAAGAACAGCTAATACATTGTATAAAGTCAATGTTCAACACCGC | ATGGTGTC | GTTCTG | NDVPLKELSINDFWR |
| | | | | TAAGTGTCCGAAAGGACCAAGATTTCGCAAAACTGCAACCCACAGTGGA | TGATCAAG | CGGAAT | YLGISYTNEGPERLSL |
| | | | | ACAAATAAGCAACAACGGCAACAACGATATGCTAGGGTGCAGAAGTTG | CACCATCA | GACTAC | TIEQDLERLTKAPLKP |
| | | | | TACAAAATGAACCGAAAGGTTGCCGCAAAAATGGTGTTAGAAGAAACG | GTGGTGG | TAAATAT | QQRIHMLNAYVIPKY |
| | | | | GATAAGATACAGATAAAGTTACCGGACCATGATCCGATGTTCAAGTTTT | ACCTGCTA | AGCGAT | QDKLVLSKTTAKGLK |
| | | | | GGGAAAGTGAATTTAAGGAGGGCGAAGGCATGCCGGAAAGGATGCCC | ATGTATTA | GCTATAT | RTDRQIRQYVRRWL |
| | | | | AAGGATCTGAAGGAATCGCCCGACTTAAAAGCGATATGGGATCCGGTA | GTAGAACG | ATACAA | KLPHDVPIAYLHAPV |
| | | | | ACTGAAGAGGAAGTTAGAAAGGCAAAAGTGGCGAATAACACCGCGGC | TGTCCAGG | ACGACT | KSGGLNIPCLQYWIPL |
| | | | | AGGTCCTGATGGAATTCAGCCGAAATCATGGAACAGGATAAGTTTAAAA | CGATAATG | GATGGT | LRVNRVNKITESQRS |
| | | | | TATAAGACGTTAATATACAACTTACTCCTGTACTATGAAAAAGTTCCACA | CACACACG | AACACC | VLAAVGKTALLTSTVY |
| | | | | TAAGCTTAAGGTGTCACGAACTGTGTTTATTCCTAAGAAAAAAGATGGA | GCCTCCGG | GGCCTT | KCNQSLATLGGNPT |
| | | | | TCCAGTGATCCTGGTGAATTCCGACCTCTTACAATATGTTCAGTGGTCCT | GCCCATCG | A (SEQ | MLAYRTYWEKELYAK |
| | | | | TAGAGGTTTCAATAAGATCCTTGTGCAGAGGCTTGTATCCCTATATAAAT | CTTTTTTG | ID NO: | VDGKDLQNARDDKA |
| | | | | ATGATGAAAGGCAAACAGCTTATTTGCCTATAGATGGTGTGGGCACGA | AGATTCCC | 1371) | STRWNGMLHSDISG |
| | | | | ACATACACGTGCTTGCGGCGATACTCAATGACTCGAACACAAAACTGAG | TAGAAACT | | EDYLNYHKLRTNSVP |
| | | | | TGAACTGCATGTAGCGCTATTGGACATTACGAAAGCATTCAATCGCCTA | TCAGTGTG | | TKVRTARGRPQKETS |
| | | | | CATCACACATCGATAATCAAATCCTTAGTGGGAAAGGGGTTCCCTTATG | TGCGACAA | | CRGGCKSTETLQHVV |
| | | | | GATTTATTACTTTCATCAGAAGAATGTATACGGGCTTACAAACGATGAT | CTGTATAA | | QQCHRTHGGRTLRH |
| | | | | GCAATTTGAGGGCCACTGCAAAATGACACAAGTGAACAGAGGAGTCTA | CCCATAAG | | DRIVGLLQHELRRDY |
| | | | | CCAAGGAGACCCTTTAAGCGGGCCAATCTTTTTGTTGGCTATTGAAAAA | GGATGGA | | NVLAKQELKTGIGLR |
| | | | | GGCTTACAAGCTCTTGATAAGGAAGTTGGCTATGACATAGGGGATGTG | CAAAGGTT | | KPDLVLIKDDTAHIVD |
| | | | | AGAGTCAATGCAGGTGCTTACGCAGATGATACAGACTTGGTTGCAGGA | ATACTAGG | | VQVARCSKLNESHVR |
| | | | | ACGAGACTTGGCTTGCAAGACAACATAAACAGGTTTTCAAGTACTATTA | GGGTAAA | | KRSKYDKKEIEVEVKS |
| | | | | AACAGGTTGGACTTGAGGTAAATCCAAGAAAGTCAATGACATTGTCTCT | AACCCTAA | | RYRVSKVMYEACTIS |
| | | | | GGTACCTTCGGGGAAAGAGAAGAAAATGAAAGTAGAAACTGGCAAACC | TCGGCTAA | | YKGIWDKQSVMSM |
| | | | | TTTCAGAGCGAACGATGTTCCTCTGAAGGAACTGTCAATTAATGATTTTT | TGGCAAAT | | RRLGVSEYCLFKIVTS |
| | | | | GGAGATACCTGGGCATAAGCTATACGAATGAAGGGCCTGAAAGACTGA | GGGATGTA | | TLRGTWLCWKRFN |
| | | | | GTCTTACAATAGAGCAAGATCTAGAACGCCTAACTAAAGCTCCATTAAA | GAAATGCC | | MITSVRS (SEQ ID |
| | | | | GCCACAACAACGGATACATATGCTTAACGCATATGTAATACCTAAATATC | AAAGATTA | | NO: 1493) |
| | | | | AAGACAAACTTGTCTTGAGTAAAACCACGGCAAAAGGGCTGAAGCGAA | CTCGCACC | | |
| | | | | CAGATAGGCAGATAAGGCAATATGTAAGACGATGGCTAAAGTTACCAC | GAATAATG | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATGATGTTCCAATTGCATATTTGCATGCACCAGTTAAATCTGGTGGCCTAAACATTCCATGCTTGCAATACTGGATACCATTACTTAGAGTAAACAGAGTCAATAAGATTACAGAAAGTCAACGCAGTGTACTTGCAGCGGTTGGTAAAACAGCCCTGCTAACGTCAACTGTTTATAAATGTAATCAGTCTCTAGCAACATTGGGTGGAAACCCAACAATGCTTGCATATCGAACGTATTGGGAAAAAGAGCTATATGCAAAGGTCGATGGGAAAGACCTACAAAATGCGCGGGATGATAAGGCTTCGACGAGGTGGAATGGCATGTTGCATAGTGACATTAGTGGAGAAGACTATTTGAATTATCATAAGCTTCGAACAAATAGTGTACCCACTAAAGTAAGAACGGCAAGAGGACGTCCTCAAAAGGAAACGTCTTGCAGAGGTGGTTGTAAAAGCACGGAAACGCTGCAACATGTAGTTCAGCAGTGTCATAGAACACATGGGGGAAGAACTCTAAGACATGACAGGATTGTGGGTCTTCTCCAACATGAACTACGCCGAGACTATAATGTCTTAGCTAAACAAGAACTAAAAACGGGCATAGGGTTGCGCAAACCGGATTTAGTTCTTATAAAAGATGACACTGCACACATCGTTGACGTGCAAGTCGCAAGGTGTAGTAAACTGAATGAAAGCCATGTAAGGAAGCGATCCAAATACGACAAGAAAGAAATAGAGGTAGAAGTAAAAAGTAGATATCGTGTAAGTAAGGTGATGTATGAAGCTTGCACGATATCATACAAAGGTATTTGGGATAAGCAGAGCGTGATGAGCATGAGAAGACTTGGAGTAAGTGAATACTGTCTTTTCAAGATTGTCACATCAACACTAAGAGGAACATGGCTTTGTTGGAAACGGTTCAATATGATCACTAGTGTTCGATCATAGAAATGTGTGCGATAAGGTGTGAATAGAAGGGTTCACCAAGAGGGAGACCTAGTTTGGACCTCAGAAATGGGGTCATAGGAGTGATAGGTTGTAAAGCCGTTGGGGAATCCGGCTACACATGGTATCTCAGGAGCCATTCATGCGCTGATCTCATTAAGGCGTAATAAACTGTGAAACAGATCCTGATAATGCCGTGCTACCAAATGATGTAACGAGGCGGAAATAAAATTAATCTGGGGCGTTCTGCGGAATGACTACTAAATATAGCGATGCTATATATACAAACGACTGATGGTAACACCGGCCTTA (SEQ ID NO: 1125) | GTGGCCGAAAAGCGGGTAATCGAATGAAATGGTAATGCTGTAGCGGAAACATGATCACATTCTGTGACAGTAAACCATTAGACCTAGGGGGAACTATGATTAACAAGATACCAGCTTACATGGAAGCAATGAAATGTAAGTCACAGTAGTGATAAGTGGTGAAGAGTCTTGTAATCACCGTAACTAGGCCAGGTTCTGGGGATGCCATGAACTTAGGGGGAGTATGGTTAGCAGATCTACCAGCTAACACTATTACTGATAATATGTAAGCCGCAGTAGCGCTAAGTGGTGTACAGATTTGCAACCACCGTAACTAAGTTCTGTTTCGATGGACTAGGGGGAATCATGATTAACAAGATACCAACTTACATGGAAGTTATGAAATG | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | TAAGTCAC | | |
| | | | | | AGTAGTGA | | |
| | | | | | TAAGTGGT | | |
| | | | | | GAAGAGTC | | |
| | | | | | TTGTAATC | | |
| | | | | | ACCGTAAC | | |
| | | | | | TAGGCCAG | | |
| | | | | | ATGTAGTC | | |
| | | | | | AAAGCACA | | |
| | | | | | TGTTTAGG | | |
| | | | | | GGGAACA | | |
| | | | | | AGGTTAAC | | |
| | | | | | ATTGGTAA | | |
| | | | | | AAGACCAA | | |
| | | | | | TGCAACCT | | |
| | | | | | CCGTAACT | | |
| | | | | | AAACGTGA | | |
| | | | | | AGGCACAA | | |
| | | | | | AACTAAAA | | |
| | | | | | GTCCAGTG | | |
| | | | | | GATGACAG | | |
| | | | | | GTGAGGTC | | |
| | | | | | ATCACTGG | | |
| | | | | | ACCCAAAT | | |
| | | | | | GTTTTAAG | | |
| | | | | | CTCATCAT | | |
| | | | | | AACAACAC | | |
| | | | | | GGTGAAA | | |
| | | | | | AATCCAGC | | |
| | | | | | ATTTATTT | | |
| | | | | | GCCTGATT | | |
| | | | | | GAGTAGCT | | |
| | | | | | TCCACACT | | |
| | | | | | ATTCCAAA | | |
| | | | | | GCCGAACC | | |
| | | | | | TATCTGGG | | |
| | | | | | TTTTTCTTG | | |
| | | | | | AAAGGCC | | |
| | | | | | GTATAGGG | | |
| | | | | | CATATGTC | | |
| | | | | | GAGAAATA | | |
| | | | | | AGTCCAAG | | |
| | | | | | GTGAGGTA | | |
| | | | | | GTGTGGCC | | |
| | | | | | CTGTACCC | | |
| | | | | | AGGGGTA | | |
| | | | | | AGGTACTA | | |
| | | | | | TACGGTCG | | |
| | | | | | AGTGGCTC | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | AGTAGGCC TAACTAGC CACTGAGT CACTATAA TGACTAGT T (SEQ ID NO: 1248) | | |
| R2 | YURE-2_Cis | — | *Ciona savignyi* | CCAAAATTACTTCCAGCACCTCCACAGCAGACGAACGAAGAAAGAAGAC | CCAAAATT | TAAGAT | MAGHKITMSEGKLLE |
| | | | | TTACGAAATAAGAATAAGCAGTTTAAAGACGAAGCAGACGAACACCAC | ACTTCCAG | CCGCGG | VAVRYGGVRNVSYE |
| | | | | TCCACCAACGACGCTCTGCAGCTACACCACCACCATCTCGCCGCAACAA | CACCTCCA | CTGTGG | CPVPDCTKTFSQANN |
| | | | | GAAGAATTTTCCGCTGCTCTCCACTCTGCTCCAACACCACCTCTCCTGCTC | CAGCAGAC | CGCCGA | LIRHLNNFGNTKHRA |
| | | | | TGTGGACTGCTGCCTTGCTGCTGGACCAACCTCTACCCGAAGGAACCCT | GAACGAA | ACGAGC | HNFTYFFTCEKCKIQI |
| | | | | TCGAACCCAGCAGCAAGGTACGTGTCACCACCTCTCCACAGAGCCAAGG | GAAAGAA | ACCTGC | HSNTKHNISNHYKQC |
| | | | | CCAGAGTGGATAGAGCAGCGGCCTCTACAACCAAGTTCTCCACTCCGAC | GACTTACG | CCATTCT | CATGGGPSCETGQYF |
| | | | | GACAAAACACCTGCCTCGTGGCCAGAGTCCTGCCGAAGAAGAATCTTCG | AAATAAGA | TCTTGTA | CPACEQAGLGNLESA |
| | | | | ACCCCAACACCGTCTCGGCAGGGCTCCAAGCAACGACATCAGCCACGAG | ATAAGCAG | GGGACT | LRHFQSSHPEFNLPP |
| | | | | TGCCCACCGGAGTGGACGCGGCGAACCCGAGGACCGCTGTCGCCAAGA | TTTAAAGA | TTTTCAC | RSQFSKSHPNSYTLSL |
| | | | | ACAATAACATCACCGCCTGCAGCAGCTACCAAACAAAGGTTAGTCTCCT | CGAAGCA | CCTCACT | KPKDHLMKILYSGPLT |
| | | | | ACCTCACCTACAAACTCGTCTGAATAGACGCCCCCGCGTGGGAGCTAAC | GACGAACA | CCCCCCA | PGQLVCPIKICLRSSA |
| | | | | CTTGGTAGCTAGCTGCAGTGCCCTGCGACAGCGGCCTCGAAGAGCTGC | CCACTCCA | ATAGTTT | ARLFHDVSKLRKHML |
| | | | | AGAGCGTCAGCCTGCTTCGACCTCGCTTGTTCTCATTTCAACCTACTCCG | CCAACGAC | TTTTTCG | VDHNRTLVYETTCGK |
| | | | | TCCTGTGGAATCAAAAGAGCCCCACTAACAATTACATTCATAAAATCTAG | GCTCTGCA | TTTTTTC | CLRPVDTSKNMRKTT |
| | | | | CAAGAACGAAGAGAAGCGACCAACTTTTAATCCATAACTTTTAGATCTTT | GCTACACC | GTTTTTT | SHFEKCSGESFISSPSP |
| | | | | TTATTTATTACTGTTTTTAAGCCCTAAGCATATTGCCTTTTTTTAGATCTTA | ACCACCAT | CACCCCC | IPQKTYKLDLPSTSTP |
| | | | | TAATTATAAAAATAGATTCAAAGTTAACACCACCAGGCCGCTACAGAGC | CTCGCCGC | ACCCCA | PPRKSPKLQPYKPIRT |
| | | | | ATTTTATTTAATCAATTTGTTACCGACCTCCTGCTGCTTCTTTTTACTTTCT | AACAAGAA | CTCGCCT | FKNPLTKSSQSKSDN |
| | | | | CCAGACTACTACCCGGATACAACCCTTGGAAACGAGAGGAATGGCCGG | GAATTTTC | CTGGGC | PPKPTPFFSPRTLERS |
| | | | | TCACAAGATCACAATGTCGGAGGGGAAGCTGCTGGAGGTTGCTGTACG | CGCTGCTC | TGCACA | ASWPALSEVVDPLPK |
| | | | | GTATGGTGGTGTGAGGAATGTCTCGTACGAGTGTCCAGTCCCGGATTGC | TCCACTCT | TCCCACA | LKEKHPSLPCALDKCP |
| | | | | ACAAAAACCTTCTCACAGGCAAATAACTTGATACGGCATTTAAATAACTT | GCTCCAAC | CGTAGG | PSPRIKPSTLVPPCHT |
| | | | | TGGCAATACAAAACACCGAGCACACAATTTCACCTATTTTTTCACCTGTG | ACCACCTC | GACCTG | ANNSPKPTSPESPSTL |
| | | | | AGAAGTGCAAAATCCAAATTCACAGCAACACAAAACATAATATTTCAAA | TCCTGCTC | TTTATAT | KPLPRPIRPSKPLEDW |
| | | | | TCATTACAAACAGTGTTGTGCAACCGGCGGCGGACCCTCGTGCGAGAC | TGTGGACT | TATTTGC | LTVRSVGPDREIVLNI |
| | | | | GGGTCAATACTTCTGCCCTGCCTGCGAGCAAGCAGGGCTGGGGAACCT | GCTGCCTT | CTTTTAT | GPRPRPGPAAGSRTT |
| | | | | GGAGTCGGCACTCCGCCATTTTCAATCCTCCCACCCTGAATTTAATCTAC | GCTGCTGG | ATGTAC | SPPSTAPAKRVAANP |
| | | | | CCCCCCGGTCTCAATTTTCAAAATCTCATCCCAATAGTTATACCCTATCCT | ACCAACCT | CACTTTT | IAAPLSGEPGATLDC |
| | | | | TAAAACCTAAAGACCACCTTATGAAAATACTTTACAGTGGACCACTGACT | CTACCCGA | TAAATAT | GQTGRKVQPPKKRP |
| | | | | CCGGGGCAATTGGTATGCCCCATTAAGATCTGTCTCAGGTCCTCAGCTG | AGGAACCC | ATTTTTG | TESAGSLPPPAEPAT |
| | | | | CACGTCTTTTCCATGACGTGTCCAAGCTGAGGAAGCACATGTTGGTTGA | TTCGAACC | TACCCCA | DLLTGREGLARLVEEY |
| | | | | TCACAACCGAACCCTTGTGTACGAGACAACATGTGGCAAATGCTTGCGG | CAGCAGCA | CAAGAT | HLSGDFGAFCRDLER |
| | | | | CCTGTCGACACCTCGAAAAATATGCGGAAAACGACGTCGCACTTCGAAA | AGGTACGT | GCTTTTC | WTALSSTNRRPKPRR |
| | | | | AGTGTTCTGGCGAATCCTTTATCTCATCCCCCTCACCCATACCCCAAAAG | GTCACCAC | GCCAAA | GRYNRGAAARATRN |
| | | | | ACTTATAAACTCGACTTACCCTCAACCAGCACCCCTCCCCCCCGTAAATCT | CTCTCCAC | AAAAAA | RGRDDRQDPQDRD |
| | | | | CCCAAATTACAACCCTACAAACCAATTCGAACCTTTAAGAACCCCCTCAC | AGAGCCAA | AAATTTT | DQGGPGPVTCGRPQ |
| | | | | CAAGTCCAGTCAATCCAAATCCGACAACCCACCCAAACCTACCCCTTTTT | GGCCAGA | TGTATCA | RYKRAAALRSAFGRD |
| | | | | TCTCGCCAAGAACACTTGAGAGGTCGGCGTCGTGGCCCGCATTGAGCG | GTGGATAG | CATTTTT | MKATVRRIIDGERGD |
| | | | | AGGTTGTCGACCCACTGCCCAAGCTCAAGGAAAAACACCCCTCGCTGCC | AGCAGCG | ATATTTT | ARCEIDPKTIEGRFRD |
| | | | | ATGCGCCCTGGATAAGTGCCCACCCTCACCCCGGATCAAACCCTCGACC | GCCTCTAC | GTAAAA | ELSPPVREGPECSLPP |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTAGTCCCTCCCTGCCATACAGCAAACAATAGTCCCAAACCAACTTCACC | AACCAAGT | CACAGA | WMAEAQAGEHAPS |
| | | | | CGAATCACCCTCTACCCTAAAACCCTTACCCCGCCCCATCCGACCATCTA | TCTCCACT | TTTTTAT | NDSQPGDAYDGPIT |
| | | | | AACCCTTGGAGGATTGGTTAACTGTGCGGAGCGTGGGACCGGATCGGG | CCGACGAC | AAACTTT | ALEVEMVLSTLNVGS |
| | | | | AGATCGTCCTGAACATCGGTCCGAGACCCCGACCCGGCCCCGCAGCAG | AAAACACC | GCACTA | APGSDGLSYGFWRA |
| | | | | GCTCCAGGACAACATCTCCCCCGTCAACGGCACCCGCGAAAAGGGTTGC | TGCCTCGT | TTTTTAT | LDPKGLVLSELFEVCR |
| | | | | TGCAAACCCAATCGCAGCACCCTTGAGCGGGGAGCCGGGTGCGACCCT | GGCCAGA | ATAAAC | IERRVPGPWKSSRVT |
| | | | | TGATTGCGGCCAGACCGGGCGAAAGGTTCAGCCGCCAAAAAAGAGACC | GTCCTGCC | TTCGCAC | LICKDAEGDLDDLGN |
| | | | | GACAGAGAGTGCTGGGTCCCTCCCTCCTCCGGCCGAGCCAGCCACCGAT | GAAGAAG | TTATTTA | WRPISICQTVYKIYAA |
| | | | | CTCCTTACAGGGAGAGAGGGGCTGGCGAGGCTGGTTGAGGAATATCAT | AATCTTCG | AAATGA | VLARRLQSWALDGG |
| | | | | CTGTCGGGGGACTTTGGCGCTTTCTGTCGGGATCTCGAGCGATGGACG | ACCCCAAC | ATCGCA | VISRSQKGFMPFEGV |
| | | | | GCGCTTTCGTCGACCAACCGAAGGCCAAAGCCGAGGCGCGGCAGGTAC | ACCGTCTC | TCTTTTT | YEHVFLLDSVVADAR |
| | | | | AACCGCGGTGCGGCTGCCCGTGCCACCAGGAACCGGGGCCGAGATGAT | GGCAGGG | TATATAC | ATRRSLAVCWLDLRN |
| | | | | CGTCAAGATCCACAAGATCGAGACGATCAAGGAGGCCCCGGTCCGGTG | CTCCAAGC | ACCAAC | AFGSVDHTTIVEALSR |
| | | | | ACATGCGGGCGGCCGCAAAGATACAAGCGGGCCGCCGCGCTGAGGTC | AACGACAT | ACAAAC | FGAPAGLVEMISDIYT |
| | | | | GGCCTTCGGGAGGGACATGAAGGCGACCGTCCGTCGCATCATAGACGG | CAGCCACG | AGGATG | GGSCRIRTRAGFTPDI |
| | | | | AGAACGGGGCGACGCTCGCTGTGAAATCGACCCCAAAACCATCGAGGG | AGTGCCCA | TGCAGC | PVGRGVRQGCPLSGI |
| | | | | TCGATTTCGCGACGAGCTGTCGCCGCCGGTTCGGGAAGGGCCGGAGTG | CCGGAGTG | TCAGGG | IFNLVMEVLLRGVEA |
| | | | | CTCGTTGCCCCCTTGGATGGCTGAAGCCCAGGCAGGTGAGCATGCGCCA | GACGCGG | GAACCA | NNACGYRLSCAGGA |
| | | | | TCGAATGATAGCCAACCCGGCGATGCATACGATGGGCCAATCACGGCG | CGAACCCG | ATCCTGC | SVRVLAYADDVALVG |
| | | | | CTGGAGGTGGAGATGGTCCTCAGTACCCTGAACGTCGGCTCTGCCCCGG | AGGACCGC | GTCCCTC | SSRAEXKIQLGVCERF |
| | | | | GATCGGACGGCCTCTCCTATGGATTTTGGAGAGCTCTAGACCCGAAAGG | TGTCGCCA | CTAGCG | AAWAGFSFNNKKCA |
| | | | | ACTCGTCCTTTCGGAGCTCTTCGAAGTCTGTAGGATCGAGCGCCGGGTC | AGAACAAT | GCGGGA | AMVLKHQRGGRRLL |
| | | | | CCGGGGCCATGGAAGAGCAGCCGGGTCACCCTCATCTGCAAAGATGCA | AACATCAC | GGGGCG | DSAPLRLCGEEVAILG |
| | | | | GAGGGTGACCTCGACGATTTGGGGAACTGGCGGCCCATCTCCATCTGCC | CGCCTGCA | CCCACCT | PDSFYKYLGAHTGYG |
| | | | | AGACGGTGTATAAGATCTACGCCGCCGTGTTGGCCCGTCGACTGCAGA | GCAGCTAC | ACCCCC | RQTGGQLVDRVERQ |
| | | | | GCTGGGCGCTTGACGGTGGCGTCATCTCCCGAAGTCAAAAGGGCTTCAT | CAAACAAA | ACGCTC | VVRLFTSFLTPTQKLS |
| | | | | GCCGTTCGAGGGGGTATACGAGCATGTATTCCTCCTCGACTCGGTCGTC | GGTTAGTC | CTCTTGA | ALKRIVLPAMSFHLR |
| | | | | GCTGACGCGCGCGCGACCCGGAGGTCGCTGGCCGTGTGCTGGCTNGAC | TCCTACCT | GCACCA | VRPCAEGHLRRLDNT |
| | | | | CTCCGGAACGCGTTCGGCAGCGTCGACCACACCACCATAGTCGAGGCGT | CACCTACA | ACAGGG | VRRCVKTALRLPKGS |
| | | | | TGTCTCGCTTCGGCGCCCCCGCGGGCCTCGTGGAGATGATATCGGACAT | AACTCGTC | ACTCCCT | CRAFFHTSPDAGGLG |
| | | | | CTATACGGGTGGGTCCTGCCGAATTAGAACTCGTGCGGGATTCACCCCG | TGAATAGA | TCCGGA | ITSVVAECDILTVTQA |
| | | | | GACATCCCTGTCGGTCGTGGAGTGCGACAGGGGTGTCCCTTGTCCGGTA | CGCCCCCG | GCCCCT | FKMLSSPDHLVSLVA |
| | | | | TCATCTTCAACCTCGTGATGGAGGTCCTGCTGCGGGGCGTCGAAGCGAA | CGTGGGA | GCACCC | KGRLGMHAARMGR |
| | | | | CAACGCTTGTGGATACCGGCTCTCCTGCGCCGGCGGCGCGTCCGTCAGG | GCTAACCT | TCAACTT | SETASACAMADYLSG |
| | | | | GTGCTCGCGTACGCCGACGATGTGGCTCTGGTGGGCTCTTCCAGGGCCG | TGGTAGCT | TTCTTAT | DSVMGHXSWKTGYR |
| | | | | AGATNAAGATCCAGCTGGGTGTGTGCGAGCGGTTTGCCGCCTGGGCCG | AGCTGCAG | TTTTAAA | MPADLWTATRAASR |
| | | | | GTTTTTCTTTTAACAACAAGAAGTGCGCCGCCATGGTACTGAAACATCA | TGCCCTGC | AAAAAA | RLSLRFSPQPQGEFG |
| | | | | GAGAGGGGGTCGGAGGCTCTTGGACTCGGCGCCTCTTCGCCTTTGCGG | GACAGCG | AAATCA | LESGTFKIAPRERRSL |
| | | | | TGAAGAGGTGGCGATCCTGGGCCCCGACTCCTTCTACAAGTACCTGGGG | GCCTCGAA | TATATAT | TRRLHHRQNLWWR |
| | | | | GCGCATACCGGCTACGGGCGGCAAACGGGTGGACAGCTTGTCGATCGA | GAGCTGCA | TGATCTT | NQWAALPNQGKTV |
| | | | | GTCGAAAGGCAGGTCGTCAGGCTGTTCACCTCGTTCCTCACCCCCACCC | GAGCGTCA | GACGAC | AAHSAYAASNNWVK |
| | | | | AAAAACTCTCGGCCCTGAAGAGAATAGTCCTGCCCGCCATGAGCTTCCA | GCCTGCTT | GGGGGC | GPSSLAPQALFFGLK |
| | | | | TCTCCGGGTCCGGCCCTGCGCCGAGGGGCATCTCCGGCGCCTTGACAAC | CGACCTCG | TACATTC | ARLNQMPTRSVKAC |
| | | | | ACAGTGAGGCGCTGTGTGAAGACAGCGTTGCGCCTGCCGAAGGGGTCG | CTTGTTCT | AGCCCC | YSRAPNYDKSCRRCG |
| | | | | TGTCGGGCTTTTTTCCACACGTCCCCCGACGCAGGGGGCCTGGGGATCA | CATTTCAA | CAAAAA | AEVETLPHVLNHCPK |
| | | | | CGTCGGTTGTCGCCGAGTGCGACATACTGACGGTGACCCAGGCCTTCAA | CCTACTCC | CCCACCC | SMKSILERHDSVLAE |
| | | | | GATGCTGTCTTCACCGGACCATCTCGTCTCGCTAGTTGCCAAGGGCCGTC | GTCCTGTG | ACCATCC | VLAAIPRGTFASVDV |
| | | | | TGGGGATGCACGCCGCGCGCATGGGCCGGTCCGAGACGGCGTCCGCTT | GAATCAAA | CCAACG | DRTSREHFRRVGEAL |
| | | | | GCGCCATGGCGGACTACCTGAGCGGGGACTCGGTAATGGGGCACANGT | AGAGCCCC | AGTGCC | RPDIVARRHDGSVVV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGTGGAAAACCGGATACAGGATGCCGGCCGATCTCTGGACAGCCACTC | ACTAACAA | GGGGCA | ADVTCPFESCASALD |
| | | | | GAGCTGCCAGCCGGCGCCTGTCCCTCCGGTTTTCCCCGCAGCCCCAAGG | TTACATTC | TTGAAG | TAAARKIEKYDQLCA |
| | | | | CGAATTCGGCCTCGAGTCGGGCACTTTCAAGATCGCCCCCAGGGAGCG | ATAAAATC | AGCTCC | NLRQLYRKPVESHAL |
| | | | | GCGCTCCTTGACCCGAAGGCTGCACCACAGGCAAAACCTGTGGTGGCG | TAGCAAGA | GGCACA | VVGSLGSWGRTNNT |
| | | | | GAACCAGTGGGCGGCCCTTCCCAACCAAGGGAAGACCGTCGCCGCCCA | ACGAAGA | ATTAGC | ALAALGIRGAVRSRL |
| | | | | CTCCGCCTACGCAGCCTCCAACAACTGGGTCAAGGGCCCGTCCTCCCTG | GAAGCGA | ACTTAG | AKQLVNLSVEGSHNI |
| | | | | GCCCCTCAGGCCCTGTTCTTCGGCCTTAAAGCGCGGCTGAACCAGATGC | CCAACTTT | CTTATTT | WLRWSGGIPKDLVR |
| | | | | CAACGCGCTCGGTCAAGGCCTGCTACTCAAGGGCGCCGAACTACGACA | TAATCCAT | ATTATTT | (SEQ ID NO: 1494) |
| | | | | AGTCCTGTCGTAGGTGTGGCGCGGAGGTGGAGACCCTCCCGCACGTGC | AACTTTTA | TTTGTCA | |
| | | | | TGAATCATTGCCCCAAGTCCATGAAATCGATCTTGGAGCGGCATGATTC | GATCTTTT | ACATTTT | |
| | | | | GGTGCTTGCGGAGGTCCTCGCCGCCATCCCTCGCGGCACATTCGCCAGT | TATTTATTA | TGTTTTT | |
| | | | | GTCGACGTCGACAGGACGTCCCGAGAACATTTCCGGCGAGTGGGCGAA | CTGTTTTT | TCAAATT | |
| | | | | GCTCTGCGACCCGACATAGTCGCCCGTCGACATGACGGATCCGTCGTGG | AAGCCCTA | TTTTCAC | |
| | | | | TCGCAGACGTGACGTGCCCATTCGAGTCCTGCGCGTCGGCCCTCGATAC | AGCATATT | CCCTCAC | |
| | | | | GGCGGCCGCGCGAAAAATCGAAAAATACGACCAGCTGTGTGCGAACTT | GCCTTTTTT | CCCCACC | |
| | | | | GCGGCAGTTATACCGTAAGCCCGTCGAGTCGCACGCACTGGTCGTAGGT | TAGATCTT | CTAATA | |
| | | | | TCCTTGGGCAGCTGGGGCAGGACCAACAACACTGCTCTGGCTGCACTCG | ATAATTAT | GGTCCC | |
| | | | | GAATCCGAGGCGCGGTTCGCTCGAGGTTGGCCAAGCAATTGGTCAACC | AAAAATAG | TCGGGC | |
| | | | | TCAGCGTCGAGGGTAGCCACAACATCTGGCTACGCTGGTCCGGCGGCA | ATTCAAAG | TTGGGC | |
| | | | | TCCCAAAGGACCTGGTCAGATAAGATCCGCGGCTGTGGCGCCGAACGA | TTAACACC | CCCTTTT | |
| | | | | GCACCTGCCCATTCTTCTTGTAGGGACTTTTTCACCCTCACTCCCCCCAAT | ACCAGGCC | TCGTGC | |
| | | | | AGTTTTTTTTCGTTTTTTCGTTTTTTCACCCCCACCCCACTCGCCTCTGGGC | GCTACAGA | TCGAGA | |
| | | | | TGCACATCCCACACGTAGGGACCTGTTTATATTATTTGCCTTTTATATGTA | GCATTTTA | AGCGTC | |
| | | | | CCACTTTTTAAATATATTTTTGTACCCCACAAGATGCTTTTCGCCAAAAAA | TTTAATCA | ACATCG | |
| | | | | AAAAAATTTTTGTATCACATTTTTATATTTTGTAAAACACAGATTTTTATA | ATTTGTTA | CCCCACT | |
| | | | | AACTTTGCACTATTTTTATATAAACTTCGCACTTATTTAAAATGAATCGCA | CCGACCTC | GACCAC | |
| | | | | TCTTTTTTATATACACCAACACAAACAGGATGTGCAGCTCAGGGGAACC | CTGCTGCT | GACCTTC | |
| | | | | AATCCTGCGTCCCTCCTAGCGGCGGGAGGGGCGCCCACCTACCCCCACG | TCTTTTTAC | CCCGAC | |
| | | | | CTCCTCTTGAGCACCAACAGGGACTCCCTTCCGGAGCCCCTGCACCCTCA | TTTCTCCA | ATTGGA | |
| | | | | ACTTTTCTTATTTTTAAAAAAAAAAAATCATATATATTGATCTTGACGACG | GACTACTA | GTCCTT | |
| | | | | GGGGCTACATTCAGCCCCCAAAAACCCACCCACCATCCCCAACGAGTGC | CCCGGATA | GGCGTC | |
| | | | | CGGGGCATTGAAGAGCTCCGGCACAATTAGCACTTAGCTTATTTATTATT | CAACCCTT | TCCCAG | |
| | | | | TTTTGTCAACATTTTTGTTTTTTCAAATTTTTTCACCCCTCACCCCCACCCT | GGAAACG | GTCGAA | |
| | | | | AATAGGTCCCTCGGGCTTGGGCCCCTTTTTCGTGCTCGAGAAGCGTCAC | AGAGGA | ACAGTC | |
| | | | | ATCGCCCCACTGACCACGACCTTCCCCGACATTGGAGTCCTTGGCGTCTC | (SEQ ID | CCAAGT | |
| | | | | CCAGGTCGAAACAGTCCCAAGTGATAGCACCTAATGCTCGACTTGTTTC | NO: 1249) | GATAGC | |
| | | | | GGCCTGGGCCGCCGAGGATTCCCAGAACGACCATTCTTCTAAATAATAT | | ACCTAAT | |
| | | | | TTATATTTCAGAATAAAACTATATATATATCGTTGGGGACTTGTCCCG | | GCTCGA | |
| | | | | CCTCGATACCGAGTGCTGCAGAGCGGCAAAATAAAGAAGAAACCGACG | | CTTGTTT | |
| | | | | TCGCTCTGCAGCCAAGGACCACCCAAACTCAAGCCAGCACCGTCGACAA | | CGGCCT | |
| | | | | CCAACATCCTCAAGTCGGCGGTTGCTGGAACAACTCATAACATCTTCAA | | GGGCCG | |
| | | | | NATAAATTATCACCCTGTGCAGCAGGAGGCCGTGCTTTTAAAACTACTCT | | CCGAGG | |
| | | | | GTAGTGGCTCATGATAATATTTCGCTCCTTTTTTGCCCCGTGTAAACTTA | | ATTCCCA | |
| | | | | GTNGATGCGAATAAAATCAGTTGAATCA (SEQ ID NO: 1126) | | GAACGA | |
| | | | | | | CCATTCT | |
| | | | | | | TCTAAAT | |
| | | | | | | AATATTT | |
| | | | | | | ATATTTC | |
| | | | | | | AGAATA | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | AAACTA | |
| | | | | | | TATATAT | |
| | | | | | | ATCGTT | |
| | | | | | | GGCGGG | |
| | | | | | | ACTTGTC | |
| | | | | | | CCGCCTC | |
| | | | | | | GATACC | |
| | | | | | | GAGTGC | |
| | | | | | | TGCAGA | |
| | | | | | | GCGGCA | |
| | | | | | | AAATAA | |
| | | | | | | AGAAGA | |
| | | | | | | AACCGA | |
| | | | | | | CGTCGC | |
| | | | | | | TCTGCA | |
| | | | | | | GCCAAG | |
| | | | | | | GACCAC | |
| | | | | | | CCAAAC | |
| | | | | | | TCAAGC | |
| | | | | | | CAGCAC | |
| | | | | | | CGTCGA | |
| | | | | | | CAACCA | |
| | | | | | | ACATCCT | |
| | | | | | | CAAGTC | |
| | | | | | | GGCGGT | |
| | | | | | | TGCTGG | |
| | | | | | | AACAAC | |
| | | | | | | TCATAAC | |
| | | | | | | ATCTTCA | |
| | | | | | | ANATAA | |
| | | | | | | ATTATCA | |
| | | | | | | CCCTGT | |
| | | | | | | GCAGCA | |
| | | | | | | GGAGGC | |
| | | | | | | CGTGCT | |
| | | | | | | TTTAAAA | |
| | | | | | | CTACTCT | |
| | | | | | | GTAGTG | |
| | | | | | | GCTCAT | |
| | | | | | | GATAAT | |
| | | | | | | ATTTCGC | |
| | | | | | | TCCTTTT | |
| | | | | | | TTGCCCC | |
| | | | | | | GTGTAA | |
| | | | | | | ACTTAGT | |
| | | | | | | NGATGC | |
| | | | | | | GAATAA | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | | AATCAG TTGAATC A (SEQ ID NO: 1372) | |
| R4 | Dong | — | *Bombyx mori* | GCTAGCTCCCTAAAATCCTACCTTACGTCCGAGGCGAACATCTGTCCACG | GCTAGCTC | TAAAAA | MLRRGRIFLPASTKA |
| | | | | TGGGGAGCGGAAACGCGTACTATCGAAACTTACGCGGCTAACAAGGTA | CCTAAAAT | CTAGCA | GKTRGRMKWSREV |
| | | | | AAGGTAACCCATTAATATGGAGACAAGACTAAAAGAAAATTGAGAGG | CCTACCTT | TAATTAT | NLFIMRTYYYVTKLET |
| | | | | GCCGCTTCCCGGGGGCGATCGCCGGGGCACACCTGGAGCTGGCGCTGG | ACGTCCGA | TAACTCA | DLTIYRKKLHEHFSLK |
| | | | | GTGTTCCAGCATAGGATCCGTCAGCGGCGGAGAGTTGAGCAGGCGGGC | GGCGAAC | TAACTA | YPNVIISQQRISDQKR |
| | | | | TCTCGCCGGGGATTTACAACCCGAAAATGCTACAGCCGCCAACAGAAAT | ATCTGTCC | ATGTAT | AIERNKLLSQETLDRL |
| | | | | CACGATGTAGAAAGTAGGAGCAATAGCCCATGTGAACCTTACAGCCCG | ACGTGGG | ATTACTT | KEEVRKQLEDEQTNN |
| | | | | AGTACCGGTTCATACAACCCCTCGGTACAATCATCACCATCATCCTCGGG | GAGCGGA | GGCCAA | VENEKLNSETYSHEYT |
| | | | | TCATAGAGGCTCACCAACGTCGACTATGGATGTTGCGCAGGGGGCGAA | AACGCGTA | AAGCCC | TLTPQTILTKKTQQHT |
| | | | | TCTTTTTACCTGCGTCCACCAAAGCTGGCAAAACAAGGGGCCGCATGAA | CTATCGAA | GTATAT | NIISSTQTSHSSTQTE |
| | | | | ATGGAGCAGAGAAGTAAACCTATTTATCATGCGCACCTACTACTACGTC | ACTTACGC | ACAGTT | SITLLLENEVDILNTNP |
| | | | | ACTAAATTAGAAACTGATCTGACTATTTACAGAAAAAAGCTGCATGAAC | GGCTAACA | CCACCG | TEGATQTQEVKDKFE |
| | | | | ATTTTTCACTAAAATACCCTAATGTAATAATTTCACAGCAAAGAATATCT | AGGTAAA | GCTCTG | TNLTMYSGMDPKAR |
| | | | | GACCAAAAAAGGGCAATAGAAAGAAATAAACTACTATCTCAAGAAACC | GGTAACCC | TCGACA | PPLPKLKYSSKLNELIR |
| | | | | CTAGACCGACTAAAAGAGGAAGTGAGAAAACAGCTCGAAGACGAACAA | ATTAATAT | GACTGA | LFNNDILVDYISPDTQ |
| | | | | ACCAATAATGTTGAAAATGAAAAATTAAATTCAGAAACATATTCACACG | GGAGACA | ACTGAG | LSDVHTLTYCTAVTIS |
| | | | | AATATACGACACTTACTCCACAAACTATTTTAACGAAGAAAACACAGCA | AGACTAAA | AAAGGG | EQLKYKIIAIEGNARH |
| | | | | ACATACAAATATTATCTCTAGCACACAGACCTCTCATTCATCCACTCAAAC | AAGAAAAT | GAAACA | KKNFKPPWQQRLEK |
| | | | | CGAATCAATAACTCTGCTGTTAGAAAATGAAGTCGATATTTTAAATACTA | TGAGAGG | TATGGA | DIAKLRADIGKLTQYI |
| | | | | ACCCCACAGAAGGGGCAACACAGACACAAGAAGTTAAAGATAAATTTG | GCCGCTTC | AATAAT | NNNRSKKVVQSVEQI |
| | | | | AAACGAATTTAACAATGTACTCAGGCATGGACCCTAAAGCAAGGCCGCC | CCGGGGG | AATAA | FKNTKIHTSHENGNK |
| | | | | ATTGCCTAAACTTAAATATAGCTCTAAGCTAAATGAACTGATACGTCTAT | CGATCGCC | (SEQ ID | KSQEFLDTLKQKLALK |
| | | | | TTAATAATGACATACTTGTAGATTACATCTCACCAGACACACAACTATCA | GGGGCAC | NO: | AHRLKRYNNSQKRK |
| | | | | GATGTACATACATTAACATATTGCACCGCCGTAACTATTTCGGACAACT | ACCTGGAG | 1373) | NENTIFLTNEKLFYRN |
| | | | | AAAATATAAAATTATAGCAATAGAAGGAAACGCGAGACATAAAAAAAA | CTGGCGCT | | LIKPKTDRDNSNIDIP |
| | | | | CTTCAAACCACCGTGGCAACAAAGATTGGAGAAGGATATAGCAAAATT | GGGTGTTC | | TAEQLEMYWARLWE |
| | | | | GAGAGCAGATATTGGTAAACTGACCCAATACATAAATAATAATAGATCT | CAGCATAG | | NSAKHNDKANWITE |
| | | | | AAAAAAGTAGTCCAAAGCGTTGAACAAATATTTAAAAACACTAAAATAC | GATCCGTC | | EKERWDTIEEMQFD |
| | | | | ACACATCACACGAAAATGGCAATAAAAAATCTCAAGAATTTTTAGACAC | AGCGGCG | | DVTEEEITTITARLHN |
| | | | | ACTGAAACAAAAATTAGCTCTAAAAGCCCACAGACTAAAAAGATATAAC | GAGAGTTG | | WKSPGIDKIHNFWFK |
| | | | | AACTCACAGAAACGAAAGAATGAGAACACTATATTTCTAACAAATGAAA | AGCAGGC | | KLICLHKTIAKNLTDIIS |
| | | | | AACTATTCTACAGAAACCTAATAAAGCCGAAAACTGATCGAGACAATAG | GGGCTCTC | | GNQSIPEFIATGITYM |
| | | | | TAATATAGATATACCAACAGCAGAACAATTGGAAATGTATTGGGCTAGG | GCCGGGG | | IPKGDFSIEASQYRPIT |
| | | | | TTATGGGAAAATAGTGCAAAACATAATGACAAAGCAAATTGGATTACTG | ATTTACAA | | CLPTIYKILTTVITKKIN |
| | | | | AAGAAAAAGAAAGATGGGATACAATAGAAGAAATGCAATTTGATGACG | CCCGAAAA | | SHIEHNNILAEEQKG |
| | | | | TGACAGAGGAAGAAATAACTACTATAACAGCTAGACTACATAACTGGAA | TGCTACAG | | CRRGHMGCKEQLIID |
| | | | | ATCCCCAGGTATAGATAAAATCCATAATTTTTGGTTTAAAAAACTAATTT | CCGCCAAC | | STIMKHATTKNRNLH |
| | | | | GCTTACACAAAACAATAGCCAAAAATCTAACAGATATTATCTCTGGAAAT | AGAAATCA | | CTYIDYKKAFDSIPHS |
| | | | | CAAAGTATTCCCGAATTCATAGCGACAGGAATCACTTATATGATACCAA | CGATGTAG | | WLIQVLEIYKINPIIISF |
| | | | | AAGGTGACTTCTCTATAGAAGCATCCCAATATCGACCAATTACATGCCTT | AAAGTAG | | LRNIMTHWQTTLKLK |
| | | | | CCGACTATTTACAAAATTTTAACAACAGTTATTACAAAGAAAATAAATTC | GAGCAATA | | NPPNFVTTRQIAIKKG |
| | | | | ACATATAGAACACAATAATATCTTAGCTGAAGAACAGAAAGGGTGTAG | GCCCATGT | | IYQGDSLSPLWFCLAL |
| | | | | ACGAGGCCACATGGGCTGCAAGGAACAGCTAATTATAGACTCAACCATC | GAACCTTA | | NPLSHQLHNDRAGY |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATGAAACACGCCACCACAAAAAATAGAAATTTACACTGTACATATATTG<br>ACTACAAAAAAGCTTTTGATAGCATCCCACATTCATGGCTGATCCAAGTC<br>CTAGAAATCTACAAAATTAACCCTATAATAATAAGCTTCCTACGCAATAT<br>CATGACACATTGGCAAACCACACTTAAATTAAAAAACCCTCCTAATTTTG<br>TAACAACACGACAAATAGCCATAAAAAAGGGTATTTACCAAGGTGATTC<br>TCTCAGCCCTTTGTGGTTTTGCCTCGCCTTGAACCCACTATCCCATCAATT<br>GCATAATGACCGGGCGGGATACCGCATTAAACAACAAGATAACACCGA<br>AACAATAATATCACACCTGATTTATATGGACGACATTAAATTATACGCAA<br>AAAATGACAAAGAAATGAAAAAGTTAATAGATACTACCACGATATTCAG<br>CAACGACATCAGTATGCAATTTGGACTTGATAAATGTAAAACCGTACAT<br>ATAATAAAAGGAAAAGTCCAACCCGGTGATTATACAATAGATGACACAA<br>ACACAATAACGGCGATGGAACCAAGTGACCTTTATAAATATCTGGGCTT<br>TCAGCAGCTCAAAGGACTCGATCATATAACAATAAAGCAATCATTAACTT<br>CAGAGTACAAAAAACGTATCAATGCCATTTGCAAAACGAAATTATCTGG<br>AAAACATCTTATAAAAGCACTGAACACCTATGCAATACCCATTCTAACCT<br>ACTCATTTGGAATAATAAAATGGAGCAAAACTGACATAGAACAAATAGA<br>ACGCATAACAAGGACTACATTAACAAAACACAATAATCTTCATCCAAAAT<br>CTGCAATAGAAAGATTGACAATTAAAAGACAAGACGGGGGTAGAGGCA<br>TGATAGATATTTGGCATCTATGGCGTAAACAAATACACAGCTTAAAAAC<br>ATTTTTCTACATAAAATCAGATTTAAGTGAAATTCACAGAGCCATAGCAC<br>AAAATGATAACAACTACACACCGCTAAATCTCAAACAAAAAGAACTAAT<br>AGATAATACAGAAAACCTAAGAAATAGAAACCCACAAAAAGACATGGA<br>AGAAAACTGGAAGAAAAAAGCGCTACATGGACGACACCCTCATGACCT<br>AAGCCAATCTCACATAGACAGCAAGGCATCAAACATGTGGCTCAAAACA<br>GGAAGTCTGTTCCCCGAAACGGAAGGATTTTTAATTGCCATACAGGACC<br>AAGTAATAAACACAAAAAATTACAGAAAATATATTATTAAAGATCCCAC<br>TATTAGAGACGATAAATGCCGCAAATGCAACACCCAGCCAGAAACCATA<br>CAGCACATAACTGGAGCATGTTCAACCCTTACACAGACAGATTACACTC<br>ACAGACACAACCAACTTGCTAATATTATCCATCAACAACTGGCTCTCAAA<br>CATAAATTGATACAAAATACAAACACACCGTACTACAATTATAAACCACA<br>AACCGTTCTTGAAAATGACTCCTGTAAACTTTATTATGATCGCGCTATTCT<br>TACCGATAGGACGATTCACTACAATAGACCGGATATCACTTTACAAGAT<br>AAAAACAATAAAGTCACCTACATTATTGACATTGCAGTCCCGAATACCCA<br>CAACATTCAAAAAACGTTTACAGAAAAGATGACAAAATACACAGAACTT<br>AAAGAAGAAATAGTTAGAATTTGGAAACAGAAAAAAGCATACATAGTC<br>CCAATAATAATCTCAACCACTGGAGTTGTCCCAAACCACATCCACAACAG<br>CTTAAAGCTTCTAGATTTAAAAGATAACATATTTATTTCACTACAAAAGG<br>CAGCTATCCTAAATACATGCAGAATAGTGAGAAAGTTCATGCAGCTTGA<br>AGAAAACCAAACTTACTACACGCAATAAAAACTAGCATAATTATTAACTC<br>ATAACTAATGTATATTACTTGGCCAAAAGCCCGTATATACAGTTCCACCG<br>GCTCTGTCGACAGACTGAACTGAGAAAGGGGAAACATATGGAAATAAT<br>AATAA (SEQ ID NO: 1127) | CAGCCCGA<br>GTACCGGT<br>TCATACAA<br>CCCCTCGG<br>TACAATCA<br>TCACCATC<br>ATCCTCGG<br>GTCATAGA<br>GGCTCACC<br>AACGTCGA<br>CTATGG<br>(SEQ ID<br>NO: 1250) | | RIKQQDNTETIISHLIY<br>MDDIKLYAKNDKEM<br>KKLIDTTTIFSNDISM<br>QFGLDKCKTVHIIKGK<br>VQPGDYTIDDTNTIT<br>AMEPSDLYKYLGFQQ<br>LKGLDHITIKQSLTSEY<br>KKRINAICKTKLSGKH<br>LIKALNTYAIPILTYSF<br>GIIKWSKTDIEQIERIT<br>RTTLTKHNNLHPKSAI<br>ERLTIKRQDGGRGMI<br>DIWHLWRKQIHSLKT<br>FFYIKSDLSEIHRAIAQ<br>NDNNYTPLNLKQKEL<br>IDNTENLRNRNPQKD<br>MEENWKKKALHGR<br>HPHDLSQSHIDSKAS<br>NMWLKTGSLFPETE<br>GFLIAIQDQVINTKNY<br>RKYIIKDPTIRDDKCR<br>KCNTQPETIQHITGA<br>CSTLTQTDYTHRHNQ<br>LANIIHQQLALKHKLI<br>QNTNTPYYNYKPQT<br>VLENDSCKLYYDRAIL<br>TDRTIHYNRPDITLQD<br>KNNKVTYIIDIAVPNT<br>HNIQKTFTEKMTKYT<br>ELKEEIVRIWKAKKAY<br>IVPIIISTTGVVPNHIH<br>NSLKLLDLKDNIFISLQ<br>KAAILNTCRIVRKFM<br>QLEENQTYYTQ (SEQ<br>ID NO: 1495) |
| R4 | DongAG | AB097127 | *Anopheles gambiae* | GAAGGCTAACCACAATAATGGAGACACGATCTATGAGAAAAAGGACCA<br>CACGATTGCCCGAGGAGGGAGCCCCTACTGGAGCTGGGCCTGGGACGG<br>GAGACAGAGCAAGCATCCAGCGGCTGGAAGATGAAATGGTGCAAGAG<br>CGTTCTTTCAGTCAACGGGCTCTGCCCGTACCACGAACGCAAAACAGAA<br>ACGGCAGCCCTATAAATCACCAAGGCAATGCTGCATCTGCTAATGTTGC<br>TGTGGCTGATAGACAACAGTCACTCATTTTGGCAGGAGGCCGACGGCA | GAAGGCTA<br>ACCACAAT<br>A (SEQ ID<br>NO: 1251) | TAACATC<br>CGGTGC<br>AAACTC<br>ATTAAC<br>ATTAAG<br>AAAAGA | METRSMRKRTTRLPE<br>EGAPTGAGPGTGDR<br>ASIQRLEDEMVQERS<br>FSQRALPVPRTQNRN<br>GSPINHQGNAASAN<br>VAVADRQQSLILAGG |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GAGGATTATGTGGACGAGAGAGATGAACCATTACGTGATCCGTTGCTA | | GAGAGG | RRQRIMWTREMNH |
| | | | | CTATGTTTACACGAGGATGGAGACGGACATGCCCGGCAGAGTGAAGAT | | AGAAAT | YVIRCYYVYTRMETD |
| | | | | GCTGGGTATGTTCAATGACCGTTTCCCTCGGTTTGCGCATCAGCTTGACC | | GAGAAT | MPGRVKMLGMFND |
| | | | | TGAGCAAGTTGTATATACGGCAGCGAGCTATTATTTTGCCTGAGGAACT | | GAGATT | RFPRFAHQLDLSKLYI |
| | | | | GGAGTTCATCAAGCTGGAGGTGCGGAGGGAATTTGGAGAGGAAGAGG | | CATTCAC | RQRAIILPEELEFIKLE |
| | | | | CAGGCTGGCGCGAGTCGAGTAGGATTTCTGCTAGGCTTAATACAATAGA | | CTTTGG | VRREFGEEEAGWRES |
| | | | | CCAAAATACATCAAGGGCGAGTGAGGATCGTGATTTGGATGAACCCAC | | CATTTGA | SRISARLNTIDQNTSR |
| | | | | CGCTCCAGGATTGTCAGTGGATATCCAACACCAGATGGCCACAGCTGTT | | ATAGCC | ASEDRDLDEPTAPGL |
| | | | | ACGCAGTTCCATGGGACAGACCCCTTGTCTCGTCACCGACTACCAAAAC | | CGGGGT | SVDIQHQMATAVTQ |
| | | | | TGCATTATTCTTACCGCCTGAAAACAGCAGTAAGCATCATAAACCAAGAT | | AGGTGA | FHGTDPLSRHRLPKL |
| | | | | GTTCTACCTCAGTATTTGGATAGCGTAGGGAGCATTGAGGATCTGCAGT | | AAAGTT | HYSYRLKTAVSIINQD |
| | | | | TAATTGTGTATTCGGCTGCGGTGGCTGTTGTACGAACGCTATGGTTGCG | | CCCAGC | VLPQYLDSVGSIEDLQ |
| | | | | GACCTATCCGCAAGGAGACAGCGAAGGTCGACCATGCTCCAAGGCTGA | | ATATTGC | LIVYSAAVAVVRTLW |
| | | | | AAAGCCCGCCTGGATGCGACGTCTAGAAAACCGGATCAACGCAACACG | | TGAGAA | LRTYPQGDSEGRPCS |
| | | | | GACAAAGATTGGTCGAATGCAGGAATATCAACGGGGAAATTCATCTAT | | GTGACA | KAEKPAWMRRLENR |
| | | | | GAAGGTGGTACGTCAGATTGCTGAAATGGTTAAACCTAAAGAACTACG | | AAATTC | INATRTKIGRMQEYQ |
| | | | | AGACCTCACTGATGCCAACATAACGGAGGTACTCGACATCCATTTACAA | | GGATAA | RGNSSMKVVRQIAE |
| | | | | CGGTTGAGTGCCCTTGCAAAACGATTACGACGTTATGCTGAATGCTCGA | | TAATAAT | MVKPKELRDLTDANI |
| | | | | AGCGGAAAGAACAAAATCGAATGTTCAACATTAACGAGAGAGAATTTT | | AATAAT | TEVLDIHLQRLSALAK |
| | | | | ACAACTGGATCCGAAATGATAAGCCCAATTTTAGAGAAGGGCTCCCGGA | | AATAAT | RLRRYAECSKRKEQN |
| | | | | TATTGGCGACTTTACACAGTTTTGGGCCAATCTATGTGAGAAACCTGTCC | | AATAAT | RMFNINEREFYNWIR |
| | | | | AACACAACAGCGAAGGAATGAGGTTAGCAGAAGATGAGCGCTTCAGTG | | AATAAT | NDKPNFREGLPDIGD |
| | | | | ATGGTATCGAAGACATGCCCGTGCTAGTTGTGAATGCTCAAGACATACG | | AATAAT | FTQFWANLCEKPVQ |
| | | | | TGAGGCAACGCAGTACACCAGGAATGGAGCTGCACCAGGACCCGATTT | | AATAAT | HNSEGMRLAEDERF |
| | | | | TGTATACAATTTTTGGTATAAAAAGCTAATCACAATCCATGAGCAGATAG | | AATAAT | SDGIEDMPVLVVNA |
| | | | | CGGCATGCTTCAATACGGTGTTGGAAGATTCGAGAAAACTACCAAAATT | | ATGCAT | QDIREATQYTRNGAA |
| | | | | TATCACCGGGGGAGTTACTTACTTTCTACCAAAAGATCAAAACACAAAA | | AATAAT | PGPDFVYNFWYKKLI |
| | | | | AATCCTGCGAAGTATAGACCACTTACCTGTCTTTCTAACTTAAACAAAGT | | A (SEQ | TIHEQIAACFNTVLED |
| | | | | GCTGTCGTCAGTGATAACGCAGAAAGTGAAAGATCATTGCGATACCAAC | | ID NO: | SRKLPKFITGGVTYFL |
| | | | | AACGTAATGACCGAAGAACAGACAGGACGTCGAAAAAACACGCAAGGC | | 1374) | PKDQNTKNPAKYRPL |
| | | | | TGTAAAGACCAGGTCATTATTGATGCAGTCATTGTTGGTCAAGCAGCCA | | | TCLSNLNKVLSSVITQ |
| | | | | AGAAACAAAGAAATCTGGATATGGCATACATCGATTACAAGAAGGCGT | | | KVKDHCDTNNVMTE |
| | | | | ATGATTCAGTACCCCATTCATACCTTCTTAAGGTACTCCAGTTGTACAAA | | | EQTGRRKNTQGCKD |
| | | | | GTAGACGGGAATGTCATCAAGCTGATGCAGCACGCGATGGGTATGTGG | | | QVIIDAVIVGQAAKK |
| | | | | AGTACATCTCTACACGTTACCGACGGAAAAGTTGTACTACGGTCAAGAT | | | QRNLDMAYIDYKKAY |
| | | | | CACTCAATATCAGGAGGGGTATTTTCCAAGGTGACACCTTTAGTACGCT | | | DSVPHSYLLKVLQLYK |
| | | | | GTGGTTTTGTCTAGCTATGAACCCGCTTAGCAGAACACTCAACCAGCAA | | | VDGNVIKLMQHAM |
| | | | | TGCAACTTTGGGTATTTACTCAAAAGTGAAGAAATAAGCACGAGAATCA | | | GMWSTSLHVTDGKV |
| | | | | CCCACACCTTCTTTATGGATGACTTGAAGCTGTTCGCAGAAACAGTACA | | | VLRSRSLNIRRGIFQG |
| | | | | GAAGATGCACCACCTGTTGAAGAACGTGCAGGGATTCAGCAACGACAT | | | DTFSTLWFCLAMNPL |
| | | | | TAAAATGGAATTTGGTATCGGTAAATGTCGATCAATTCATCTACACCGA | | | SRTLNQQCNFGYLLK |
| | | | | GGTCAAGTATTGGATGCCGATAGCTTCCGTGCCAACGAACAAGAGGAA | | | SEEISTRITHTFFMDD |
| | | | | ATCCGCCACATGGTTCAAGGTGAAACTTACAAGTTCCTCGGTTTCCTGCA | | | LKLFAETVQKMHHLL |
| | | | | GCTGAGGGGTATTCACTATGCAGTGATCAAGAAAGAGCTACAGGACAA | | | KNVQGFSNDIKMEF |
| | | | | GTTCTTACATCGTGTTAGCTGTATCCTGAAGAGCTTTTTGTCAGTCGGCA | | | GIGKCRSIHLHRGQV |
| | | | | ACAAGGTGAAAGCAATAAACACATTTGCGGTGGCTCTGTTGACCTACAG | | | LDADSFRANEQEEIR |
| | | | | CTTTGGAGTAATGAAATGGTCTAATACTGACTTGGAAGCGTTGGAGCGA | | | HMVQGETYKFLGFL |
| | | | | ACAATTCGTGTGGTTTCCACTAAGCACCAAATGCGTCACCCAAAAGCGT | | | QLRGIHYAVIKKELQD |
| | | | | CCGTCGAGAGAGTAATCCTGCCACGAAAAATAGGAGGGGTAGGAATCA | | | KFLHRVSCILKSFLSV |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTGATATTCAGGCACTTTGTATTTCTCAGATCCATCAGCTGCGAAGTTAC | | | GNKVKAINTFAVALL |
| | | | | TTCGTGGAAAGCCAAAACCGACATGAATTATACCGCACTGTGTATAAAG | | | TYSFGVMKWSNTDL |
| | | | | CAGATCACGGATTAAGCGCCCTGCATCTAGCGCAGCAAGATTACCAGCT | | | EALERTIRVVSTKHQ |
| | | | | GAATTGCAACATAAAAACCGTCGATGGAAAAGGCGCAACGTGGAAACA | | | MRHPKASVERVILPR |
| | | | | GAAGGAGTTACATGGGACGCACACCCATCAACTGAATCTGGAACATATC | | | KIGGVGIIDIQALCISQ |
| | | | | GACAAAGTGTCATCTAGCACTTGGCTTGTGAGGTGTGACCTTTTCTGTG | | | IHQLRSYFVESQNRH |
| | | | | AGACAGAAGGTTTCATGGTAGCCATCCAAGACCGGGTAATTGCGACGT | | | ELYRTVYKADHGLSA |
| | | | | GGAACTATCGGCGGTGTATATTGCGTGAAGACGTGGAGGACCGATGCA | | | LHLAQQDYQLNCNIK |
| | | | | GAAAGTGCAACTCAGGAGGAGAATCGATTGAGCATGTCATTGCCGGCT | | | TVDGKGATWKQKEL |
| | | | | GTCCAGTGCTAGCTGGGTCAGCGTATCTCGATCGCCACAACGACGTTGC | | | HGTHTHQLNLEHIDK |
| | | | | CAAAATTGTTCACCAGCAGCTTGCACTGAGGCACAAGTTGGTAGAGCGA | | | VSSSTWLVRCDLFCE |
| | | | | TTTTTACCCTGCTACCGATACCTCCCAGATCCGGTCCAGGAAAATGATTG | | | TEGFMVAIQDRVIAT |
| | | | | CATAAAGCTGTATTGGGATCGCGAAATTATAACGGACATCCTCATCCGT | | | WNYRRCILREDVEDR |
| | | | | GCCAATAGGCCAGACATCTTAGTCTACGAGAAAAGAAAGAAACGAGCG | | | CRKCNSGGESIEHVIA |
| | | | | ACCATCGACATCGACATTGCTGTAACGTTAGACCATAATGTTCAGACAAC | | | GCPVLAGSAYLDRHN |
| | | | | ATTTTCCACCAAGGTGATGAAGTATCATGATCTGGCAGAGGAGTTGAAG | | | DVAKIVHQQLALRHK |
| | | | | CAGACGTGGTATCTGGAGGATATCCGCATTGTTCCGGTAATCATCTCGG | | | LVERFLPCYRYLPDPV |
| | | | | CGACCGGAATTGTACCTATGGCCCTCTTACGTTCCCTGGACGAGCTCGA | | | QENDCIKLYWDREIIT |
| | | | | ACTGCAGAGAGAACTACCCAGGATTCAGAAGGCGGTGATTCTTCGAAC | | | DILIRANRPDILVYEKR |
| | | | | ATGTAGCACTTTAAGAAGGTTCCTGAATCCCTATAACTAACATCCGGTGC | | | KKRATIDIDIAVTLDH |
| | | | | AAACTCATTAACATTAAGAAAAGAGAGAGGAGAAATGAGAATGAGATT | | | NVQTTFSTKVMKYH |
| | | | | CATTCACCTTTGGCATTTGAATAGCCCGGGGTAGGTGAAAAGTTCCCAG | | | DLAEELKQTWYLEDI |
| | | | | CATATTGCTGAGAAGTGACAAAATTCGGATAATAATAATAATAATAATA | | | RIVPVIISATGIVPMA |
| | | | | ATAATAATAATAATAATAATAATAATAATAATATGCATAATAATA (SEQ | | | LLRSLDELELQRELPRI |
| | | | | ID NO: 1128) | | | QKAVILRTCSTLRRFL |
| | | | | | | | NPYN (SEQ ID NO: |
| | | | | | | | 1496) |
| R4 | R4-1_BX | CADV01008175 | *Bursa-phelenchus xylophilus* | GGGATCCTGGGTTCCTACTACCTCGCTCCACCTCCTCGCGATGGATCCTG | GGGATCCT | TAAGAA | MTCNNAVVFPPADG |
| | | | | GGGAAGTCTCCGGACTGAGCTAAGAGAGCGTTAAAGTAGAGGGTGAC | GGGTTCCT | AAGCAT | NPAGTADRNFAIRFP |
| | | | | GGCGTAAGTACCTCCAAGTTGCGGTGGAGCGGAACATCTACTCTTCGGA | ACTACCTC | GAAATA | SSEPPGPSGIRPSEPL |
| | | | | GAGAGGGGAAGCTCTATGGCGGCGTTAGAAAGGTTGGACTACGGCAA | GCTCCACC | ATAAGA | DGRTGIGDVEHAQA |
| | | | | CGCCAGGGAGATGGGGAAGGTTCATCAGGTGATACTAGTTCGCTACTG | TCCTCGCG | AATCAG | GNGGFLVDVLEYKEA |
| | | | | TCATTCGATGTATCCGGAACCATACTCGCCAAGTTGTGAACTATGTGAA | ATGGATCC | ATAAGA | HRYGSKCEFCYVQTK |
| | | | | AGTCTGGATCCAATCCAAGACCACGGGGCGCAATTAAAGGTGTGAAG | TGGGGAA | ATAACA | GTVCSKPRTDAWLK |
| | | | | CAGCTTGCTGGTGATCACCACGGTGGTACCTACACCGGCGGGGGAACA | GTCTCCGG | AGAATA | CEILFLLHHAYTANQ |
| | | | | TCTTTAATGCCGAGATGACCGCGCGAATAATAGGGAGCCGGCAAAAGC | ACTGAGCT | CTAATA | NKSIELAESAFRRAGI |
| | | | | CGAGCGTAAGTGGAAAGGATACAGAAATTTGCTCAAAAGTATACCAAC | AAGAGAG | AGTATA | TRRSKATIAKRWSLIQ |
| | | | | CCGCCACTTATAAAAGACCGAGAAAAGGGTACCACTAGAGCTCATTATA | CGTTAAAG | TCATGTA | RGKGTDYKEYWDEY |
| | | | | AAACATCTATGACATGTAATAATGCTGTGGTCTTTCCGCCAGCCGATGGT | TAGAGGGT | ACTATG | FEKFRYECNPTPIVRR |
| | | | | AACCCCGCTGGGACTGCGGATAGGAATTTTGCTATTAGGTTCCCCTCCA | GACGGCGT | ACAAAA | KRNRLAAGLQSPSSV |
| | | | | GTGAACCTCCAGGACCCTCTGGAATACGACCTTCTGAGCCTCTGGACGG | AAGTACCT | AGAACG | PNGYEFERKRTCETPL |
| | | | | TAGAACCGGGATTGGCGACGTTGAGCACGCCCAGGCGGGAAATGGAG | CCAAGTTG | CACCAA | DTKASSLPLICNLLTGI |
| | | | | GATTCCTGGTTGATGTTCTGGAATATAAAGAAGCACATCGCTACGGCTC | CGGTGGA | TAAGAA | VGVENVEENMSVEC |
| | | | | CAAGTGTGAGTTTTGTTATGTGCAAACCAAAGGTACCGTGTGCTCTAAG | GCGGAAC | CATGCTT | TEPKELSGTANSSVP |
| | | | | CCTCGGACCGATGCGTGGTTGAAATGCGAGATTCTGTTCTTGCTTCATCA | ATCTACTC | GAGTGG | GLAEGVYERRHNNV |
| | | | | TGCCTATACGGCTAATCAGAACAAGAGTATTGAACTCGCCGAGAGTGCT | TTCGGAGA | CCAGCT | NEPAAGCPQDVPVA |
| | | | | TTTCGGCGAGCAGGAATTACCCGACGTAGCAAGGCTACCATCGCGAAA | GAGGGGA | CTGCAG | NNLIDSPTTNDRLEA |
| | | | | AGATGGTCCTTAATACAGCGAGGTAAAGGCACCGACTATAAGGAATACT | AGCTCTAT | GCAAAA | EFKAQLDRAERSYMR |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGGACGAGTACTTCGAAAAATTCAGATACGAGTGCAACCCCACACCTAT | GGCGGCG | GTCGAA | RRLPRLKNLSPDERM |
| | | | | AGTACGGCGCAAACGAAACAGGTTAGCCGCTGGGTTACAGTCGCCCAG | TTAGAAAG | TTTGGA | WIGTTVERLRLETVSE |
| | | | | CAGCGTGCCGAACGGATATGAATTTGAGCGGAAAAGGACTTGTGAAAC | GTTGGACT | ACAGCC | PVCEQWRLANAGLY |
| | | | | GCCTCTTGATACCAAGGCTTCAAGTCTTCCACTAATCTGTAACTTGCTAA | ACGGCAAC | GGTAAT | AAIRSIAVMRPLDAA |
| | | | | CAGGAATTGTCGGAGTTGAGAATGTTGAGGAAAATATGAGTGTAGAAT | GCCAGGG | GGAAGA | REAHKTWLLNMKM |
| | | | | GCACTGAGCCGAAAGAGCTAAGTGGAACTGCGAACTCTTCTGTTCCGG | AGATGGG | CCTGCA | TERKLRQQIGWVETT |
| | | | | GTTTGGCAGAAGGAGTATATGAAAGACGACATAACAATGTCAACGAGC | GAAGGTTC | ACAAAC | RRTKNEARTERQEIV |
| | | | | CAGCGGCTGGGTGTCCCCAAGATGTCCCAGTCGCAAACAACTTGATCGA | ATCAGGTG | GTGGGG | YRKVAKLRRERFPEM |
| | | | | TTCCCCAACTACTAACGATCGATTAGAAGCTGAGTTTAAGGCACAGCTG | ATACTAGT | TAGCAG | DLDSVSVHLKRKLELL |
| | | | | GATAGAGCGGAACGGTCTTATATGAGACGAAGGCTACCTAGGCTGAAG | TCGCTACT | GCAATA | KGRIQVRTAERLRRD |
| | | | | AACCTATCCCCTGACGAAAGGATGTGGATTGGAACAACAGTCGAGCGC | GTCATTCG | TGTAACT | TREAAGPYGKTALRG |
| | | | | CTAAGACTCGAGACTGTGAGCGAACCTGTATGTGAACAGTGGCGGCTT | ATGTATCC | ATGACA | QGFAPNVKDATQY |
| | | | | GCCAACGCTGGGCTATATGCAGCTATCCGGTCAATCGCGGTAATGCGCC | GGAACCAT | GACCAA | WSGLAQPSGQKCSE |
| | | | | CCCTGGACGCCGCCCGCGAAGCCCATAAAACTTGGCTTCTAAATATGAA | ACTCGCCA | AACTCC | NSAILSDWKELVECN |
| | | | | AATGACGGAAAGGAAACTAAGACAGCAGATTGGCTGGGTCGAGACGA | AGTTGTGA | GAAACT | LSSLPDQMEPLVVQG |
| | | | | CGCGCCGTACTAAGAACGAGGCACGTACTGAAAGACAAGAAATTGTCT | ACTATGTG | CTGGTA | ISRASPWKSPGPDGI |
| | | | | ATAGAAAAGTGGCCAAACTGCGAAGGGAAAGATTCCCCGAGATGGACC | AAAGTCTG | ATGAGC | FNYYWRQDFIVDWL |
| | | | | TGGACAGTGTGTCAGTCCACCTCAAACGCAAGCTTGAGTTACTTAAAGG | GATCCAAT | CCGTGC | KQLMLDSLRTGHYP |
| | | | | GCGGATTCAAGTGAGAACCGCAGAGAGGTTGCGAAGGGATACCAGAG | CCAAGACC | CCCCCA | WKLSSGRTVLLYKDG |
| | | | | AGGCCGCTGGTCCATATGGTAAGACTGCTCTTCGGGGTCAAGGGTTTGC | ACGGGGC | AGCATG | DPTKAENYRPITCLN |
| | | | | CCCGAATGTAAAAGACGCGACTCAGTACTGGTCTGGATTGGCCCAGCCA | GCAATTAA | TGGTCT | GCFKMINSVVSEVILK |
| | | | | TCCGGACAAAAATGTTCTGAGAACTCGGCGATTCTCTCAGATTGGAAAG | AAGGTGTG | CGTTCG | RVENTIALPIEQMAL |
| | | | | AACTCGTCGAGTGTAATTTAAGCAGCTTGCCGGATCAGATGGAGCCGCT | AAGCAGCT | ATGTAG | RRKVWACVESQIWD |
| | | | | GGTAGTCCAAGGCATAAGTCGGGCTAGTCCATGGAAATCTCCTGGACC | TGCTGGTG | TTAGGA | QIKQRKLSDRTQKCK |
| | | | | GGACGGTATTTTTAACTACTATTGGCGACAAGACTTTATTGTGGACTGGT | ATCACCAC | ACAGTT | VAWVDFSKAYDSLN |
| | | | | TAAAGCAGCTAATGCTGGATTCCTTGAGGACCGGGCACTATCCGTGGAA | GGTGGTAC | CTCTTTA | HDAIKFVIGVLKLPTG |
| | | | | ACTTTCAAGTGGACGCACGGTGCTCCTGTACAAAGACGGGGATCCGACC | CTACACCG | ACCCGT | INNYLLDSMQNWST |
| | | | | AAAGCCGAGAACTACCGACCTATCACCTGCCTAAACGGATGCTTCAAAA | GCGGGGG | GATGAT | HLELKSSGKVVRGPS |
| | | | | TGATCAACTCGGTTGTTTCTGAAGTTATCCTGAAACGCGTCGAAAATAC | AACATCTT | TACGCC | YPIKRGVLQGDSLSPT |
| | | | | GATAGCTCTCCCGATAGAGCAAATGGCTTTACGACGTAAGGTATGGGCA | TAATGCCG | CTGTCTT | LFVVVTSIIVRHIKTIES |
| | | | | TGTGTTGAGTCTCAGATATGGGATCAGATCAAACAGCGGAAGCTGTCTG | AGATGACC | AAATGG | SDIQMYMDDIKLYGK |
| | | | | ATCGAACACAGAAATGCAAGGTAGCGTGGGTAGATTTCTCAAAGGCTTA | GCGCGAAT | CAGGTG | DQETLTRLIKELQTVS |
| | | | | TGACAGTCTTAACCATGATGCTATAAAGTTCGTCATAGGAGTTCTAAAG | AATAGGG | CCACCA | NKLGLCMNLKKCAIL |
| | | | | CTTCCGACAGGTATTAACAACTACCTGCTTGACAGTATGCAGAATTGGA | AGCCGGCA | AATACC | GDDLPEEINGIEHLKE |
| | | | | GCACGCACCTCGAGCTTAAAAGCTCTGGAAAGGTAGTACGAGGCCCTA | AAAGCCGA | GAACAC | SYKYLGVPQREITQV |
| | | | | GTTACCCGATTAAAAGGGGCGTTCTTCAAGGCGATAGTCTAAGCCCAAC | GCGTAAGT | TCGTTG | RATMAALEKKILTEV |
| | | | | ACTGTTTGTCGTGGTGACCAGTATAATAGTACGTCATATCAAGACGATC | GGAAAGG | AGGTAT | DTSLGAAELSYRQRIS |
| | | | | GAAAGTAGTGATATACAAATGTATATGGATGATATCAAGTTGTATGGCA | ATACAGAA | GGTGGT | RVNSKIAPLVRFVVQ |
| | | | | AAGATCAGGAAACTCTGACACGGCTAATAAAAGAGCTGCAGACGGTAT | ATTTGCTC | CCGAAT | SMLVTPRDVLKVYNR |
| | | | | CGAACAAGTTAGGTCTATGTATGAACCTTAAGAAATGCGCAATTCTCGG | AAAAGTAT | GTGAAG | LGGIDVEIRRRLVKYEI |
| | | | | CGACGACCTCCCAGAGGAAATCAACGGGATTGAGCACCTTAAGGAATC | ACCAACCC | CTGGGA | RYKKSNVARLYLDRK |
| | | | | ATATAAGTACTTAGGTGTTCCCCAACGGGAAATCACCCAAGTGCGTGCC | GCCACTTA | GTACAA | VGGIGFVNLCRIMVE |
| | | | | ACCATGGCCGCACTTGAAAAGAAAATACTAACTGAAGTAGATACTAGTC | TAAAAGAC | TTTGGTA | AVAARAVYCRLAPSF |
| | | | | TTGGAGCAGCCGAACTAAGTTACCGCCAACGGATATCGCGTGTTAACTC | CGAGAAA | CGAGAG | NEFQDFLAEQNTSPI |
| | | | | TAAGATCGCGCCGTTGGTGAGGTTCGTTGTGCAGAGTATGCTGGTCACG | AGGGTACC | CACCAG | TAAQTILDKCGINIELS |
| | | | | CCACGCGATGTGCTTAAAGTGTACAATAGGCTTGGAGGCATTGATGTCG | ACTAGAGC | CGCCCC | TSTLGDVKKIVRNHY |
| | | | | AAATTCGAAGAAGACTCGTCAAGTACGAGATCAGATACAAGAAAAGTA | TCATTATA | CGATCT | HELWLTAWKNTGLY |
| | | | | ATGTAGCCCGGCTCTACCTTGATAGAAAAGTTGGCGGCATTGGTTTCGT | AAACATCT | AAGTGA | KRWENDHVDIKRSSL |
| | | | | AAACCTCTGCCGGATAATGGTCGAGGCGGTTGCAGCCAGAGCTGTCTAC | (SEQ ID | TGACGC | WINRGNLSANNARI |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGCAGACTTGCTCCCTCGTTTAATGAGTTCCAAGACTTCCTTGCAGAACAGAATACCAGCCCAATCACTGCTGCACAGACAATTTTAGATAAGTGCGGCATTAATATTGAGCTGAGTACATCTACTCTGGGAGATGTAAAGAAAATAGTGCGAAACCACTATCACGAGCTTTGGCTCACGGCATGGAAGAACACTGGGCTCTATAAACGTTGGGAGAACGACCATGTAGACATTAAAAGATCTAGTTTATGGATCAATCGAGGTAACCTAAGTGCGAATAACGCTCGTATTGGAATTGGCATTCAAGACAACAGTATCTTTTGTCGAGGCTTTGTTGGGAACAAGTGTGATACGAAATATTGCCGATTATGTGGGGATGGCATAGAATCCGTAAGCCATATTGTAACTGGTTGTCCGACTCACCGTACAAACCTGTACATAGAGCGGCATGACTGTGTTGCAAGAAATGTTTACGCATACCTCGCCATAAGGTATGGAATCCCTGTGCCACACTATACGCAGCGAGTCAAGACAATAGAGAAAAACGGCGATCAGTCTGTAGAGCTATACTGGAATTACAAGTTCCCATGCACCCGTGCACTGGAAGCTTGCCGTCCGGATATTGTTCTCATAGATAAGGTTAGTAAGCGAACTCATATAATTGAGGTGGCTGTCTCATGGCGGGGACGGTTACAGGAAATGGTCGATAGGAAAGTGTACAAGTATACGGTAAACGGAGAATACGAAGCCGATGGCTCTTCCCGTGGGTGGAATATCGTCCGTGAACTAAACGATCAGTACGGCTTTCCTGTCGAGGTATATACGCTAGTGATTGGTGCTGGAGGCGAAATCCTACCATGCACGGTTAAAGATGTAGAACGGCTCACCGGTGGAGCGGCTACTGATAACCTCATTGAGCGTATGGAGCGGAGCGCAGTCCTTGGCTCATGTCGTATCATTAAAAGGCATCTGGCACTCTAAGAAAAGCATGAAATAATAAGAAATCAGATAAGAATAACAAGAATACTAATAAGTATATCATGTAACTATGACAAAAAGAACGCACCAATAAGAACATGCTTGAGTGGCCAGCTCTGCAGGCAAAAGTCGAATTTGGAACAGCCGGTAATGGAAGACCTGCAACAAACGTGGGGTAGCAGGCAATATGTAACTATGACAGACCAAAACTCCGAAACTCTGGTAATGAGCCCGTGCCCCCCAAGCATGTGGTCTCGTTCGATGTAGTTAGGAACAGTTCTCTTTAACCCGTGATGATTACGCCCTGTCTTAAATGGCAGGTGCCACCAAATACCGAACACTCGTTGAGGTATGGTGGTCCGAATGTGAAGCTGGGAGTACAATTTGGTACGAGAGCACCAGCGCCCCCGATCTAAGTGATGACGCATGCGTCGGAACAATGAAGACGGCTGGCAAACATTCAGGAGTCGCAAA (SEQ ID NO: 1129) | NO: 1252) | ATGCGTCGGAACAATGAAGACGGCTGGCAAACATTCAGGAGTCGCAAA (SEQ ID NO: 1375) | GIGIQDNSIFCRGFVGNKCDTKYCRLCGDGIESVSHIVTGCPTHRTNLYIERHDCVARNVYAYLAIRYGIPVPHYTQRVKTIEKNGDQSVELYWNYKFPCTRALEACRPDIVLIDKVSKRTHIIEVAVSWRGRLQEMVDRKVYKYTVNGEYEADGSSRGWNIVRELNDQYGFPVEVYTLVIGAGGEILPCTVKDVERLTGGAATDNLIERMERSAVLGSCRIIKRHLAL (SEQ ID NO: 1497) |
| R4 | R4-1_HG | — | *Heterodera glycines* | TGGCGATACTCGGAACCTCCGGGGAGCCTGGTAGGAGTTGGCCTACAGGTCGCGAAAGTCCCTAGGTGCTGCACGGGTTGCGCTAATCCGAGGGCGCTGGGTTACCTTCCCATCGGCCAAAAACGTCTGGGCCTTCTTAGCCGCGGGTCCAGTATTTCTGTTGAGCCTGACAGTTCTTCCCGGATATGGCGAAAGATTACAGGGCGGTATTTCGTGAAACCTAAAAAWGGTCGGGCCGAATGGCACGGACAGACTCACTTCGGAGTGAGCTCGGGGGCATCCGTGTGTTACCCCGCTGCACCACGCCGAAGCTGTCATAGCGAGCCCGAAGGGGAATGGCCATGGAGACTCCAGCCTCACCCTGTAACTCGAACCTAAGTCCAGGCCCCTTTCTGGTGTTGGCTCGCACTGGTTAGGAACACGACAGTCTCGTGTAATCCCACACGCACCGAAAGCCCTAGCCCTCGTAGGCGAAGGCTGCGTTGCTGGTTTCAGAACTGTGAGCWAGTGGGGTTCGGATGGCCGAGTGTACCAACCTGCTTGCTAACAGGTAGCATAGAGTAATATGCTAGTAAGCAGGGCACGAGAAAGGGCCGTAAAGGCTCCGGCTATGAAGGACCTTGCGACCACGCGTGTGTCTCCCACGTGCGGATTCTTGAAGCCAGAGTCTTGCACTGCGCGCAGGATGGAGCCTGTGCAACTCCTCCCTCGCTGATCGCAGGAGTGGAGGATCACCACTCTTTTTACCTTGCTAGCTTGGGGTACCACCTTGAGCTGGGGCCGGCCTTGCTAGCTTGGGGTACGACCCTTTGAGCTGGGGCTGGC | TGGCGATACTCGGAACCTCCGGGGAGCCTGGTAGGAGTTGGCCTACAGGTCGCGAAAGTCCCTAGGTGCTGCACGGGTTGCGCTAATCCGAGGGCGCTGGGTTACCTTCCCATCGGCCAAAAACGTCTGGGCCTTCTTAGCCGCGGGTCCAGTATTTCTGTTGAGCCTGACAGTTCTTCCCGGATATGGCGAAAGATTACAGGGCGGTATTTCGTGAAACCTAAAAAWGGTCGGGCCGAATGGCACGGACAGACTCACTTCGGAGTGAGCTCGGGGGCATCCGTGTGTTACCCCGCTGCACCACGCCGAAGCTGTCATAGCGAGCCCGAAGGGGAATGGCCATGGAGACTCCAGCCTCACCCTGTAACTCGAACCTAAGTCCAGGCCCCTTTCTGGTGTTGGCTCGCACTGGTTAGGAACACGACAGTCTCGTGTAATCCCACACGCACCGAAAGCCCTAGCCCTCGTAGGCGAAGGCTGCGTTGCTGGTTTCAGAACTGTGAGCWAGTGGGGTTCGGATGGCCGAGTGTACCAACCTGCTTGCTAACAGGTAGCATAGAGTAATATGCTAGTAAGCAGGGCACGAGAAAGGGCCGTAAAGGCTCCGGCTATGAAGGACCTTGCGACCACGCGTGTGTCTCCCACGTGCGGATTCTTGAAGCCAGAGTCTTGCACTGCGCGCAGGATGGAGCCTGTGCAACTCCTCCCTCGCTGATCGCAGGAGTGGAGGATCACCACTCTTTTTACCTTGCTAGCTTGGGGTACCACCTTGAGCTGGGGCCGGCCTTGCTAGCTTGGGGTACGACCCTTTGAGCTGGGGCTGGC | TGAGGACTCANAATTGACAATACACCTCAGA (SEQ ID NO: 1376) | MISCDLERETLTQMALFRARSDKTPTHAGIPAPDEVREGGCGQNRTNPAAPRGKAAAIQRQNGITIPIXACAQSGLVRTQRVQQWSAVEESALKDVVVRNTDDRGLINWAKGVLPEWQRLCQLNPTMYMARSSPSLSNKWASLRRTHVGPGCPSKEGSGPSQDLSDVKIQPARLAHDTVAELPQRTVPCGTDGHGVIDSDETETALAEVSRSSPFGEREPLDLGATERITRKRLRNAVRDVVPPRKRRVPSTP |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTTACTAGCTTGGCGCGCCACCCTTGGAGCTGGGGTGGCGCAAGATCAC | CTTAGCCG | | SRKEQDLVPEVDGPA |
| | | | | TTGTATACGGTCTAACCAATACATTTGAAAAGCGATCAAAGCGAAATGA | CGGGTCCA | | PTDVLTHPPTESEPEP |
| | | | | TATCCTGTGATTTGGAAAGAGAAACCTTAACCCAAATGGCTCTCTTTAGA | GTATTTCT | | MLDPLSLVQLVRPQL |
| | | | | GCCCGCAGTGACAAGACGCCGACCCACGCCGGGATACCAGCCCCTGAT | GTTGAGCC | | GRAMGWAAEEMEL |
| | | | | GAGGTCCGAGAGGGAGGGTGCGGCCAAAACCGAACCAATCCCGCGGC | TGACAGTT | | GNVVMDVELKREFN |
| | | | | CCCCCGTGGTAAGGCGGCAGCGATTCAAAGGCAAAACGGCATAACTAT | CTTCCCGG | | REVRRVGRTPPDQM |
| | | | | TCCTATAAAWGCCTGCGCTCAATCCGGCCTAGTCCGGACCCAGAGGGTT | ATATGGCG | | YKRGAGPPLPQKREP |
| | | | | CAGCAGTGGTCAGCCGTGGAGGAGTCCGCCTTAAAGGATGTGGTGGTG | AAAGATTA | | ERVALLEQLIAARVER |
| | | | | CGAAACACAGACGACCGGGGGCTCATTAATTGGGCCAAAGGTGTGCTC | CAGGGCG | | GINRGLDWFLELNVA |
| | | | | CCTGAATGGCAAAGATTGTGCCAGCTCAACCCGACCATGTACATGGCTC | GTATTTCG | | VFAAARVLSRRERVE |
| | | | | GATCGTCTCCATCGCTGTCCAATAAGTGGGCATCTCTGCGGCGGACCCA | TGAAACCT | | TLADRLHINDSATLSE |
| | | | | TGTTGGTCCTGGATGCCCTTCGAAAGAAGGCTCCGGGCCCTCACAAGAC | AAAAAWG | | VSRRRAKAERKLRCA |
| | | | | CTTTCAGATGTAAAAATCCAACCAGCCAGGTTGGCCCATGATACGGTGG | GTCGGGCC | | REQPWMSRRIRXLG |
| | | | | CCGAGCTACCTCAACGTACTGTCCCTTGCGGCACAGACGGTCATGGTGT | GAATGGCA | | VRVERLKQLADLVRQ |
| | | | | AATCGATTCCGATGAGACCGAGACTGCCTTAGCWGAGGTATCCCGGTC | CGGACAG | | RIAGRGNRSSYEGPR |
| | | | | GAGTCCCTTTGGAGAACGCGAGCCGCTCGACTTAGGGGCGACAGAGAG | ACTCACTT | | RRFRLRPSLRSVTEAP |
| | | | | GATCACGCGTAAGCGGCTGCGCAACGCCGTTCGCGATGTGGTTCCACCT | CGGAGTG | | VNPPLNGNEVYTFW |
| | | | | CGGAAACGCAGGGTTCCATCCACCCCTTCACGTAAGGAACAAGATTTGG | AGCTCGGG | | HSLWAQSLRANTDD |
| | | | | TTCCAGAGGTGGACGGGCCTGCACCTACGGATGTGTTGACACACCCACC | GGCATCCG | | CQLREFKNQLSAARH |
| | | | | CACAGAATCCGAACCAGAACCGATGCTTGACCCACTCTCACTTGTCCAAC | TGTGTTAC | | TDLTSVGTSSLVQMF |
| | | | | TGGTAAGGCCGCAATTAGGCCGGGCAATGGGATGGGCAGCCGAGGAG | CCCGCTGC | | SAALRKMKKGKAPG |
| | | | | ATGGAACTCGGGAATGTCGTGATGGACGTGGAGCTGAAGAGGGAGTTC | ACCACGCC | | PDGIRAAWWGVFRR |
| | | | | AACCGGGAGGTGAGGCGTGTCGGAAGAACGCCTCCCGACCAAATGTAT | GAAGCTGT | | IAPYVATWVVRVIRG |
| | | | | AAGCGTGGCGCAGGTCCACCACTCCCACAGAAACGAGAGCCCGAACGA | CATAGCGA | | AEPVANWICNGLTVL |
| | | | | GTAGCCCTACTCGAGCAACTCATTGCGGCGCGCGTGGAGCGTGGCATC | GCCCGAAG | | LPKSSDNADPSNYRPI |
| | | | | AACAGGGGACTTGATTGGTTCCTTGAACTGAATGTCGCGGTCTTTGCAG | GGGAATG | | TCLNTCYKLFTAVIAQ |
| | | | | CCGCTAGGGTTCTGAGCCGCCGGGAGAGAGTGGAAACTCTTGCTGATC | GCCATGGA | | ITASYVDVLGGLPRQ |
| | | | | GGCTGCACATCAACGATTCTGCCACTCTGTCCGAAGTATCCAGACGGCG | GACTCCAG | | QVALRKGVWGTSVS |
| | | | | AGCTAAAGCCGAAAGGAAACTCCGGTGTGCMCGGGAACAACCATGGA | CCTCACCC | | LMIDALTVADARRAK |
| | | | | TGAGCAGGCGGATCAGGAWACTTGGTGTGAGGGTCGAGAGACTCAAA | TGTAACTC | | RPLGVCWFDFKKAF |
| | | | | CAACTAGCTGACCTGGTCCGGCAAAGAATAGCTGGGAGAGGTAATAGA | GAACCTAA | | DSVPHNLIRWILRVIG |
| | | | | TCGTCTTACGAAGGCCCTAGGCGGAGATTCCGACTAAGACCCTCTTTAC | GTCCAGGC | | LPPVILSVIVSVMDQ |
| | | | | GTTCTGTTACTGAAGCACCTGTCAATCCACCCCTTAACGGGAATGAAGTT | CCCTTTCT | | WATRLKIGGKVMPK |
| | | | | TACACGTTCTGGCACAGCCTTTGGGCGCAGAGCCTCCGTGCTAACACGG | GGTGTTGG | | TIPVRTGVFQGDTLS |
| | | | | ATGACTGTCAACTGAGGGAATTCAAAAACCAGCTTTCTGCTGCGCGACA | CTCGCACT | | PLLFCLSVWPISFALD |
| | | | | CACGGATCTGACGAGCGTCGGAACCAGCTCATTGGTTCAGATGTTCAGC | GGTTAGGA | | QFPQYQFRCANHLQ |
| | | | | GCGGCCCTTCGGAAAATGAAGAAGGGCAAAGCTCCCGGTCCTGATGGT | ACACGACA | | QGFSVGHVFYMDDL |
| | | | | ATCCGTGCCGCGTGGTGGGGAGTGTTCCGGCGAATTGCACCGTATGTG | GTCTCGTG | | KCYCPDREVLTAVIQ |
| | | | | GCTACGTGGGTGGTCCGAGTAATACGWGGGGCAGAACCAGTAGCTAA | TAATCCCA | | QVQKSASALGLTIHY |
| | | | | CTGGATCTGCAACGGGCTCACTGTCCTGCTGCCCAAGAGTAGTGACAAT | CACGCACC | | KKSAWLDQDGGKSG |
| | | | | GCCGACCCTAGTAACTACCGGCCAATCACATGCCTAAATACMTGCTACA | GAAAGCCC | | KAVLGVPXLVGTYKY |
| | | | | AACTCTTCACTGCCGTTATCGCACAAATAACCGCAAGTTACGTTGATGTT | TAGCCCTC | | LGMHERFMIVSKDSL |
| | | | | CTTGGTGGCCTACCTAGACAACAAGTAGCACTGCGAAAAGGCGTTTGG | GTAGGCG | | ESVRGKFMGRLKTL |
| | | | | GGCACCTCTGTGTCCCTGATGATCGATGCGCTAACGGTGGCTGACGCGA | AAGGCTGC | | WTSKLTFGQAMLGT |
| | | | | GAAGAGCTAAACGCCCACTTGGAGTCTGCTGGTTCGACTTCAAGAAAGC | GTTGCTGG | | KSXCMPVVRYVLQNL |
| | | | | GTTTGACTCAGTACCGCACAACTTAATTCGCTGGATCCTGAGAGTCATCG | TTTCAGAA | | FLPKSEFNQTRLVLRE |
| | | | | GACTCCCCCCGGTCATCTTGTCTGTCATTGTCTCTGTGATGGATCAATGG | CTGTGAGC | | WDRQIRDLLDECNIR |
| | | | | GCAACGAGGCTMAAGATAGGTGGAAAGGTCATGCCCAAGACCATCCC | WAGTGGG | | QVFRSKTELYVSREEG |
| | | | | GGTGCGAACCGGCGTATTCCAAGGGGACACCCTATCGCCCCTGCTKTTC | GTTCGGAT | | GWGLPSMEDALEEE |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGCCTATCKGTKTGGCCAATMTCGTTCGCCCTAGACCAATTTCCTCAGTA | GGCCGAGT | | VVTKLAILVARQETEP |
| | | | | TCAGTTTCGTTGTGCAAACCATCTTCAGCAGGGCTTTAGTGTCGGACAC | GTACCAAC | | LFRVCEALERKRCPTP |
| | | | | GTGTTTTACATGGACGACCTGAAATGCTATTGCCCAGACAGGGAAGTGT | CTGCTTGC | | LSLGLQILKDWGVGV |
| | | | | TGACAGCAGTTATTCAGCAGGTGCAGAAGAGCGCTTCTGCCCTCGGTCT | TAACAGGT | | ELQGRTLLLNGNTVG |
| | | | | GACGATCCACTACAAGAAATCTGCGTGGCTCGACCAGGACGGCGGGAA | AGCATAGA | | PSQATRKLTGELVLR |
| | | | | AAGTGGCAAAGCCGTCTTGGGTGTACCAGWACTTGTCGGCACTTACAA | GTAATATG | | REAERLSRWRSKVKP |
| | | | | GTACCTGGGAATGCACGAGAGATTCATGATTGTAAGCAAAGACAGTCTT | CTAGTAAG | | GCGMTGGAWRDVP |
| | | | | GAGTCAGTCAGGGGAAAGTTCATGGGGCGGCTTAAAACCCTGTGGACC | CAGGGCAC | | GIDVHLSNRWLVKG |
| | | | | TCGAAACTGACATTCGGGCAGGCAATGCTTGGCACAAAGAGCMTCTGC | GAGAAAG | | ALSPTVVSNSLAIRAN |
| | | | | ATGCCAGTCGTGCGCTACGTGCTGCAGAATCTATTCCTACCAAAATCGG | GGCCGTAA | | TVILRGSGGGYTKGTL |
| | | | | AATTCAACCAGACCCGTCTGGTCCTGAGAGAGTGGGATCGTCAGATCAG | AGGCTCCG | | LRCRGCGNTGETRRH |
| | | | | AGACCTACTGGATGAATGTAATATCCGGCAGGTTTTCCGAAGCAAGACG | GCTATGAA | | IVSACSLGRQKGAAS |
| | | | | GAGTTATATGTCAGCCGCGAAGAGGGTGGCTGGGGTCTTCCTAGCATG | GGACCTTG | | RRHDNVCRILVRAIC |
| | | | | GAAGACGCCCTCGAGGAAGAGGTAGTCACAAAACTTGCCATACTTGTTG | CGACCACG | | HKLNIEPPNSANFPH |
| | | | | CAAGACAAGAAACTGAGCCGTTGTTCCGGGTGTGTGAAGCTCTTGAAA | CGTGTGTC | | VVVLEGSGAKMWID |
| | | | | GGAAAAGGTGCCCCACCCCCCCTGTCCCTAGGATTGCAAATACTGAAGGA | TCCCACGT | | FPFVVPHKIRHTRPDI |
| | | | | CTGGGGAGTTGGGGTAGAGTTACAGGGCCGCACATTGCTGCTGAACGG | GCGGATTC | | VVLFEWNGVRRLSVI |
| | | | | GAACACAGTGGGCCCATCTCAGGCAACCAGAAAACTCACTGGAGAACT | TTGAAGCC | | EVAVSDVANMQTQ |
| | | | | GGTCCTGAGGAGGGAAGCGGAACGGCTCAGTAGATGGAGAAGTAAAG | AGAGTCTT | | HIRKSHRYGTNSTEPF |
| | | | | TGAAACCTGGCTGTGGCATGACTGGAGGGGCATGGCGGGATGTGCCCG | GCACTGCG | | VAGVTPTYRNDCLAA |
| | | | | GAATCGATGTCCATCTTAGCAATAGGTGGCTCGTCAAAGGTGCACTGTC | CGCAGGAT | | QLRAKFKAQQVDVIP |
| | | | | TCCGACCGTTGTCTCAAACAGCCTTGCCATACGAGCAAACACGGTGATT | GGAGCCTG | | IIVGTTGETLDGEFGR |
| | | | | CTGAGAGGGAGTGGCGGGGGCTACACCAAAGGTACCCTCCTCCGGTGC | TGCAACTC | | IRKGLPMLTKLQMPR |
| | | | | AGAGGATGTGGTAACACGGGAGAAACACGCAGACACATTGTGTCAGCA | CTCCCTCG | | LWSEIQRAVILGSYRI |
| | | | | TGCTCCCTGGGAAGGCAGAAGGGGGCTGCCTCCCGCAGGCACGACAAC | CTGATCGC | | LVEHLALPKGGA |
| | | | | GTCTGCAGGATATTGGTGCGAGCCATCTGCCACAAACTCAACATTGAAC | AGGAGTG | | (SEQ ID NO: 1498) |
| | | | | CGCCCAACTCAGCCAACTTCCCCCATGTCGTTGTGCTGGAAGGCAGTGG | GAGGATCA | | |
| | | | | TGCTAAGATGTGGATAGACTTTCCCTTCGTGGTGCCACATAAGATCCGC | CCACTCTT | | |
| | | | | CACACACGACCTGACATCGTCGTCTTGTTTGAGTGGAACGGGGTCAGAC | TTTACCTT | | |
| | | | | GTCTTAGTGTCATCGAAGTGGCTGTTAGCGATGTGGCAAATATGCAAAC | GCTAGCTT | | |
| | | | | ACAACACATCCGCAAATCCCACAGATATGGCACCAACTCGACTGAACCC | GGGGTACC | | |
| | | | | TTCGTCGCGGGGGTCACGCCTACGTATAGGAATGACTGCCTGGCAGCG | ACCTTGAG | | |
| | | | | CAGTTGCGAGCGAAATTTAAAGCCCAGCAAGTTGATGTGATCCCGATCA | CTGGGGCC | | |
| | | | | TTGTCGGGACCACTGGTGAAACATTGGATGGCGAGTTTGGGCGGATCC | GGCCTTGC | | |
| | | | | GAAAGGGTTTGCCTATGCTCACTAAACTGCAGATGCCAAGGCTGTGGTC | TAGCTTGG | | |
| | | | | AGAAATCCAGCGGGCGGTGATCCTCGGATCATATCGAATTTTGGTTGAA | GGTACGAC | | |
| | | | | CATCTTGCGCTACCAAAGGGGGGCGCTTGAGGACTCANAATTGACAAT | CCTTTGAG | | |
| | | | | ACACCTCAGA (SEQ ID NO: 1130) | CTGGGGCT | | |
| | | | | | GGCCTTAC | | |
| | | | | | TAGCTTGG | | |
| | | | | | CGCGCCAC | | |
| | | | | | CCTTGGAG | | |
| | | | | | CTGGGGT | | |
| | | | | | GGCGCAA | | |
| | | | | | GATCACTT | | |
| | | | | | GTATACGG | | |
| | | | | | TCTAACCA | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | ATACATTT | | |
| | | | | | GAAAAGC | | |
| | | | | | GATCAAAG | | |
| | | | | | CGAA (SEQ | | |
| | | | | | ID NO: | | |
| | | | | | 1253) | | |
| R4 | R4- | — | *Parhyale* | CCGACCGCCAGCGGGATAACTGGCAAACCCTGTCTCGACCACCGGCCCG | CCGACCGC | TGAGCC | MKMSHNRDTPSNG |
| | 1_PH | | *hawaiensis* | TGAATCCATCGGGGCGTATGAGTCTGACACAGGGGGGTGTTTAAGGTG | CAGCGGG | TTAGGT | VKGTSVRLGTSLVRSP |
| | | | | ACCCTGTTGCGAGGAAATGCGCAGCAAAAGCCGGATGAGCCTTAGAAC | ATAACTGG | CGCGGG | VGEAGAVRERGTHP |
| | | | | ATCGAAGGCCAACGACAACCTGCCGAAAGACTGGCGACTAATCCAGTC | CAAACCCT | ATGTGA | SESVSQDSDASVNAT |
| | | | | AACCTCCTGTAGGTCACCGGCTGGTCATGCTGAATCTCAGCTTAACCAG | GTCTCGAC | CCCGGC | GEGSVREQAPLSPPG |
| | | | | GCGTACGAACTTACAGTTGGAGGGTCGAGCACCCCTGATGGCTGAAAA | CACCGGCC | GCCAGA | AEEATVPTQRRTRHK |
| | | | | GGACCATCAAAGTCGAAGGTAGCCAACGAGAAGACCAACGGCTGATTC | CGTGAATC | GTGTAG | WSREDRVVLWECFV |
| | | | | AGGCGGAAGAGTCAACTCGTTGAATGCGTTCGACAGCTTGGGGTAGAT | CATCGGGG | AGCTGA | ASKREGPGYLKRLKQ |
| | | | | GGAACTCCTAAGCCCTGAAAGGCAGTCCATCTTCGCAGACGCTAAGGTG | CGTATGAG | ACATCG | LWDERGIPGNFPQA |
| | | | | CCCCGCCGCCTGAGGGTTATCAGGCCCCGCCGCCTGAGGGTTACCAGGC | TCTGACAC | CTCAACC | SLSGQIRQICSKNLLS |
| | | | | AACCATGAAAATGAGTCATAATAGAGATACCCCTTCTAACGGCGTGAAG | AGGGGGG | GATCCA | EEERLQIAARMEAQV |
| | | | | GGTACCTCAGTTAGACTGGGTACCTCGCTCGTCCGGTCTCCTGTGGGTG | TGTTTAAG | ATTTGG | ASPSADEPARQVPTR |
| | | | | AGGCAGGGGCCGTTCGTGAACGCGGTACTCACCCGTCGGAATCGGTTA | GTGACCCT | GTCGTG | PVTPPRSPPVEPARR |
| | | | | GCCAGGATTCCGACGCTAGTGTGAATGCTACTGGAGAGGGGAGTGTGA | GTTGCGAG | AAATCC | PSIPSEETPDLGAVPS |
| | | | | GGGAGCAGGCTCCCCTTTCTCCGCCGGGGGCGGAGGAGGCTACTGTCC | GAAATGCG | CCTCGAT | EIDSADPNRSPSRGP |
| | | | | CGACGCAACGCCGCACGCGCCACAAGTGGTCCAGGGAAGACCGAGTTG | CAGCAAAA | AATAAT | RHLPAHNMSQSESE |
| | | | | TGCTGTGGGAGTGCTTCGTCGCCAGCAAGCGCGAGGGGCCAGGCTATC | GCCGGATG | AATAAT | DDVTDPDVSDQQRS |
| | | | | TCAAGCGCCTCAAGCAGCTGTGGGACGAGAGAGGAATCCCGGGCAATT | AGCCTTAG | AA (SEQ | DSLEPRDLLRNSSVES |
| | | | | TCCCACAGGCTTCTCTTAGTGGCCAAATCCGGCAAATCTGCAGCAAAAA | AACATCGA | ID NO: | TPGHPNQELSDTLLS |
| | | | | CCTCCTCAGCGAAGAGGAACGGCTTCAAATCGCTGCGCGGATGGAAGC | AGGCCAAC | 1377) | NYVPSEIDSDDPNQS |
| | | | | TCAAGTTGCCTCTCCATCCGCTGACGAACCTGCACGCCAGGTTCCAACCC | GACAACCT | | PRRGPRHLPAHDMS |
| | | | | GACCTGTGACCCCGCCTAGGTCCCCACCTGTGGAACCTGCTAGGCGGCC | GCCGAAA | | LSDSMDEETEPDLSD |
| | | | | CTCCATTCCATCGGAGGAAACCCCCGACTTAGGCGCTGTCCCGTCTGAG | GACTGGCG | | QQRSDLLELRDLLRN |
| | | | | ATCGACTCTGCCGACCCCAACCGGTCGCCCTCACGTGGGCCTAGGCACT | ACTAATCC | | SSVETTPKGHPSLRHL |
| | | | | TACCGGCCCACAATATGAGCCAGAGCGAGTCAGAAGACGATGTGACAG | AGTCAACC | | PEPKIRAAAFRVNSVI |
| | | | | ATCCCGACGTGTCTGACCAGCAGCGGAGTGACTCGCTGGAGCCACGGG | TCCTGTAG | | GKIHTNNITETNALIK |
| | | | | ACTTACTCCGAAACTCCAGCGTAGAATCAACGCCAGGTCACCCTAACCA | GTCACCGG | | AGADLAVRILEVQPR |
| | | | | GGAACTTAGTGACACCCTACTGTCGAACTACGTCCCATCTGAGATCGAC | CTGGTCAT | | PQRTQRKKDPPWKH |
| | | | | TCGGACGACCCCAACCAGTCGCCGCGACGTGGGCCTCGGCACTTACCG | GCTGAATC | | RLEKNIAEIRKHLSWI |
| | | | | GCCCACGATATGAGCCTGAGCGACTCGATGGACGAAGAGACAGAACCT | TCAGCTTA | | SEWRRGNLHDEEKK |
| | | | | GACCTATCCGACCAGCAGCGGAGTGACTTGCTGGAGCTGCGGGACTTA | ACCAGGCG | | TLLESRYRCLEVGLTN |
| | | | | CTCCGGAACTCCAGCGTAGAAACGACGCCAAAAGGTCATCCTAGCCTAC | TACGAACT | | LEDTLKQRLSAKRSKV |
| | | | | GACATCTACCGGAACCGAAGATCCGAGCAGCTGCTTTCCGCGTCAACTC | TACAGTTG | | RRFEARVAGFHQNQ |
| | | | | AGTGATTGGTAAAATCCACACCAACAACATCACTGAGACAAACGCCCTC | GAGGGTC | | LFNTNQKRLYQTLRG |
| | | | | ATCAAAGCTGGAGCAGACCTCGCAGTGAGGATCCTTGAGGTACAACCC | GAGCACCC | | EETSSDSPNAEESIRF |
| | | | | CGACCGCAACGGACCCAGCGGAAAAAGGATCCTCCTTGGAAGCACCGC | CTGATGGC | | WSDIWSKEVRHNNT |
| | | | | CTCGAGAAGAACATTGCTGAGATCAGGAAACATCTCAGCTGGATCTCCG | TGAAAAG | | AEWLHDVKEKNVAA |
| | | | | AATGGCGCAGAGGAAATCTCCACGACGAGGAAAAGAAGACGCTGCTCG | GACCATCA | | DPDLTITSQQLKKQLS |
| | | | | AATCGAGGTACCGGTGCCTCGAAGTCGGCCTAACCAACTTAGAAGATAC | AAGTCGAA | | KTKNWKAPGPDMV |
| | | | | CTTAAAGCAGCGGCTATCTGCTAAAAGGAGCAAAGTTAGACGCTTCGAG | GGTAGCCA | | QGYWIKTFTSLHSRIA |
| | | | | GCCAGAGTAGCTGGATTCCATCAGAACCAGCTATTCAACACCAACCAGA | ACGAGAA | | AQLNHCLQRGTVPT |
| | | | | AACGCCTCTATCAAACCCTTAGAGGAGAAGAGACGAGCTCTGACTCACC | GACCAACG | | WMTTGKTVLIQKDK |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAACGCAGAAGAGAGCATCCGATTCTGGAGTGACATCTGGAGCAAAGA | GCTGATTC | | AKGTEVSNYRPITCLP |
| | | | | GGTACGGCACAACAATACCGCAGAATGGCTCCACGACGTCAAGGAGAA | AGGCGGA | | LMWKVLTGIIYERVY |
| | | | | GAACGTCGCAGCAGATCCAGACCTTACAATCACCAGTCAACAGCTCAAA | AGAGTCAA | | QHLDSKKLLPDEQKG |
| | | | | AAGCAACTGAGCAAGACCAAGAACTGGAAAGCACCCGGACCAGATATG | CTCGTTGA | | CRRNTRGTKDHLLVD |
| | | | | GTGCAAGGCTACTGGATCAAAACTTTCACATCGCTGCACTCCAGAATTG | ATGCGTTC | | KLLTKDARSKKKNLS |
| | | | | CTGCACAGCTCAACCACTGCCTGCAACGCGGAACCGTGCCCACCTGGAT | GACAGCTT | | MAWVDYKKAFDMV |
| | | | | GACCACAGGGAAGACGGTCCTAATCCAGAAGGACAAGGCAAAGGGCA | GGGGTAG | | PHSWILECLDIYGIAG |
| | | | | CGGAGGTCAGCAATTACCGCCCAATCACGTGCCTCCCCCTTATGTGGAA | ATGGAACT | | NIRNLIATTMPNWKT |
| | | | | GGTGCTGACGGGCATAATCTACGAGAGAGTCTACCAACATCTAGACTCA | CCTAAGCC | | QLTSANKHLGEVSIKR |
| | | | | AAGAAGCTCCTACCCGACGAACAGAAAGGATGCCGCAGGAACACCAGG | CTGAAAGG | | GIFQGDSLSPLLFVLT |
| | | | | GGAACGAAGGACCATTTGCTCGTCGACAAGCTCCTCACGAAAGATGCCA | CAGTCCAT | | MIPLSETLNKAGQGY |
| | | | | GGAGCAAAAAGAAAAACCTAAGCATGGCTTGGGTTGATTACAAAAAAG | CTTCGCAG | | NYSRTMKLNHLLYM |
| | | | | CCTTCGACATGGTCCCTCACTCCTGGATCCTGGAATGCCTGGACATCTAC | ACGCTAAG | | DDLKLYAKSKDQVEQ |
| | | | | GGCATTGCCGGCAACATCCGCAATCTGATCGCGACGACCATGCCCAACT | GTGCCCCG | | LLNIVHQYSQDIKMQ |
| | | | | GGAAGACCCAGCTCACAAGCGCCAATAAACACCTCGGCGAGGTGAGCA | CCGCCTGA | | FGVSKCGVLNIERGE |
| | | | | TCAAGCGGGGCATCTTCCAGGGCGACTCCCTATCTCCACTGCTCTTTGTC | GGGTTATC | | VTASEGITIEEGTIKDI |
| | | | | CTGACCATGATCCCCCTCTCCGAGACCCTGAACAAGGCCGGCCAGGGCT | AGGCCCCG | | EEAGYKYLGVMEYNT |
| | | | | ACAACTACAGTCGTACCATGAAGCTCAACCACCTGCTTTACATGGACGAT | CCGCCTGA | | ILHRTMKDSIRKEYLT |
| | | | | CTGAAGCTCTACGCCAAATCAAAGGACCAAGTAGAGCAGCTCCTTAATA | GGGTTACC | | RLRLILKSHLNGGNTI |
| | | | | TAGTCCATCAGTACTCCCAAGACATCAAGATGCAGTTCGGTGTTAGCAA | AGGCAACC | | KAINTWAVPVVRYSA |
| | | | | ATGCGGAGTCCTTAACATCGAAAGGGGAGAGGTTACTGCGTCCGAGGG | (SEQ ID | | GIINWTKKDCTDMDI |
| | | | | AATCACCATCGAAGAAGGTACCATCAAGGATATCGAGGAGGCAGGTTA | NO: 1254) | | KTRKLMTIYRALHPRS |
| | | | | CAAGTACCTGGGTGTCATGGAGTATAACACCATTCTCCACAGAACGATG | | | CVDRLYINRREGGRG |
| | | | | AAAGATTCCATTCGGAAGGAGTACCTCACCCGACTCCGGCTCATCCTGA | | | LISVEDCVEAEKRALS |
| | | | | AATCACACCTCAATGGGGGCAACACCATCAAGGCCATCAACACCTGGGC | | | QHFRESDDPWARCL |
| | | | | CGTCCCCGTAGTCCGATATTCTGCTGGCATTATTAACTGGACCAAGAAA | | | VEAKLLKETETADQF |
| | | | | GACTGCACCGACATGGACATCAAAACCAGGAAGCTCATGACCATCTATC | | | KERRRLDRTNKWKS |
| | | | | GAGCACTGCACCCAAGATCGTGCGTAGACAGACTCTACATTAACAGAAG | | | MKMSGQYLEAVQD |
| | | | | AGAGGGGGGCCGTGGCCTCATCAGCGTCGAGGACTGCGTCGAAGCGG | | | KIVPDSWNWLLRGEL |
| | | | | AAAAACGCGCTCTCTCCCAACACTTCAGAGAGAGCGACGACCCGTGGGC | | | KRETEGTILAAQEQA |
| | | | | ACGCTGCTTAGTCGAGGCGAAGTTGCTGAAAGAGACCGAAACGGCTGA | | | LRTRYIQNKIDKRNVP |
| | | | | CCAATTCAAAGAGCGACGGCGCCTCGATCGGACTAACAAATGGAAGAG | | | STCRICRSSDETINHVI |
| | | | | CATGAAGATGTCCGGCCAGTACCTCGAAGCTGTTCAGGACAAAATCGTA | | | SECGVLAQKEYKRRH |
| | | | | CCAGACTCTTGGAACTGGCTTCTGAGGGGTGAGCTGAAACGGGAAACA | | | DKVARHLHWTLLRIH |
| | | | | GAAGGCACCATCCTGGCAGCTCAAGAGCAAGCCCTCAGAACCAGGTAC | | | NFPVSERWYEHEPAP |
| | | | | ATCCAAAACAAGATCGACAAGAGAAACGTCCCTAGTACCTGTAGAATTT | | | VVENEAVQIYWDKR |
| | | | | GCAGGAGCTCGGATGAAACCATCAACCACGTGATAAGCGAATGCGGAG | | | METDRVLHANRPDI |
| | | | | TGCTGGCGCAAAAGGAGTACAAGCGCAGGCACGATAAAGTTGCCCGAC | | | VVKDKQEKSAKLIDISI |
| | | | | ACCTTCACTGGACCCTCCTGCGGATCCATAACTTCCCGGTCAGTGAGAG | | | PFDSRIVDKEAEKKEK |
| | | | | GTGGTACGAGCACGAACCCGCGCCCGTGGTTGAAAACGAAGCCGTGCA | | | YRDLAIELQRLWQM |
| | | | | GATCTACTGGGACAAGAGGATGGAAACTGATCGAGTACTTCACGCCAA | | | KVDVVPVVIGALGA |
| | | | | CCGACCGGACATCGTCGTCAAAGACAAACAGGAGAAGTCGGCCAAACT | | | MSKNLKTALRELKCG |
| | | | | GATCGACATTTCAATCCCCTTCGACTCCAGAATCGTGGACAAGGAAGCG | | | HLHPGTLQKSALLGT |
| | | | | GAGAAGAAGGAAAAGTACCGTGACCTTGCCATCGAACTCCAGAGACTG | | | AHIIRKVL (SEQ ID |
| | | | | TGGCAGATGAAGGTGGACGTCGTTCCAGTGGTCATCGGAGCTCTGGGG | | | NO: 1499) |
| | | | | GCAATGTCCAAGAATCTCAAGACTGCCCTGCGAGAGCTGAAGTGCGGC | | | |
| | | | | CATCTCCACCCAGGAACCCTCCAGAAGAGCGCTCTGCTTGGAACAGCGC | | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ACATCATTCGCAAAGTGCTCTGAGCCTTAGGTCGCGGGATGTGACCCGG | | | |
| | | | | CGCCAGAGTGTAGAGCTGAACATCGCTCAACCGATCCAATTTGGGTCGT | | | |
| | | | | GAAATCCCCTCGATAATAATAATAATAA (SEQ ID NO: 1131) | | | |
| R4 | R4-2_BX | CADV01009048 | *Bursa-phelenchus xylophilus* | GAGGATCCTGGGTTCCTACTACCCTGCTCCATCTCCTCGCGATGGATCCT | GAGGATCC | TAACAA | MVFNNCKPKHLCPAI |
| | | | | TGGGGAAGTCTCCGGACTGAGCTAAGAGAGCGTTAAAGTAGAGGGTG | TGGGTTCC | GTGTAA | RPTGQQETNGGSEG |
| | | | | GCGGCGTAGTGACTTCCAAGTTGCGATGGGGCGGAACATCTACTCTTCT | TACTACCC | TAAAAA | TAEPTAGPSRPAVSE |
| | | | | GAGAGAGGGAAAGCCCTATGGCGGCGGTAGAAAGGTTGGGCTACGGC | TGCTCCAT | CCACCC | DAAQPVPLFEEGEYI |
| | | | | AACACTTGCCATGATCAGATTCGATCAAAATTAGCCTCTGGGGCTGGCA | CTCCTCGC | ATGCGT | RAHRDKTCPYCEVL |
| | | | | ACCCTACAACGGATTGTAAACTGAACTATGCTATGCAAAATGAAAATAA | GATGGATC | AGTAAA | WIGARSSKARSDSW |
| | | | | AAAATGGGGGCTTTACAATCTAAGGTGTTGGCAGATCACGAAAACTGCC | CTTGGGGA | CCGATC | PLCQILYLMKRNDDL |
| | | | | CGTCGATGAGGGTGAGATAACATCCTACGGAACAGCCCCTGCTGGACC | AGTCTCCG | AATTATC | RGQRTRYPLLESSLRA |
| | | | | AAACCAAATCATCCACAAATTGGAGGGTTTTCTTGGTAGTTTCCCTTGGC | GACTGAGC | TAGCAA | AGIARTKFAIIKCIRNV |
| | | | | ACGTCTTGTTTCATAAGCCAGAATAAAAACGATACCATACAGACATGAG | TAAGAGA | AATCGC | LRDRYVPNGPYSEH |
| | | | | GCTGGGTACCTGCCAGCCGCGACACGGAAAACCGGTAGGTGCAACCGG | GCGTTAAA | AGGTCA | WKIYRANSGEVPQG |
| | | | | AGACAGCTAGGGGAAAGAAAATAGTAAAGTGTCGAAAACAAAACAGG | GTAGAGG | GAAGAC | ATITKGKRSARVAGL |
| | | | | TAGCCCCTGGCTAGAGGGAATGGGACATTGTCCGATTAGGTTGCCTTGA | GTGGCGG | CAAAGA | PSPSQSGHHTKRIQA |
| | | | | CCCAATGAAAGCCAACCGGGTTTACATTATCGGTCTACCAAGGGCAATG | CGTAGTGA | ACCGAC | GTGIETETTVTETNTT |
| | | | | ACCAGAGAAACTGCGACTATGCCGTAACCCTTCGCAGATTGCCGATGAG | CTTCCAAG | CCAGAG | PEVSHEHRDPCGEPE |
| | | | | AACCATCGATCGTAAGTCGAAGCCAAGCGGATTGACCAGTGGAGGGTT | TTGCGATG | GAATAG | TSAANVDKVTELTED |
| | | | | ATCCCGACAACAGCATGGTATTCAATAATTGTAAACCTAAACACCTGTGC | GGGCGGA | GACCAG | GSETRGTANVANGG |
| | | | | CCTGCGATCCGTCCGACAGGGCAACAGGAAACGAACGGTGGTAGCGAG | ACATCTAC | AGCTGA | VSVSDPGRKRQSSSQ |
| | | | | GGCACTGCTGAGCCTACCGCTGGTCCTTCGAGACCGGCAGTGAGCGAG | TCTTCTGA | AACTCTC | NRGNIETTNPELVG |
| | | | | GATGCAGCCCAACCGGTGCCACTGTTCGAAGAGGGCGAATATATAAGG | GAGAGGG | AGATAC | MWEDMFGVQLDGA |
| | | | | GCTCACCGCGATAAGACTTGTCCTTATTGCGAAGTCCTGTGGATAGGAG | AAAGCCCT | GCCAAC | MRTTERPRLPKLKHL |
| | | | | CGCGGTCTTCAAAGGCCCGCTCCGACAGCTGGCCATTGTGCCAAATCTT | ATGGCGGC | GGTCCT | SEPERLWIRAKLEQA |
| | | | | GTACTTAATGAAGCGCAACGACGACCTCAGAGGTCAAAGGACGAGGTA | GGTAGAA | AATAAA | WLQCVSYDVEQQW |
| | | | | TCCACTGCTCGAGAGTTCTTTGAGAGCAGCCGGAATTGCCCGTACTAAG | AGGTTGG | ACGTCG | LNANAVLYAAIRSVA |
| | | | | TTTGCGATTATCAAGTGTATTCGGAACGTGTTGAGAGACCGGTATGTGC | GCTACGGC | TTAAGT | ASRPCKEAREAQKT |
| | | | | CCAACGGCCCATACTCTGAGCATTGGAAAATTTACCGCGCGAATAGCGG | AACACTTG | AAAGCA | WLDNKKKDEAKLRRL |
| | | | | GGAAGTTCCTCAGGGAGCGACCATAACAAAAGGGAAGAGGTCCGCCAG | CCATGATC | TCGTTAA | IGRISSVHSMPKGDR |
| | | | | AGTTGCGGGGCTTCCCTCCCCAAGCCAGAGCGGTCACCACACGAAACG | AGATTCGA | GTACAA | TPREKKLVKNITKLKN |
| | | | | AATACAAGCTGGAACTGGAATTGAAACGGAAACTACGGTGACTGAGAC | TCAAAATT | AACAAA | THYPDMDWGGLLN |
| | | | | TAACACAACACCCGAGGTTTCGCATGAACACAGAGATCCCTGCGGGGA | AGCCTCTG | AGCACT | HFKVKLSQLKEKISVR |
| | | | | ACCAGAGACGAGTGCTGCTAATGTAGATAAGGTAACGGAATTGACGGA | GGGCTGG | GTAAAC | VAEHKRKVNRNAAG |
| | | | | AGATGGGTCTGAAACCAGAGGAACTGCGAACGTCGCTAACGGTGGGGT | CAACCCTA | GCGAGG | QYGKSVAGSAGLAP |
| | | | | TTCTGTTAGCGATCCTGGTCGTAAAAGGCAGAGTTCAAGCCAAAATAGA | CAACGGAT | CCCCCTC | DVVSATAYWSGLAQ |
| | | | | GGAAATATCGAAACGACTAATCCAGAATTAGTCGGTATGTGGGAAGAC | TGTAAACT | TTTGCCA | PGPKKFKASSPIFQT |
| | | | | ATGTTTGGAGTGCAGCTTGATGGAGCGATGCGCACAACAGAGCGACCA | GAACTATG | AACTCC | WKDDVAKNLNTEPV |
| | | | | AGGCTACCCAAACTGAAGCACCTGTCCGAACCCGAGAGGTTATGGATCA | CTATGCAA | GGTAAT | LLYPIIKECIRKPSPWK |
| | | | | GGGCGAAGTTGGAACAGGCTTGGCTGCAGTGCGTTAGCTATGACGTCG | AATGAAAA | CCTCGTA | APGPDGIYNYYWQQ |
| | | | | AACAGCAATGGCTTAACGCCAACGCGGTTCTATACGCCGCCATCAGGTC | TAAAAAAT | GTACGG | EFVAQWIQTLVKRTL |
| | | | | AGTCGCGGCTAGCAGACCTTGTAAAGAGGCCCGCGAAGCTCAAAAAAC | GGGGGCT | TGCTTTT | DIGRFPTALMCGRTV |
| | | | | ATGGCTGGATAATAAAAAGAAGGATGAGGCGAAATTGAGGCGGCTGAT | TTACAATC | TCCCGCT | LLFKSGDKSMPQNYR |
| | | | | CGGGAGAATCAGCTCTGTCCACAGTATGCCGAAAGGCGACCGTACGCC | TAAGGTGT | TCACGA | PITCLNGCFKITNAVL |
| | | | | ACGAGAAAAGAAACTCGTGAAGAATATAACTAAGTTGAAAAACACCCA | TGGCAGAT | ATCAGA | TKVILQRVQDTCALP |
| | | | | CTATCCAGACATGGATTGGGGTGGACTTCTGAACCATTTTAAGGTAAAG | CACGAAAA | ACGCTG | REQMALKPKVWSC |
| | | | | TTGTCGCAACTTAAAGAAAAGATTAGCGTGCGGGTGGCGGAGCATAAG | CTGCCCGT | CCAGAT | MEAQLRDQALQSEI |
| | | | | CGGAAAGTTAATCGTAACGCAGCAGGACAGTACGGCAAAAGTGTGGCC | CGATGAG | CTTGTCC | GDDCKTAWIDFSKAY |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GGCAGCGCAGGGTTAGCGCCGGATGTCGTTTCCGCGACGGCATACTGG | GGTGAGAT | GACATG | DSLDHDALRFVIQTIA |
| | | | | TCAGGTCTTGCACAACCTGGGCCAAAGAAATTTAAAGCAAGCTCGCCGA | AACATCCT | GGCCGT | LPAGMEEYLLKSLDS |
| | | | | TCTTCCAGACTTGGAAAGACGACGTAGCGAAGAACTTGAACACTGAGCC | ACGGAACA | AGGGTT | WRTQLVLSDAGKVV |
| | | | | GGTACTGCTGTATCCGATCATAAAAGAATGCATCAGAAAGCCAAGCCCC | GCCCCTGC | TGGGAG | SGKPYPIKRGVLQGD |
| | | | | TGGAAAGCACCAGGCCCTGACGGGATATACAACTATTACTGGCAGCAA | TGGACCAA | TACCAG | SLSPALFVLTTSPIVAH |
| | | | | GAGTTTGTGGCTCAGTGGATCCAAACCCTTGTGAAGAGAACCCTGGATA | ACCAAATC | CGTGGG | LQRTCPTGRIQLYMD |
| | | | | TAGGGCGGTTCCCGACTGCACTTATGTGTGGGAGGACGGTACTACTCTT | ATCCACAA | GCGGAG | DIKLYGKTESDLCMLI |
| | | | | CAAAAGCGGTGACAAATCTATGCCTCAGAACTATCGACCCATTACATGC | ATTGGAGG | AGCGTA | KETQRVANKLGLNIN |
| | | | | CTGAATGGATGCTTTAAGATTACCAATGCGGTATTGACGAAAGTAATCC | GTTTTCTT | CCTGGG | LKKCALFGKSIKQSIA |
| | | | | TTCAACGGGTTCAAGACACTTGCGCTCTTCCCAGAGAACAAATGGCTTT | GGTAGTTT | TACACT | GFDPLGDRTYKYLGIP |
| | | | | GAAACCAAAGGTGTGGTCGTGCATGGAAGCGCAGTTGCGCGACCAGGC | CCCTTGGC | GCATAA | QRDVADIKQAYDELK |
| | | | | ACTTCAGTCTGAGATCGGTGACGATTGTAAGACTGCATGGATCGATTTT | ACGTCTTG | TCGGGT | AKTVQTIGETMACDY |
| | | | | TCCAAAGCATACGATAGTCTGGACCACGACGCCTTAAGATTTGTAATCC | TTTCATAA | CTCAGA | LTTRQVINRLNSKIPP |
| | | | | AAACGATTGCACTGCCGGCAGGGATGGAAGAGTACCTTCTGAAATCCCT | GCCAGAAT | AAACCA | VVRFVTQSALCSAPM |
| | | | | GGATAGTTGGAGAACGCAACTTGTGCTATCTGATGCAGGTAAGGTTGTC | AAAAACGA | CCTATG | TRGLYNKITELDNVSR |
| | | | | TCCGGAAAGCCCTACCCAATTAAAAGGGGAGTGCTCCAAGGAGACAGT | TACCATAC | GTTTATT | AELRKVLIYKATNVSR |
| | | | | CTGAGTCCCGCGCTATTCGTCTTAACGACGAGCCCAATTGTCGCTCACCT | AGACATGA | ATTCTGT | FYLATKEGGFGYASL |
| | | | | TCAGAGAACTTGTCCCACGGGTCGTATACAGTTGTATATGGATGATATT | GGCTGGG | CTCCCAT | QQVFVEAVVSRAIYC |
| | | | | AAACTCTATGGCAAGACAGAGTCGGACCTGTGTATGTTAATAAAAGAAA | TACCTGCC | CTGCAG | LRAPSLCDIREFILSKF |
| | | | | CTCAACGAGTCGCAAACAAATTGGGCTTAAACATTAATTTGAAAAAATG | AGCCGCGA | GGTAGC | DPVKVARIALARSKID |
| | | | | TGCCCTCTTTGGTAAAAGTATAAAACAGAGTATTGCCGGGTTTGACCCG | CACGGAAA | TTTTCGT | MDIERMDMASATRT |
| | | | | CTCGGCGACAGAACATACAAATATCTCGGCATTCCCCAAAGGGATGTTG | ACCGGTAG | TGGGCC | IRQHYQAKWKTLFQ |
| | | | | CAGATATCAAACAGGCATATGACGAACTCAAAGCTAAAACGGTGCAGA | GTGCAACC | ATAGGA | QSKLYQKWVQHKIDI |
| | | | | CCATCGGCGAAACGATGGCGTGTGACTATCTAACAACAAGGCAAGTTAT | GGAGACA | GCCTAG | PNSSRWLQRGEISPR |
| | | | | CAACAGATTAAATTCGAAGATACCGCCTGTAGTCAGATTTGTCACACAAT | GCTAGGG | GGGCAA | NCRIAVAVQDNTLLC |
| | | | | CTGCGCTGTGCAGCGCGCCTATGACCAGAGGATTATATAATAAAATCAC | GAAAGAA | GAGTGC | RGFVGSKDPNKQCRL |
| | | | | GGAATTGGATAACGTGAGTAGAGCAGAGTTAAGGAAAGTTCTTATCTAT | AATAGTAA | ATGTAG | CNAGIETASHIVTECS |
| | | | | AAAGCGACCAATGTCTCTCGGTTCTACCTGGCCACGAAAGAAGGGGGA | AGTGTCGA | TCTTCAA | THRVHMYIERHDSV |
| | | | | TTCGGCTATGCAAGCCTGCAGCAGGTATTTGTTGAAGCTGTTGTGAGTA | AAACAAAA | CGGCCA | ARNIYAVLAKNCGF |
| | | | | GAGCGATCTACTGCCTGAGAGCTCCCAGTCTGTGTGACATACGGGAGTT | CAGGTAGC | TGCCAG | WIPHYSQKIPTVKITK |
| | | | | CATATTGAGTAAGTTCGACCCTGTCAAGGTTGCTCGCATTGCGTTGGCA | CCCTGGCT | GGAAAC | SYELYWNYKFPCTQA |
| | | | | AGGAGTAAAATTGACATGGACATCGAACGGATGGACATGGCCTCGGCC | AGAGGGA | TTGTGA | LEACRPDIVLIDRAKK |
| | | | | ACGCGTACCATCAGACAACATTATCAGGCAAAGTGGAAAACTCTGTTCC | ATGGGACA | GAGGTG | RILVVEVAVSYVTRLE |
| | | | | AACAATCGAAACTTTACCAAAAGTGGGTGCAGCATAAGATCGATATACC | TTGTCCGA | AGGGAT | QMTQRKLYKYGVNG |
| | | | | CAACTCGAGTAGGTGGTTGCAGAGGGGGGAAATCTCGCCGCGAAACTG | TTAGGTTG | AACTAG | EYQADGETRGWNIC |
| | | | | TCGAATCGCGGTAGCTGTTCAAGATAACACTTTACTGTGCAGAGGATTT | CCTTGACC | CATCAG | RELVQKYNMRIDLCI |
| | | | | GTGGGGAGTAAGGACCCAAACAAACAATGTCGGCTATGCAATGCTGGC | CAATGAAA | ATAATAT | VVIGACGEILPCMVK |
| | | | | ATTGAGACCGCTAGTCACATCGTGACTGAATGTAGTACACACCGGGTTC | GCCAACCG | CAGTCA | EIEKISKVSGRQLLERC |
| | | | | ACATGTATATCGAACGTCACGACTCTGTGGCGCGAAATATATATGCTGT | GGTTTACA | TGAAAT | QRSAVLGTVRTVRRH |
| | | | | CCTGGCAAAAAATTGCGGTTTTTGGATTCCTCATTACTCACAGAAAATCC | TTATCGGT | TAGTAA | LAN (SEQ ID NO: |
| | | | | CAACAGTAAAGATTACGAAGTCATATGAGTTGTATTGGAATTACAAGTT | CTACCAAG | CAACCA | 1500) |
| | | | | CCCGTGCACGCAAGCACTGGAGGCTTGTCGTCCCGATATCGTTCTCATT | GGCAATGA | ACGTTC | |
| | | | | GACAGAGCGAAGAAAAGAATCCTCGTGGTGGAAGTGGCGGTCTCGTAT | CCAGAGAA | ACCGTC | |
| | | | | GTCACACGGCTAGAGCAGATGACGCAGAGGAAACTCTATAAATACGGG | ACTGCGAC | GTTGGC | |
| | | | | GTGAACGGCGAGTACCAGGCTGACGGGGAAACCCGTGGCTGGAACATT | TATGCCGT | AAAACA | |
| | | | | TGTCGTGAACTTGTACAAAAGTACAATATGAGAATTGATCTCTGCATAG | AACCCTTC | CCGACT | |
| | | | | TCGTAATTGGGGCATGTGGAGAAATACTCCCTTGCATGGTTAAAGAAAT | GCAGATTG | AACGAT | |
| | | | | TGAAAAAATATCCAAGGTCTCTGGTCGGCAGCTCCTAGAACGGTGCCAG | CCGATGAG | GCTAGT | |
| | | | | CGTAGCGCTGTACTTGGAACTGTGCGGACCGTAAGGAGACACTTGGCA | AACCATCG | TAGAAA | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AACTAACAAGTGTAATAAAAACCACCCATGCGTAGTAAACCGATCAATT | ATCGTAAG | GAGTCG | |
| | | | | ATCTAGCAAAATCGCAGGTCAGAAGACCAAAGAACCGACCCAGAGGAA | TCGAAGCC | GGTCTT | |
| | | | | TAGGACCAGAGCTGAAACTCTCAGATACGCCAACGGTCCTAATAAAACG | AAGCGGAT | CCCAAA | |
| | | | | TCGTTAAGTAAAGCATCGTTAAGTACAAAACAAAAGCACTGTAAACGCG | TGACCAGT | GTTAGG | |
| | | | | AGGCCCCCTCTTTGCCAAACTCCGGTAATCCTCGTAGTACGGTGCTTTTT | GGAGGGT | TGCTTG | |
| | | | | CCCGCTTCACGAATCAGAACGCTGCCAGATCTTGTCCGACATGGGCCGT | TATCCCGA | CACCGA | |
| | | | | AGGGTTTGGGAGTACCAGCGTGGGGCGGAGAGCGTACCTGGGTACACT | CAACAGC | AGCCGA | |
| | | | | GCATAATCGGGTCTCAGAAAACCACCTATGGTTTATTATTCTGTCTCCCA | (SEQ ID | TCCGCTC | |
| | | | | TCTGCAGGGTAGCTTTTCGTTGGGCCATAGGAGCCTAGGGGCAAGAGT | NO: 1255) | TACCCAC | |
| | | | | GCATGTAGTCTTCAACGGCCATGCCAGGGAAACTTGTGAGAGGTGAGG | | AGCTCT | |
| | | | | GATAACTAGCATCAGATAATATCAGTCATGAAATTAGTAACAACCAACG | | GCCCAG | |
| | | | | TTCACCGTCGTTGGCAAAACACCGACTAACGATGCTAGTTAGAAAGAGT | | CGTT | |
| | | | | CGGGTCTTCCCAAAGTTAGGTGCTTGCACCGAAGCCGATCCGCTCTACC | | (SEQ ID | |
| | | | | CACAGCTCTGCCCAGCGTT (SEQ ID NO: 1132) | | NO: | |
| | | | | | | 1378) | |
| R4 | R4-2_HG | ABLA01000389 | *Heterodera glycines* | TGTGGCGATACTCGGAACCTCCGGGGAGCCTGGTAGGAGTTGGCCTAC | TGTGGCGA | TAGTCG | MRKSFLQHIPELSSHI |
| | | | | AGGTCGCGAAAGTCCCTAGGTGCTGCACGGGTTGCGCTAATCCGAGCC | TACTCGGA | TAGCCC | AMSVPARNYPKMCS |
| | | | | CCTTCCGGTGTTGGCTAGCACTGGAGGGGGGGGGTCCAAAGAATACG | ACCTCCGG | AGATGT | LAQGSSGTLSHNGKG |
| | | | | TGAAGCGGACCCTGTGTTTTCTCTGACCTCATACGGGTATATCCCGATGA | GGAGCCTG | CGACAG | VAMHRCPSDDCAGK |
| | | | | TATCTATACAGTGTTCATTTTCATTTCTTAACCTGCTTTTTCCTCAAGAGA | GTAGGAGT | CCCCTAC | DPPQRGSQKGNLRS |
| | | | | AATATGACCACATTCGTTTGCCATTTCGAAGGTGCGACTTTTGAGGGAG | TGGCCTAC | ACCGGT | VRWTPSEEKAVFEY |
| | | | | TTCTCAGGGACATCAAGCTGTTCATGGACGGCTTGACGGCTCGTGGCGG | AGGTCGCG | AGATGG | WSRLEQHAMLNGSE |
| | | | | CACGCAGCCGCGCGGGCCAGTTAGGGCTGGTGCCAATGAGGCAGCGA | AAAGTCCC | AAGGAG | ARGTCAITRSQFLIH |
| | | | | AGAAGTCTCTGAAACGCCAAAAGCAGCGGGAGAAGAGAGAGAAAGCG | TAGGTGCT | GTATGT | WDGERESRSLSDGV |
| | | | | GGGACGGGTTAGAGATAATAGCATGATTGACGGCGAAGCAATACTTTG | GCACGGGT | ATCTAA | PEYPMRTERAYYERV |
| | | | | ACTTCCAGGTACGGAGGACGGCGGCAAAAAGCAAAAAGGGGACGAAA | TGCGCTAA | GCCCAC | RLLRQRGWQWDCA |
| | | | | CCGATGGCATTGCCAAAGGGGCCGAAACCATTGAGCTGGACGCTGATG | TCCGAGCC | GGCAAG | NECLVIGQCAEPCRK |
| | | | | GGCCGTCTGCCGCGCAAAAGGAGGGGGGAGCCCCTCCGTCTGGGAAG | CCTTCCGG | CCACCA | PNVVAIKADKGMKR |
| | | | | AAGGTGCGGCGCCATTCGTCCAACAAACCGGAATAGATCTTGATGATCT | TGTTGGCT | GTGGAA | SLVKGKLLSLPHVMG |
| | | | | CAGCAATTGATCATATTGATCTCTTTTTCCAGTTGTTGCGATAAATTATCG | AGCACTGG | ACGGTG | EINQVSVQVEVPLPS |
| | | | | TGCATTATTTCTTCGATTTCTCCAAAGCTTAACTCCTTTCCTAATACCTACT | AGGGGGG | ACCACCT | VPASVPQVEGVESKG |
| | | | | CATGTATACGTTAGTAGGCATGTTTTATGCAGGTAAAGATAGACCTGGT | GGGGTCCA | CTGTTC | FTETEPSNKPSLEGNP |
| | | | | GCCCCCGGGCGACTTGGGATGTGGATGATGGTTGGCGGAGAGTTCTGA | AAGAATAC | GCGGAA | AEEGLRKPERVNVPV |
| | | | | TGACGCCGTAGTTCCGGAGGAACAGTTCCTACTAGTGCCAGCCTGGGCT | GTGAAGC | ATGCCC | HGIISDSERKDLKDRF |
| | | | | AGTGGAGCTGGTCTGGCGAGTGCTTTGCTCGTCAGATAAGGGGTGGTT | GGACCCTG | CGTAGA | WSAYKTAKRSVGFRP |
| | | | | GGGGTGGTACCTCTGGAATGATGTGTCGGATAAGCACTCTGCCTTATAA | TGTTTTCTC | GTATAT | ALKIEPNRVNRAQW |
| | | | | AGCTGTCGTTCTGCCCAGGTTTCTCCTAACCAGGTTGAACTTGTAATGAG | TGACCTCA | GAAGGT | EVLDSCVVEVLKKRET |
| | | | | CCTTTGGGTATCTGGTCGGGGTCTGCGCGGAGATAGCTCGTGAGGAGC | TACGGGTA | CGGAGC | SNGYRGCVLRHLNV |
| | | | | TGTTATTACATTATTGGTTGAACGCTTTTGGGTCGTACTGCACAGATAAA | TATCCCGA | ATTGAA | AVYAAGYVLAEGNKE |
| | | | | TATGAGAAAAAGTTTTTTACAACATATACCTGAGCTTTCAAGTCATATTG | TGATATCT | GCACAA | RRQVIRRQSAEWLLR |
| | | | | CTATGTCTGTGCCTGCGAGAAATTATCCCAAAATGTGCTCTTTAGCACAG | ATACAGTG | GTGAGA | QKSEINNIRRHIGWIT |
| | | | | GGTTCTTCCGGCACATTAAGTCATAATGGGAAGGGTGTCGCAATGCACC | TTCATTTTC | ACCCTG | DELTRRRTGKNPTSR |
| | | | | GGTGCCCCAGCGATGATTGTGCTGGTAAAGATCCCCCTCAGCGGGGGT | ATTTCTTA | GAAGTA | QLSNFAWLQRRYQV |
| | | | | CTCAAAAAGGGAATTTGAGGAGTGTGCGATGGACTCCCAGCGAGGAGA | ACCTGCTT | TGGTGG | LGKPVRETRDLEVQR |
| | | | | AAGCTGTCTTCGAGTATTGGTCACGGTTGGAACAGCATGCCATGTTAAA | TTTCCTCA | TGAGCT | ERLVSRLRLAQDRINS |
| | | | | TGGTAGCGAAGCCCGGGGGACCTGTGCCATAACTAGAAGTCAGTTTCTC | AGAGAAAT | GGTAAC | SMDREERVRKRMLP |
| | | | | ATTCATTGGGATGGCGAGAGAGAGTCAAGATCCTTGTCGGATGGTGTG | ATGACCAC | CTCGAA | LRRKLEEPLGDSKLDT |
| | | | | CCCGAGTACCCAATGAGGACGGAAAGGGCGTACTATGAAAGGGTCCGA | ATTCGTTT | TTCCTCC | KQARTFWASLIGERK |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTCTTGCGACAACGCGGATGGCAATGGGATTGTGCTAATGAATGCTTAG | GCCATTTC | TATGGG | EFGKIPELENWAEEV |
| | | | | TAATTGGCCAATGTGCAGAGCCATGCCGTAAGCCAAACGTGGTAGCGA | GAAGGTG | TGCTTG | RSKVTDGQGFASDH |
| | | | | TTAAGGCTGATAAGGGTATGAAGAGATCGCTGGTTAAGGGAAAGCTTT | CGACTTTT | CGCCCG | VDQTVWKKILGKAR |
| | | | | TGTCCCTGCCCCATGTAATGGGCGAAATAAACCAAGTGAGCGTGCAGGT | GAGGGAG | TAGGTC | PLKAPGPDGIPNLLW |
| | | | | TGAGGTGCCTTTGCCAAGTGTACCCGCCAGCGTGCCCCAGGTGGAAGG | TTCTCAGG | ATTTGTG | KRLPSANQALFKWL |
| | | | | AGTTGAAAGCAAAGGTTTTACTGAAACGGAACCGTCGAATAAACCTTCC | GACATCAA | TATGTA | MGIKRKQLSVPSWLT |
| | | | | CTGGAAGGGAATCCGGCGGAAGAAGGATTAAGGAAACCGGAGCGAGT | GCTGTTCA | GGGATG | KGRVVLLPKGGDPVD |
| | | | | AAACGTACCTGTTCATGGGATAATCAGTGATAGTGAACGGAAAGACCTG | TGGACGGC | GAAGGA | PANYRPIACLNTQYK |
| | | | | AAAGACCGGTTTTGGAGCGCCTATAAAACGGCCAAGAGGTCTGTGGGT | TTGACGGC | ATCTCG | LVTGMVTAWVSEHL |
| | | | | TTTAGACCGGCTCTAAAAATCGAACCGAATAGGGTTAACCGTGCCCAGT | TCGTGGCG | ATAGCG | TTYSILPIEQRAMVSG |
| | | | | GGGAAGTACTGGATTCCTGCGTTGTTGAGGTGCTCAAAAAGAGGGAAA | GCACGCAG | CAAATC | TWGCTHAMVIDRAI |
| | | | | CCTCCAATGGGTACCGCGGTTGCGTCCTCCGGCATTTGAACGTTGCAGT | CCGCGCGG | GGGATA | TSYAEATGLPLYVGFV |
| | | | | TTATGCGGCGGGATACGTGCTGGCGGAAGGCAACAAGGAAAGGAGGC | GCCAGTTA | CCGCAC | DFAKAFDSVSQPWIR |
| | | | | AGGTGATCAGACGCCAGTCGGCGGAATGGTTGCTTCGCCAAAAGTCCG | GGGCTGG | TGGCGA | YALKVAGVHKRIRCLI |
| | | | | AAATCAACAACATCCGTAGACACATCGGGTGGATTACCGATGAGTTAAC | TGCCAATG | TCATGCT | GILMKCWSVRYEVFK |
| | | | | ACGGAGGAGGACGGGAAAGAACCCAACATCCAGACAGTTGAGTAATTT | AGGCAGC | GCCAGT | SGRVLRSAPLAVKNG |
| | | | | TGCATGGTTGCAAAGGCGATACCAGGTTTTGGGTAAACCCGTGAGGGA | GAAGAAG | GGGCCC | VLQGDTLSPLLFCLSV |
| | | | | AACCCGGGACTTGGAAGTCCAACGAGAAAGACTTGTAAGTCGTCTTCGA | TCTCTGAA | TGCTGA | AVVSSAVGSLFDFEV |
| | | | | TTGGCTCAGGACCGAATTAACTCTTCCATGGATCGTGAAGAGCGAGTTC | ACGCCAAA | GTTGGG | TIPGRGVMQQQNHL |
| | | | | GTAAACGAATGTTACCCCTGCGGAGAAAGTTGGAAGAACCTTTGGGTG | AGCAGCG | CGGGTT | FYMDDFKGFAPSEAS |
| | | | | ACTCTAAACTTGACACAAAGCAGGCACGAACATTTTGGGCCAGCCTGAT | GGAGAAG | AGCAAC | LTRMLVTLERTASAL |
| | | | | TGGAGAGCGAAAGGAATTTGGAAAAATCCCGGAGCTTGAAAACTGGGC | AGAGAGA | CCGTCC | GLKINKRKCALVHPR |
| | | | | CGAAGAAGTGAGGAGCAAAGTCACCGATGGACAAGGTTTCGCAAGTGA | AAGCGGG | AGGGAC | ERENEETGSDIPVLGL |
| | | | | CCATGTGGATCAAACTGTTTGGAAAAAGATACTGGGTAAGGCCAGGCC | GACGGGTT | GCAGAT | RDTYKYLGIEERFGIV |
| | | | | ACTGAAGGCGCCCGGACCAGATGGAATCCCCAATTTACTTTGGAAACGG | AGAGATAA | GCCAAA | FEDAWDRVRTKMFE |
| | | | | TTACCATCCGCAAACCAGGCGTTATTTAAGTGGTTAATGGGGATCAAGC | TAGCATGA | AGCCTG | RMRTLLCTEHTFGEL |
| | | | | GGAAACAGCTCAGTGTCCCCAGTTGGCTCACAAAAGGAAGGGTGGTCC | TTGACGGC | GTGACA | RAAFASTIAPVARYLF |
| | | | | TCCTACCCAAAGGAGGTGACCCGGTAGACCCGGCCAACTACCGACCAAT | GAAGCAAT | CTCTAAA | LNVIVGGPSWSETLT |
| | | | | CGCTTGTTTGAACACGCAGTACAAACTAGTGACTGGTATGGTGACGGCA | ACTTTGAC | GGGAGT | KAKDMDLRIRRLLWE |
| | | | | TGGGTATCGGAACACCTGACCACATACTCTATTTTGCCGATTGAACAAC | TTCCAGGT | CTACGG | RRDNEPGWRFKHCS |
| | | | | GAGCGATGGTGTCTGGCACTTGGGGGTGTACCCATGCTATGGTGATTG | ACGGAGG | CGACGA | ADRLYLRVQYGGLGF |
| | | | | ACAGAGCAATTACGTCTTATGCAGAGGCCACTGGACTACCGCTTTATGT | ACGGCGG | GAACAT | VSVEDTLSESIIYCWA |
| | | | | AGGCTTTGTGGACTTTGCGAAGGCTTTCGACTCAGTTAGTCAACCGTGG | CAAAAAGC | CCCCTAA | YVQCRPELELARELFG |
| | | | | ATCAGGTACGCTCTAAAGGTCGCTGGAGTTCACAAGCGAATCCGATGTC | AAAAAGG | GTC | TLNRSARSGIKQSIAK |
| | | | | TTATTGGAATCCTTATGAAATGTTGGAGCGTAAGGTATGAAGTGTTCAA | GGACGAA | (SEQ ID | GARKVFRSYALLSKNS |
| | | | | GAGCGGGAGAGTGTTAAGGAGTGCGCCTTTGGCAGTTAAGAACGGAGT | ACCGATGG | NO: | AQRVSDLDGDASPG |
| | | | | GTTACAAGGAGACACGTTGAGCCCGCTGCTCTTTTGTCTCTCAGTAGCC | CATTGCCA | 1379) | FRVGEMIFMEPTRG |
| | | | | GTTGTTTCTTCTGCAGTAGGCAGCCTCTTTGATTTTGAGGTCACCATACC | AAGGGGC | | ARAIVKILRKENDSRR |
| | | | | TGGACGAGGAGTGATGCAGCAGCAGAACCACTTGTTCTATATGGATGA | CGAAACCA | | LAAWKGRPMGGRV |
| | | | | CTTTAAAGGGTTTGCTCCTAGTGAAGCGTCCTTGACTAGGATGTTAGTA | TTGAGCTG | | VSLPELDQVHSYHWL |
| | | | | ACATTGGAGCGAACCGCTTCAGCCCTCGGGTTGAAAATCAATAAGAGG | GACGCTGA | | IRARIGRRSFRDCIAA |
| | | | | AAATGCGCTCTGGTACACCCCCGTGAAAGAGAGAACGAGGAAACTGGA | TGGGCCGT | | QEGQLKARELMCPHI |
| | | | | AGTGATATCCCGGTCCTTGGTCTACGAGACACTTATAAATACCTTGGAAT | CTGCCGCG | | NAKAKWCRRCGDG |
| | | | | CGAAGAGAGATTTGGTATCGTTTTCGAGGATGCGTGGGACCGAGTCCG | CAAAAGG | | RVETEQHILSGCAWS |
| | | | | TACCAAGATGTTTGAGAGAATGCGCACCTTGCTATGCACGGAACATACC | AGGGGGG | | RTGTMLDRHNGVVR |
| | | | | TTCGGGGAGTTGCGTGCGGCCTTCGCTAGTACGATCGCCCCAGTAGCGA | AGCCCCTC | | QVHTALCRKYGLPVS |
| | | | | GGTACCTCTTTCTCAATGTAATCGTTGGTGGGCCTAGTTGGAGTGAAAC | CGTCTGGG | | SHVVPLHAVIENEHA |
| | | | | CCTGACGAAAGCTAAGGACATGGACCTGCGTATCCGACGCCTCCTGTGG | AAGAAGG | | KILYDVALHTSPAGVL |
| | | | | GAAAGAAGAGATAACGAGCCGGGATGGCGGTTTAAGCATTGTAGTGCT | TGCGGCGC | | PREDGSTSYTGLRSTR |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | GACCGCTTGTACCTCCGCGTACAGTACGGTGGACTTGGCTTCGTGTCCG | CATTCGTC | | PDMVIFDKKARTILIV |
| | | | | TAGAGGACACTTTGTCTGAGTCTATCATTTACTGTTGGGCTTACGTGCAA | CAACAAAC | | EISVPWRENLVKQELI |
| | | | | TGTAGGCCCGAGTTGGAGCTGGCTCGTGAACTTTTTGGAACCTTAAACA | CGGAATAG | | KWRKYAINSMIEPLE |
| | | | | GGAGTGCTAGAAGCGGTATAAAACAGAGCATTGCGAAAGGAGCGCGT | ATCTTGAT | | LAEAEIPGPNLKHAL |
| | | | | AAAGTGTTCCGAAGTTATGCCCTTCTCTCGAAAAATTCCGCCCAGCGAGT | GATCTCAG | | GLAYGTSFPTVKVVPI |
| | | | | ATCTGACCTTGATGGGGATGCCTCCCCAGGATTCCGAGTAGGGGAAAT | CAATTGAT | | VVGSCGEVLPNITKRL |
| | | | | GATATTCATGGAACCAACTCGGGGTGCCAGAGCAATCGTAAAAATCCTC | CATATTGA | | SELGIPKRGIPSLLESI |
| | | | | CGTAAGGAGAATGATTCGCGACGCTTGGCTGCCTGGAAAGGTAGACCT | TCTCTTTTT | | QRAAIIGSGHVIRAHL |
| | | | | ATGGGAGGTCGGGTCGTGTCATTGCCAGAGCTCGACCAGGTTCATAGCT | CCAGTTGT | | SVPRSESET (SEQ ID |
| | | | | ACCACTGGTTGATCCGTGCGAGGATTGGCAGGCGTTCGTTCCGAGACTG | TGCGATAA | | NO: 1501) |
| | | | | CATTGCAGCACAGGAGGGACAGTTGAAAGCGCGGGAGCTTATGTGTCC | ATTATCGT | | |
| | | | | ACATATAAATGCGAAAGCAAAGTGGTGCCGACGATGTGGGGACGGTCG | GCATTATT | | |
| | | | | TGTTGAAACCGAGCAGCATATCCTTAGTGGTTGTGCTTGGTCACGGACT | TCTTCGAT | | |
| | | | | GGAACTATGTTAGATCGACATAACGGTGTTGTACGGCAAGTACACACG | TTCTCCAA | | |
| | | | | GCTTTATGCAGGAAATATGGACTGCCCGTTTCTTCTCATGTCGTTCCTTT | AGCTTAAC | | |
| | | | | GCATGCGGTAATCGAGAATGAACATGCCAAAATCCTGTACGATGTCGCG | TCCTTTCCT | | |
| | | | | TTGCATACTTCGCCTGCTGGCGTCCTCCCTAGGGAGGATGGGAGTACGA | AATACCTA | | |
| | | | | GTTATACGGGTCTGCGTAGCACCAGGCCCGATATGGTAATATTCGATAA | CTCATGTA | | |
| | | | | AAAAGCACGTACGATCCTTATTGTGGAAATTTCGGTGCCATGGAGAGAG | TACGTTAG | | |
| | | | | AACCTGGTTAAACAGGAGCTCATAAAGTGGCGGAAATATGCCATAAATT | TAGGCATG | | |
| | | | | CTATGATCGAACCATTGGAACTAGCGGAAGCTGAAATACCGGGACCTAA | TTTTATGC | | |
| | | | | CCTGAAACATGCGTTAGGCCTTGCGTACGGTACGAGTTTCCCAACAGTG | AGGTAAA | | |
| | | | | AAGGTGGTCCCGATAGTAGTTGGGTCGTGCGGCGAGGTATTACCAAAT | GATAGACC | | |
| | | | | ATAACGAAGAGGCTGAGTGAACTTGGGATACCTAAACGAGGAATCCCG | TGGTGCCC | | |
| | | | | AGTTTGCTTGAGTCGATACAGCGTGCTGCGATAATTGGTTCTGGACATG | CCGGGCG | | |
| | | | | TTATCCGGGCGCACTTGAGTGTACCTAGGAGCGAGTCCGAGACTTAGTC | ACTTGGGA | | |
| | | | | GTAGCCCAGATGTCGACAGCCCCTACACCGGTAGATGGAAGGAGGTAT | TGTGGATG | | |
| | | | | GTATCTAAGCCCACGGCAAGCCACCAGTGGAAACGGTGACCACCTCTGT | ATGGTTGG | | |
| | | | | TCGCGGAAATGCCCCGTAGAGTATATGAAGGTCGGAGCATTGAAGCAC | CGGAGAG | | |
| | | | | AAGTGAGAACCCTGGAAGTATGGTGGTGAGCTGGTAACCTCGAATTCCT | TTCTGATG | | |
| | | | | CCTATGGGTGCTTGCGCCCGTAGGTCATTTGTGTATGTAGGGATGGAAG | ACGCCGTA | | |
| | | | | GAATCTCGATAGCGCAAATCGGGATACCGCACTGGCGATCATGCTGCCA | GTTCCGGA | | |
| | | | | GTGGGCCCTGCTGAGTTGGGCGGGTTAGCAACCCGTCCAGGGACGCAG | GGAACAGT | | |
| | | | | ATGCCAAAAGCCTGGTGACACTCTAAAGGGAGTCTACGGCGACGAGAA | TCCTACTA | | |
| | | | | CATCCCCTAAGTC (SEQ ID NO: 1133) | GTGCCAGC | | |
| | | | | | CTGGGCTA | | |
| | | | | | GTGGAGCT | | |
| | | | | | GGTCTGGC | | |
| | | | | | GAGTGCTT | | |
| | | | | | TGCTCGTC | | |
| | | | | | AGATAAG | | |
| | | | | | GGGTGGTT | | |
| | | | | | GGGGTGG | | |
| | | | | | TACCTCTG | | |
| | | | | | GAATGATG | | |
| | | | | | TGTCGGAT | | |
| | | | | | AAGCACTC | | |
| | | | | | TGCCTTAT | | |
| | | | | | AAAGCTGT | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | CGTTCTGC CCAGGTTT CTCCTAAC CAGGTTGA ACTTGTAA TGAGCCTT TGGGTATC TGGTCGG GGTCTGCG CGGAGATA GCTCGTGA GGAGCTGT TATTACAT TATTGGTT GAACGCTT TTGGGTCG TACTGCAC AGATAAAT (SEQ ID NO: 1256) | | |
| R4 | R4-2_SRa | CACX01002006 | *Strongyloides ratti* | CGTCAGAAGAGCAGGTGTTTTTCAAAGCAAAGACTTATTCTACGAAGGG GAAAGATGATCAAACATGCAGATTTGGCTGCAATGAAATAGAATCAAAC TACCATGTGGTGACATCTTGCAAATACCATTCATACACAAGAAGACACG ATATGGTTGTGTACAATATATTAAAAGACTAAAAGAAAAGTATAAGTT AGATGGTGATTTACAATATGGTAGATCAGTATTTAATGGGAAGAAGGA AAAAATTAGGATCAGATCTGGCCATAAGTTTTTGACTGAACAACCGTTA GTAAACAATAAACCGGATATTGTTATAACGATGAAAGAAGGGAAAAAA AAGATAACGTACATACTAGAGATGTCGATACCACATATCTAGAACTTGA AGATGCAAGAAAGAATAAAGTATAAAAAATATTGTGTGAGCTCCATGGT AAAAATAACGAATGATAATGTTGATTCGATAGCTCGTGATTTTAATCTAC TAAATTTAATGGAAAGAAAAGAAAGGTGTAAGATAAAGTTTGGATCATT TGTATTTGGCTGTTATGGAGAATATGTCTTGACTGAATCTGCTCTAAGAA CACAGAAAATCCTGATTGAATTGGGATTCTCCAAAAAAGAGATGGATAG CTTGATCAAAGAGTGTTCTTACAGTTAAATGAATGAGACAGCAAGAATT ATTATGAAACATCTAGAAGGCGAAAAGAATCAAGATGAAATCAGCCATT AATAACTTTTATTTACCCAATTATTTATTGCGTTAACTTGATTATATGATA TTTATTGTATATTTATTGTTTAATTTAGTTTCATAGTACAAATAAAAGAAT ATACTACGATTCTTTACTTTTAAGTTCTACGAGAACGTTGTTTTAGAATAT TTTAATAATATTTCTACTACAATTAAGTAATTAGAAGAAATCAACGAAAG CAGCTAAACTTACTCGCAAAATTCGTTGATCGAGGCTGGAATGGCACCA ACTAATATACTAACCAACAATAGAAAAAAAAAGAAGAACTTCAGTGGAC TTCAAATAAAATAAAATTATTGGTAGAATTGTATGATAAAACTGAGAAA ATTTGACTAAAACAAAAAGATTAGAGCAAATATGTCATCATTTTCCTAAT CATACAATTAAAGCGATGATGACGAAATTGAGAGAATTTGAAAGAGAA AAAAGGGAAAATTGTGAAATTAAAATGAGGGAAAATGAGGAAAAACCT GAGGAAAAATTAAATTTTGACAACTATGAAGAAGCAAAATTGAAAAGA GGAATTAAGTGTAAAAAAGAAGTAAAACCAATTGTTATTGAAAACAAG GATTAGGAATTTTTGAAAACGGAAAAATTATTTCTCAAGTTTGTCAACAC | CGTCAGAA GAGCAGG TGTTTTTC AAAGCAAA GACTTATT CTACGAAG GGGAAAG ATGATCAA ACATGCAG ATTTGGCT GCAATGAA ATAGAATC AAACTACC ATGTGGTG ACATCTTG CAAATACC ATTCATAC ACAAGAA GACACGAT ATGGTTGT GTACAATA TATTAAAA AGACTAAA AGAAAAGT ATAAGTTA GATGGTGA TTTACAAT ATGGTAGA | TAATTA GATTTAT ATGTGC CACTTTA CCTCAA AGATAT ATTAATA CTAACTT AATTATA ATTTATT ATGAAT TATAATA TAATAA GTTTTAA AATAAA A (SEQ ID NO: 1380) | MQKFSVPKDSSQIFL VDSILNKHICSTKNKV KDVIKRRSIIKTLICAA GLTLRKLVCGKLGNN KYNSKINQLWKKERK IINCIEDLKHLIETNKR RHNFGKRLRNAKVSP SEMLKDYYNKLRYIK NEITACLDEHKKAILR TKFKLTPSIKIISNIQN HNDEEAELPKEEEFV KYYKELFTNKDGDDK ETPHLDNWLKKFSKT LIVDWTINDKEILEAL KYCGNFKAPGSDMV MKVCYKWFKSAQNY LIRWIKSTWYGEYTIN KKDTNAVTFMIWKR DGKPKNDVKSYRPIS CLNCDFKLLNKLIANK IYESIEKILPINQMAVI KNKHGTCEALLLYKSL VQSMKFRRTKDVKEI WCSWIDFSKCYDSIS HKCLKKMIQSIKAPPII HKLILDGIDSWNISIC NGKNISKTKIPVKSGI LQGKVASSLYFVLLTG |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AATCAATTACCAAAGAAAGAAGGGTAAATCAACCAGAATGCAAAAATTT | TCAGTATT | | EISYALNKEEQVPIETI |
| | | | | AGTGTTCCAAAGGACTCTTCTCAAATATTCTTAGTGGATAGTATCCTAAA | TAATGGGA | | TPSNTLKINHISFIDDY |
| | | | | CAAACATATTTGCTCAACCAAAAACAAAGTTAAGGATGTCATTAAGAGG | AGAAGGA | | QLYATSQKKVEKLTIK |
| | | | | AGAAGTATTATTAAGACATTAATATGTGCAGCTGGTTTAACTCTTAGAAA | AAAAATTA | | LREIAEEMNLKLNPQ |
| | | | | GTTAGTTTGTGGGAAACTTGGAAATAATAAATATAATTCCAAGATAAAT | GGATCAGA | | KCGIYGTDDLGKRLM |
| | | | | CAACTTTGGAAAAAAGAAAGGAAAATTATTAATTGTATAGAAGATTTAA | TCTGGCCA | | LKESSLNFPYTSEYKYL |
| | | | | AGCATTTGATAGAAACGAATAAACGTAGGCACAATTTTGGGAAAAGATT | TAAGTTTT | | GLVENSLDLKDINIQL |
| | | | | AAGGAACGCCAAAGTGAGCCCTTCTGAGATGTTGAAGGATTACTACAAC | TGACTGAA | | FKDKILSKYSTIFESRL |
| | | | | AAGTTAAGATATATTAAAAATGAAATTACGGCATGCTTGGATGAACACA | CAACCGTT | | TTHQKRKVFNSTISPC |
| | | | | AAAAAGCAATTTTAAGAACAAAATTTAAACTAACACCAAGCATTAAGAT | AGTAAACA | | AAYYLGNLITNKCSIQ |
| | | | | CATCTCAAATATTCAAAATCATAATGATGAAGAGGCTGAACTCCCAAAG | ATAAACCG | | ELLNECKKFDQMVR |
| | | | | GAAGAAGAATTCGTCAAATACTATAAAGAACTATTTACAAACAAAGATG | GATATTGT | | NQLVNQNIKKLQVS |
| | | | | GGGATGATAAAGAAACACCACATCTTGACAATTGGTTGAAGAAGTTTAG | TATAACGA | | NSRIYLPKEYNSLGLN |
| | | | | TAAGACATTAATTGTAGACTGGACTATAAATGACAAGGAGATTCTTGAA | TGAAAGAA | | EIEIEVAANIIRKACYIK |
| | | | | GCTTTAAAATATTGTGGTAATTTCAAAGCACCGGGATCTGACATGGTAA | GGGAAAA | | KRETLRGVDKLYIAM |
| | | | | TGAAAGTTTGTTACAAATGGTTCAAATCTGCACAAAATTATCTAATCAGA | AAAAGATA | | SKNGHRNTLSDALYIT |
| | | | | TGGATCAAATCAACTTGGTATGGTGAATACACAATAAATAAGAAAGATA | ACGTACAT | | KKYSNFQINWNIMG |
| | | | | CAAATGCAGTCACATTCATGATTTGGAAAAGAGATGGTAAACCAAAAAA | ACTAGAGA | | MVKDQNNILLDAKKI |
| | | | | TGATGTCAAATCATATAGACCGATTTCTTGCTTGAACTGTGATTTCAAGT | TGTCGATA | | IENIKEKRRNLWLEH |
| | | | | TACTAAACAAACTTATTGCAAACAAGATTTATGAATCAATAGAGAAAATT | CCACATAT | | WKKGNMTYANEAIK |
| | | | | TTGCCTATAAATCAAATGGCAGTAATTAAGAATAAACATGGAACATGTG | CTAGAACT | | KEFHLPDLNIDSKYL |
| | | | | AAGCCCTACTCCTATACAAATCATTGGTTCAATCAATGAAATTTAGAAGA | TGAAGATG | | MLCYAGSEEQIIYNG |
| | | | | ACGAAAGATGTGAAAGAAATATGGTGTTCATGGATTGACTTCAGCAAAT | CAAGAAA | | HVSLVNQSSPSSRLC |
| | | | | GTTATGACTCAATAAGTCATAAGTGTTTGAAAAAAATGATACAAAGTAT | GAATAAAG | | RKCNKLEETSYHVAS |
| | | | | TAAGGCTCCACCAATTATTCACAAACTCATTTTAGATGGAATTGATAGCT | TATAAAAA | | VCEFHKKNLHLMRH |
| | | | | GGAACATATCAATTTGTAATGGGAAAAATATTTCCAAAACTAAAATACCT | ATATTGTG | | NSAVYHIITELCRIMK |
| | | | | GTTAAATCTGGTATTCTTCAAGGTAAAGTGGCTAGCTCTTTATATTTTGT | TGAGCTCC | | VKCTLRYPEASGIIKS |
| | | | | ATTATTGACTGGTGAAATATCTTATGCTTTGAACAAGGAAGAACAAGTA | ATGGTAAA | | GNMKIAAGVKYTFG |
| | | | | CCAATTGAAACGATTACACCAAGCAACACTTTGAAAATCAACCATATCA | AATAACGA | | TAKIYHNKPDLVWYT |
| | | | | GTTTTATAGATGATTATCAACTGTATGCTACATCACAAAAGAAAGTTGAA | ATGATAAT | | PEVIYVIEVSISSLKNA |
| | | | | AAACTAACTATTAAATTGAGGGAAATAGCAGAAGAGATGAACCTGAAG | GTTGATTC | | KSQMKMKTARYAVN |
| | | | | CTGAATCCACAAAAAATGTGGCATATATGGCACAGATGATCTGGGAAAG | GATAGCTC | | STKKLENFAALNNLK |
| | | | | AGACTAATGCTGAAAGAAAGTTCATTAAACTTTCCATATACTTCCGAGTA | GTGATTTT | | KGENFVEILSHKANFK |
| | | | | CAAGTATCTTGGTCTGGTAGAAAATTCATTGGACTTAAAGGATATCAAT | AATCTACT | | RVHFMPLVFCTFGEI |
| | | | | ATCCAACTGTTTAAAGATAAAATACTATCTAAATACTCAACTATTTTTGAA | AAATTTAA | | PKETMKYLEKLNFSN |
| | | | | TCAAGACTCACTACACACCAGAAAAGAAAAGTATTTAATAGTACAATAT | TGGAAAG | | EKIKTIASPIARYTGRT |
| | | | | CTCCATGCGCAGCATATTACCTAGGTAATTTAATAACCAATAAATGTTCA | AAAAGAA | | LKAHFTN (SEQ ID |
| | | | | ATTCAAGAACTATTGAATGAATGTAAGAAATTCGATCAAATGGTCAGAA | AGGTGTAA | | NO: 1502) |
| | | | | ATCAGTTAGTGAACCAAAACATCAAAAAGCTTCAAGTATCAAATAGTAG | GATAAAGT | | |
| | | | | AATCTACTTACCTAAAGAATACAACTCCCTTGGATTAAACGAAATAGAAA | TTGGATCA | | |
| | | | | TTGAAGTAGCAGCCAATATAATCAGGAAAGCTTGTTACATTAAAAAAAG | TTTGTATTT | | |
| | | | | AGAAACTCTTAGAGGAGTAGACAAACTATATATTGCAATGTCAAAAAAT | GGCTGTTA | | |
| | | | | GGTCACAGAAACACTCTTAGTGATGCTTTATATATAACTAAAAAATACTC | TGGAGAAT | | |
| | | | | TAACTTTCAAATAAATTGGAATATTATGGGTATGGTGAAAGATCAAAAC | ATGTCTTG | | |
| | | | | AATATTCTTCTGGATGCGAAGAAAATTATTGAAAATATCAAAGAGAAAA | ACTGAATC | | |
| | | | | GGAGGAACCTATGGCTGGAACATTGGAAAAAAGGAAACATGACATATG | TGCTCTAA | | |
| | | | | CAAATGAAGCAATCAAAAAAGAATTCCATCTCCCGGACCTAAACATTGA | GAACACAG | | |
| | | | | CTCCAAATACCTCATGTTGTGCTATGCTGGTTCAGAGGAACAAATCATTT | AAAATCCT | | |
| | | | | ATAATGGACACGTAAGTTTGGTTAATCAATCCTCACCGTCTAGTAGATTA | GATTGAAT | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TGTAGAAAGTGTAACAAATTGGAAGAAACTTCATACCATGTGGCTAGTG | TGGGATTC | | |
| | | | | TTTGTGAATTCCATAAAAAGAATCTACATCTAATGCGTCACAATAGTGCA | TCCAAAAA | | |
| | | | | GTTTACCACATAATAACTGAACTCTGTAGAATCATGAAAGTCAAATGTAC | AGAGATG | | |
| | | | | GCTAAGATATCCAGAAGCATCAGGAATAATAAAAAGTGGAAACATGAA | GATAGCTT | | |
| | | | | GATTGCTGCTGGAGTAAAATACACTTTTGGAACAGCAAAAATATACCAT | GATCAAAG | | |
| | | | | AATAAGCCTGACTTGGTATGGTATACTCCAGAGGTAATTTATGTTATAG | AGTGTTCT | | |
| | | | | AAGTAAGTATTTCATCACTGAAGAACGCCAAATCTCAAATGAAAATGAA | TACAGTTA | | |
| | | | | GACTGCTAGATATGCAGTAAACTCAACAAAGAAATTGGAAAATTTTGCT | AATGAATG | | |
| | | | | GCTCTGAATAATTTAAAGAAGGGAGAAAACTTTGTTGAAATATTAAGTC | AGACAGCA | | |
| | | | | ATAAAGCAAATTTCAAAAGAGTCCATTTCATGCCCCTAGTTTTCTGCACT | AGAATTAT | | |
| | | | | TTTGGTGAAATACCTAAAGAAACAATGAAATACCTGGAAAAACTCAACT | TATGAAAC | | |
| | | | | TTTCCAATGAAAAGATTAAAACAATTGCTTCACCAATCGCACGTTACACT | ATCTAGAA | | |
| | | | | GGAAGAACTCTCAAAGCACATTTTACTAATTAATTAGATTTATATGTGCC | GGCGAAA | | |
| | | | | ACTTTACCTCAAAGATATATTAATACTAACTTAATTATAATTTATTATGAA | AGAATCAA | | |
| | | | | TTATAATATAATAAGTTTTAAAATAAAA (SEQ ID NO: 1134) | GATGAAAT | | |
| | | | | | CAGCCATT | | |
| | | | | | AATAACTT | | |
| | | | | | TTATTTAC | | |
| | | | | | CCAATTAT | | |
| | | | | | TTATTGCG | | |
| | | | | | TTAACTTG | | |
| | | | | | ATTATATG | | |
| | | | | | ATATTTATT | | |
| | | | | | GTATATTT | | |
| | | | | | ATTGTTTA | | |
| | | | | | ATTTAGTT | | |
| | | | | | TCATAGTA | | |
| | | | | | CAAATAAA | | |
| | | | | | AGAATATA | | |
| | | | | | CTACGATT | | |
| | | | | | CTTTACTTT | | |
| | | | | | TAAGTTCT | | |
| | | | | | ACGAGAAC | | |
| | | | | | GTTGTTTT | | |
| | | | | | AGAATATT | | |
| | | | | | TTAATAAT | | |
| | | | | | ATTTCTAC | | |
| | | | | | TACAATTA | | |
| | | | | | AGTAATTA | | |
| | | | | | GAAGAAAT | | |
| | | | | | CAACGAAA | | |
| | | | | | GCAGCTAA | | |
| | | | | | ACTTACTC | | |
| | | | | | GCAAAATT | | |
| | | | | | CGTTGATC | | |
| | | | | | GAGGCTG | | |
| | | | | | GAATGGCA | | |
| | | | | | CCAACTAA | | |
| | | | | | TATACTAA | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | CCAACAAT | | |
| | | | | | AGAAAAA | | |
| | | | | | AAAAGAA | | |
| | | | | | GAACTTCA | | |
| | | | | | GTGGACTT | | |
| | | | | | CAAATAAA | | |
| | | | | | ATAAAATT | | |
| | | | | | ATTGGTAG | | |
| | | | | | AATTGTAT | | |
| | | | | | GATAAAAC | | |
| | | | | | TGAGAAAA | | |
| | | | | | TTTGACTA | | |
| | | | | | AAACAAAA | | |
| | | | | | AGATTAGA | | |
| | | | | | GCAAATAT | | |
| | | | | | GTCATCAT | | |
| | | | | | TTTCCTAA | | |
| | | | | | TCATACAA | | |
| | | | | | TTAAAGCG | | |
| | | | | | ATGATGAC | | |
| | | | | | GAAATTGA | | |
| | | | | | GAGAATTT | | |
| | | | | | GAAAGAG | | |
| | | | | | AAAAAAG | | |
| | | | | | GGAAAATT | | |
| | | | | | GTGAAATT | | |
| | | | | | AAAATGAG | | |
| | | | | | GGAAAAT | | |
| | | | | | GAGGAAA | | |
| | | | | | AACCTGAG | | |
| | | | | | GAAAAATT | | |
| | | | | | AAATTTTG | | |
| | | | | | ACAACTAT | | |
| | | | | | GAAGAAG | | |
| | | | | | CAAAATTG | | |
| | | | | | AAAAGAG | | |
| | | | | | GAATTAAG | | |
| | | | | | TGTAAAAA | | |
| | | | | | AGAAGTAA | | |
| | | | | | AACCAATT | | |
| | | | | | GTTATTGA | | |
| | | | | | AAACAAG | | |
| | | | | | GATTAGGA | | |
| | | | | | ATTTTTGA | | |
| | | | | | AAACGGA | | |
| | | | | | AAAATTAT | | |
| | | | | | TTCTCAAG | | |
| | | | | | TTTGTCAA | | |
| | | | | | CACAATCA | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | ATTACCAA | | |
| | | | | | AGAAAGA | | |
| | | | | | AGGGTAA | | |
| | | | | | ATCAACCA | | |
| | | | | | GA (SEQ ID | | |
| | | | | | NO: 1257) | | |
| R4 | R4- | CADV01008832 | *Bursa-* | GGGTCCTCGGTTCTTACTACCGTGCTCCACCTCCTCGCGATGGACCCTGG | GGGTCCTC | TGAGAC | MISRSQADRPVEGQ |
| | 3_BX | | *phelenchus* | GGTAGGCCTCCGGGCTGAGCTAAGCAGAGCATTAAAGTAAAGAGTGAC | GGTTCTTA | CACCCAT | PVTAMSFHNLEPNN |
| | | | *xylophilus* | GGCGCAGTTGCTTCCAAGTTGCGGTGGGGCGGAACATCTACTCTTCTGA | CTACCGTG | GCGCAG | LYPENLRPTGSQDAN |
| | | | | GAGAGGGGAAGCCCTATGGCGGCGTTAGAAAGGTTGGACTGCGGCAA | CTCCACCT | AGTATC | RGVADIAEEVTGPSG |
| | | | | CACTAGCCATGATCAGATTCGATCAAAATAGCCTCTGGGGCTGGCGACC | CCTCGCGA | CGAATC | LVTNEEAARAPPLFV |
| | | | | CTATAACGGATTGTAAACTGAACTATGCTAACCTGTCAGTAAAGACAGA | TGGACCCT | AGTGAA | EGEYKRAHCGGGKC |
| | | | | ACGGGGGCTTTGCAATCTAAGGTGTTGGCAGACCACTAAAACTGCCCTT | GGGGTAG | AGTCCA | HYCRVLWIGARSSKA |
| | | | | TGATGAGGGTGAGATAACATCCTACGGAACAGCCCCTGCTGATCCAAAC | GCCTCCGG | AGTTTCA | RTDSWNLCEILFLINK |
| | | | | AAAATCATCCACAAATCGGAGGGTTTTCTTGGTAGTTTCCCTTGGCACGT | GCTGAGCT | GGACAG | CMELGNVRRIYSPLE |
| | | | | CTTGTTTCAAAAGCCAGAATATAAAACAATACCGAAGTACAGAATGGCT | AAGCAGA | AAACGT | SSLKEAGINRTRHAIV |
| | | | | GGAACCTAACAGCCATGGCACAGAAAACCGGTGGGTGCACACCGGAGA | GCATTAAA | CAGATA | KCRLAVMRDRFVDN |
| | | | | CAGCAGGGGAAAGATTGCAAAGTGCCGTAAATAAAGATGGTAGCTCTC | GTAAAGA | AGTCCA | APYSEHWRLYNACA |
| | | | | TGACCTGAGGGAATGGGACACTGTCCGATTAATGCCTTATCCCGAAGAC | GTGACGGC | AGAGAA | ENRAVVVPMDSATT |
| | | | | GGTCAAGGTTCTATCTTATCGGTCTCCAAAGGGCTCTGGCCATAGAAGC | GCAGTTGC | ACGAGA | VKKRTARQAGLESPS |
| | | | | TGCGAGGAAGCCGTAACCCTACGCAGATTGCCGCCGTGCATGATAAGTC | TTCCAAGT | AAACAA | QIGVAGKRVHEAETG |
| | | | | GTAGCCAAGCGGATCGACCAGTGGAGGGCCAACCCGTAACAGCCATGA | TGCGGTG | GTTCAA | TDRINAVIETNTTPLE |
| | | | | GTTTCCATAATTTAGAACCAAACAACCTGTACCCAGAAAATCTTCGTCCT | GGGCGGA | GTATGC | DIDLSPETPEGLAELP |
| | | | | ACTGGGTCACAGGACGCGAATCGCGGAGTTGCGGACATTGCTGAGGAG | ACATCTAC | AAGAGT | STVEIMELTEDGSRSR |
| | | | | GTGACTGGTCCTTCGGGGCTGGTTACTAACGAGGAGGCAGCGCGAGCA | TCTTCTGA | TAATCA | GTANDADGGVSISDP |
| | | | | CCGCCGCTTTTCGTAGAGGGCGAATATAAAAGGGCACACTGCGGTGGG | GAGAGGG | ATAAGA | LRNRPSSSQESRNVP |
| | | | | GGCAAATGTCACTACTGCAGGGTCCTGTGGATAGGTGCGAGGTCTTCAA | GAAGCCCT | GAGTAC | EQVDPDGELVWESL |
| | | | | AGGCCCGTACCGACAGTTGGAATCTCTGTGAGATTCTATTTTTGATTAAC | ATGGCGGC | CGTAAA | YGAQLRGAMRTTDR |
| | | | | AAATGCATGGAACTTGGAAACGTGCGTCGGATTTACAGTCCTCTCGAGA | GTTAGAAA | TGTATG | PRLPKLTKFSAAEQL |
| | | | | GTTCTTTGAAAGAGGCTGGAATCAACCGAACACGTCATGCAATAGTTAA | GGTTGGAC | ACCCCCC | WIKSKVEKARLECVSY |
| | | | | GTGTCGACTAGCTGTCATGCGTGATCGATTTGTGGATAACGCCCCATATT | TGCGGCAA | CCTTTGC | GIEQQWLRASAVLYA |
| | | | | CTGAGCATTGGCGTCTGTATAACGCGTGTGCAGAAAATAGGGCGGTGG | CACTAGCC | CAAGTC | TIKTVAACRPYNKAR |
| | | | | TCGTCCCGATGGACTCGGCCACAACGGTGAAGAAAAGAACTGCTAGAC | ATGATCAG | GACAAC | EAHKVWLENKRAEE |
| | | | | AAGCGGGCTTGGAATCACCTTCGCAAATCGGGGTCGCTGGCAAGCGAG | ATTCGATC | TGTCAT | KRVRRIIGRIETVRTM |
| | | | | TCCACGAAGCTGAAACTGGAACTGATCGGATTAACGCGGTGATTGAAAC | AAAATAGC | GCAGGT | PKGKRTDKQIRLARKI |
| | | | | GAACACAACTCCGCTAGAGGATATTGACTTGAGTCCAGAGACCCCAGAA | CTCTGGGG | GTCTCTC | NRLKRVSFPEMDWH |
| | | | | GGGCTTGCAGAGTTGCCTAGTACTGTAGAGATAATGGAATTGACGGAA | CTGGCGAC | TTTTCAC | GFLNHFKAKLDLLKKL |
| | | | | GACGGGTCTAGATCCAGAGGGACTGCGAACGACGCTGATGGCGGGGTT | CCTATAAC | CCGCCA | ISVRVAEHERKISRKIA |
| | | | | TCCATCAGCGATCCACTACGAAATCGCCCAAGCTCAAGTCAGGAAAGCA | GGATTGTA | TATGGA | GTYGKSVSGQSGFTP |
| | | | | GAAATGTCCCGGAGCAAGTAGACCCGGATGGGGAACTTGTATGGGAGA | AACTGAAC | CCAAAC | DVVAATTFWSGLAQ |
| | | | | GTCTATACGGAGCACAGTTGAGGGGAGCGATGCGCACAACTGACAGGC | TATGCTAA | GCTATCC | PGPKKFKKNSLIFQT |
| | | | | CGAGGTTGCCAAAACTTACGAAATTCTCTGCAGCCGAACAGCTGTGGAT | CCTGTCAG | AGCCTC | WKDSVVENMNTEP |
| | | | | TAAATCGAAGGTTGAGAAAGCTCGGCTGGAGTGCGTTAGCTACGGCAT | TAAAGACA | GCTCAG | VLLHPLIIECMNKPSP |
| | | | | TGAACAGCAATGGCTCCGTGCCAGCGCAGTTCTATATGCCACGATCAAG | GAACGGG | AAGAGC | FKATGPDGIFNSYWR |
| | | | | ACTGTAGCGGCTTGTCGTCCGTACAACAAGGCCCGCGAAGCTCACAAG | GGCTTTGC | CTTAGG | QGFIANWVKSLIQRT |
| | | | | GTATGGCTCGAGAACAAACGTGCTGAAGAAAAGAGAGTACGAAGGATT | AATCTAAG | GCTGGG | IQTGEFPASLMCGRT |
| | | | | ATTGGGCGAATTGAGACTGTACGCACCATGCCGAAAGGCAAACGAACT | GTGTTGGC | GAGTAC | VLLYKNGDTAKPENY |
| | | | | GACAAGCAGATCCGCCTTGCGCGGAAGATTAACAGGTTGAAACGTGTC | AGACCACT | CACATG | RPITCLNGCFKMTNA |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AGCTTCCCAGAGATGGACTGGCACGGATTCCTGAATCACTTTAAAGCTA | AAAACTGC | TGGCGG | VITKVIVQRVQDTCA |
| | | | | AGTTAGATCTTCTTAAAAAGTTGATCTCAGTTCGGGTGGCAGAACATGA | CCTTTGAT | AAACTG | LPGEQMALKPKVWA |
| | | | | GCGGAAGATTAGTCGGAAGATAGCAGGTACATACGGCAAAAGTGTATC | GAGGGTG | AATCTG | CMEAQLRDQALQSEI |
| | | | | CGGTCAGTCAGGGTTTACGCCGGATGTCGTTGCCGCAACGACTTTCTGG | AGATAACA | GATGCG | GNDCKTAWIDFSKAY |
| | | | | TCAGGCCTTGCACAGCCTGGACCAAAGAAATTTAAAAAGAACTCGCTGA | TCCTACGG | ATGCAT | DSLDHDAIRFVIETLA |
| | | | | TCTTCCAGACTTGGAAAGACAGTGTAGTTGAGAATATGAACACTGAGCC | AACAGCCC | ACCGGG | LPDGMEKYLLKSLES |
| | | | | AGTACTGCTACACCCGCTGATCATAGAATGTATGAATAAGCCCAGTCCG | CTGCTGAT | AGCGCA | WKTKLVLSNRGKVAT |
| | | | | TTCAAGGCCACTGGCCCTGACGGGATTTTCAACTCCTATTGGAGGCAAG | CCAAACAA | GCGAAA | GRPYKIKRGVLQGDS |
| | | | | GATTCATTGCGAATTGGGTTAAGTCGCTAATCCAGCGAACTATTCAAAC | AATCATCC | TCACTTA | LSPALFVIATSPIVSHL |
| | | | | AGGAGAGTTCCCGGCCTCACTTATGTGTGGTCGTACGGTGCTCCTGTAT | ACAAATCG | ACGCTG | KRVCPSGRIQLYMDD |
| | | | | AAGAATGGTGACACTGCTAAGCCGGAGAATTATCGACCTATCACATGCC | GAGGGTTT | GTGCAC | IKLYGKSETELRMLIKE |
| | | | | TGAATGGTTGCTTCAAGATGACTAATGCTGTTATCACGAAAGTAATCGTT | TCTTGGTA | CTCCTGC | VQKVANKLGLQMNL |
| | | | | CAACGGGTTCAAGACACCTGTGCTCTCCCGGGAGAACAGATGGCCCTG | GTTTCCCT | TATCGTA | KKCSTYGAGLTESIAG |
| | | | | AAGCCGAAGGTGTGGGCGTGCATGGAAGCGCAGTTGCGCGACCAGGC | TGGCACGT | GTACTTC | FDPLGDRAYKYLGVP |
| | | | | TCTACAGTCTGAGATCGGTAACGATTGTAAGACTGCGTGGATCGATTTT | CTTGTTTC | CTAGAT | QRSVADTNLAFGELE |
| | | | | TCAAAAGCTTATGACAGTCTGGACCACGACGCGATCCGATTCGTGATAG | AAAAGCCA | AGATGA | GKVIRSIEETMACEYL |
| | | | | AAACACTTGCTTTACCGGACGGAATGGAGAAATATCTCCTGAAGTCGCT | GAATATAA | GTAGGG | TMRQVVTRLNSVIGP |
| | | | | AGAGAGTTGGAAGACAAAACTGGTGCTTAGTAATCGAGGTAAAGTTGC | AACAATAC | TGGGCT | LVRFVAQSVLTSQAK |
| | | | | CACTGGGCGACCTTACAAGATTAAGAGAGGTGTTCTGCAAGGTGACAG | CGAAGTAC | AAAGGT | VSWIYNKISDLDSKIR |
| | | | | TCTTAGTCCGGCCCTATTTGTCATTGCGACAAGTCCTATCGTCTCCCATCT | AGAATGGC | AGTCGT | AKLAQTGLRYKKSNV |
| | | | | AAAGCGTGTTTGCCCATCCGGCCGTATACAATTGTATATGGATGACATT | TGGAACCT | CTTCAAT | ARLYLSKSKNGIGLVN |
| | | | | AAACTGTATGGCAAATCAGAGACCGAATTACGTATGCTCATTAAAGAAG | AACAGCCA | GGCAAT | VQQVLVEALVSRAIY |
| | | | | TTCAAAAGGTAGCCAACAAATTGGGGCTCCAGATGAATCTAAAAAAATG | TGGCACAG | ACCGAG | CLRAPSLVEIREHILTA |
| | | | | TAGTACCTATGGTGCTGGCCTAACAGAGAGTATCGCCGGGTTTGACCCA | AAAACCGG | GGGTCT | EFDPVGAARTVLRRS |
| | | | | CTCGGCGACAGAGCATACAAGTATCTCGGAGTTCCCCAGCGGAGCGTC | TGGGTGCA | CGTGAC | RIQLEIERVEMASAIS |
| | | | | GCAGATACTAATTTGGCCTTTGGTGAGCTTGAAGGCAAGGTAATACGGT | CACCGGAG | AGGTGA | AIKTNYQARWMTKF |
| | | | | CCATCGAGGAAACGATGGCGTGCGAATACTTGACAATGCGGCAGGTGG | ACAGCAG | GGGATA | TQSKLYQKWVHHDI |
| | | | | TCACAAGATTGAACTCTGTGATCGGTCCTCTTGTCCGGTTTGTAGCACAG | GGGAAAG | ACTAGT | DLANSNLWLERGEIS |
| | | | | TCCGTACTAACCAGTCAGGCGAAAGTAAGCTGGATATATAACAAAATAT | ATTGCAAA | ATCAGA | PQNARIAVAAQDNT |
| | | | | CGGATCTGGATAGCAAGATAAGAGCGAAATTAGCTCAAACAGGCCTAA | GTGCCGTA | TAATATC | LLCRGFVGNRESEKQ |
| | | | | GGTACAAGAAAAGCAACGTAGCAAGACTCTACCTAAGCAAGAGTAAAA | AATAAAGA | AGTCAT | CRMCNMGIETCSHIL |
| | | | | ATGGCATCGGTTTGGTGAATGTCCAGCAGGTATTAGTTGAAGCATTGGT | TGGTAGCT | GAAATT | TECSYHRAHMYIERH |
| | | | | GAGCCGAGCCATCTATTGTCTGAGAGCCCCGAGTCTCGTTGAGATTCGG | CTCTGACC | AGCAAC | DSVARNIYAVLAKDH |
| | | | | GAGCATATACTAACAGCAGAGTTCGACCCTGTAGGAGCTGCTCGTACCG | TGAGGGA | AACCAA | GLWIPHYSQPVSSVT |
| | | | | TGCTGCGGAGGAGTAGGATCCAACTGGAGATCGAGCGCGTCGAAATGG | ATGGGACA | CGTCAC | KTPTCELYWNYKFPC |
| | | | | CTTCGGCTATATCGGCGATTAAAACAAATTACCAGGCAAGATGGATGAC | CTGTCCGA | CGTCGT | TRALEACRPDIVLIDR |
| | | | | GAAGTTCACCCAATCGAAACTATACCAGAAGTGGGTTCACCATGACATC | TTAATGCC | TGGCAA | AKRTILIVEVAVSYVT |
| | | | | GATCTAGCCAACTCAAACTTATGGTTAGAGAGGGGCGAAATCTCTCCGC | TTATCCCG | AACACC | RLKQMVSRKVYKYG |
| | | | | AAAACGCAAGGATTGCGGTAGCGGCTCAAGATAATACGTTACTGTGTC | AAGACGGT | GACTAA | VNGEKGADGESRG |
| | | | | GCGGGTTTGTAGGTAATCGGGAGTCAGAAAAACAGTGCCGCATGTGTA | CAAGGTTC | CGATGC | WNMIRELSEVYNMK |
| | | | | ACATGGGCATTGAGACCTGCAGTCATATCCTGACTGAATGTAGTTATCA | TATCTTAT | TAGTTA | VNLCAVVIGASGEVL |
| | | | | CCGGGCGCATATGTATATAGAACGTCACGATTCTGTGGCAAGGAATATC | CGGTCTCC | GAAAGA | PCTVKAIQSISSKTSSR |
| | | | | TATGCTGTCCTGGCAAAAGACCACGGTCTCTGGATTCCGCATTACTCGCA | AAAGGGCT | GTCGGG | QLLERCQRSAVLGST |
| | | | | GCCCGTGAGTTCGGTAACAAAGACGCCGACGTGTGAACTTTACTGGAAT | CTGGCCAT | TCTTCCC | RVVKRHLAEFH (SEQ |
| | | | | TACAAGTTTCCATGTACCCGTGCATTGGAAGCTTGCCGTCCAGATATCGT | AGAAGCTG | AAAGTT | ID NO: 1503) |
| | | | | TCTCATCGATCGCGCGAAAAGAACTATCCTCATAGTGGAAGTTGCGGTG | CGAGGAA | AGGTGC | |
| | | | | TCGTATGTCACACGGCTAAAGCAGATGGTGTCACGAAAAGTGTATAAAT | GCCGTAAC | TTGCACC | |
| | | | | ATGGAGTAAACGGTGAAAAGGGAGCCGACGGCGAAAGCCGCGGCTGG | CCTACGCA | GAAGCC | |
| | | | | AATATGATCCGTGAACTATCTGAAGTTTATAATATGAAAGTGAACCTTTG | GATTGCCG | GATCCG | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CGCAGTCGTGATTGGGGCGAGTGGGGAAGTTCTCCCTTGTACGGTCAA<br>AGCCATTCAGAGCATATCTAGCAAGACCTCCAGCCGACAGCTCCTAGAG<br>CGGTGCCAGCGTAGCGCTGTCCTAGGGTCGACGAGGGTTGTCAAACGA<br>CATCTTGCAGAATTCCATTGAGACCACCCATGCGCAGAGTATCCGAATC<br>AGTGAAAGTCCAAGTTTCAGGACAGAAACGTCAGATAAGTCCAAGAGA<br>AACGAGAAAACAAGTTCAAGTATGCAAGAGTTAATCAATAAGAGAGTA<br>CCGTAAATGTATGACCCCCCCCTTTGCCAAGTCGACAACTGTCATGCAG<br>GTGTCTCTCTTTTCACCCGCCATATGGACCAAACGCTATCCAGCCTCGCT<br>CAGAAGAGCCTTAGGGCTGGGGAGTACCACATGTGGCGGAAACTGAAT<br>CTGGATGCGATGCATACCGGGAGCGCAGCGAAATCACTTAACGCTGGT<br>GCACCTCCTGCTATCGTAGTACTTCCTAGATAGATGAGTAGGGTGGGCT<br>AAAGGTAGTCGTCTTCAATGGCAATACCGAGGGGTCTCGTGACAGGTG<br>AGGGATAACTAGTATCAGATAATATCAGTCATGAAATTAGCAACAACCA<br>ACGTCACCGTCGTTGGCAAAACACCGACTAACGATGCTAGTTAGAAAGA<br>GTCGGGTCTTCCCAAAGTTAGGTGCTTGCACCGAAGCCGATCCGCTCTA<br>CCCACAGCTCTGCCCAGCGTT (SEQ ID NO: 1135) | CCGTGC<br>(SEQ ID<br>NO: 1258) | CTCTACC<br>CACAGC<br>TCTGCCC<br>AGCGTT<br>(SEQ ID<br>NO:<br>1381) | |
| R4 | R4-<br>4_BX | — | *Bursa-<br>phelenchus<br>xylophilus* | TGCCAGCGGTGTTGATTAGGTCCAAGTTCTTTGGCCAAAGATCCGCCCT<br>CGGTTTAGCAGTACCGAACGAGTATACCTTCAAGTGGTGGCACTGAATT<br>AGACTGAATACTCTGAACTGTAGACTTTTGTGCAACTGTGTATGGTGTG<br>GAAGACTTGTTTGTACCACTATCAGCTTTATTGGGGCTCGTTACTGTTTC<br>ATACAGGTAGATGTCCCCTTTAGAGATTTCCCTGCAGTTTGCGCTCCAAG<br>TCGCTAGCCTCTTGCGTGTAGTCAAAGGAATACATTCGCCGTCGGTGAC<br>AGGGCTATACCCGGCGACTACGGACTTGTTTATTACGTAGTGCAGCCTC<br>GTTTAAGACGAATGTGAAAAGAAGGTGTGATTACTAAGCGTTATGAGTC<br>GGGTTATCTGGAAACTCCGCCCCGCCGCAATGGCTTCAAGGGTCAAACT<br>GCTAACATTTTAAACCAATATTTGGCAGCAGCAGACTATGATGTCAGAG<br>TGCCGGGGGTCTATCGATATAAGACTGAAAGCGATAGACGTGGAGTGA<br>AAGGATTCCCTTTGTTAAGAGAATCGGTAGAATTCACTTTTTACTTATTC<br>AAGAACTTAACAGCAACAAGCACTCGCGAGGATTACCGCCCCAGATTCG<br>GTCGGCGGTACTTCACCTGCTTTCTTCCACTTTCGGAATCTGGCATCCTG<br>GCTTTCAGTGTGGTGATGGCCGGCTTGAGTTTTCTTGAGTCGTGCGAGT<br>GCCTCATCTGGGACGTCCGGACCGATTGATGGAGTCTGCAGTGGACGA<br>GGACTTGATGGACCGTAACCATAGTATATCCCTCATGCGTCTTCTCGACT<br>CGAGGGGGTAGCTTGCACTACCCACCCTTCTCTTCTCCGATTGGGATTTA<br>GACCTAGCCCTCTGGTGTGTCTCGACCCGCGATATCAGATTCCTGAATCG<br>ACTGTGAGAAATGTCTACGCGCAAAGATCGACCCATTGCCACCCGGCTA<br>TGTGGATCGGGCTCTTGACTGCTTATCTCCGGCTTTAATCGCTTGAGGAA<br>AGGGGGGTGTCGCCCGAAAGGGTTACGCGATCATCCGATTCCTACCGT<br>AAAAACGTAGTTGAAGTAGGATTGAACCTGAGTACCAAGTGAAAAGAG<br>TGGCTATAATGCTCCATGGTATACCCTAGGGATAACCGTGTCGAGCGCA<br>CTGCTCAATACCCTGATTTGTTAGTGTAGGTATGTCTAGTGGCTGCCTAG<br>GCAGATTCGCCTATTCACTACGTAAAATCTGGGTGAGTACCATAAGAAC<br>CTCCTGTAGGGCCAGGAGTCAAACTAGTCCAGGTTCGGTATGCTTCGGT<br>ATACTCTCTCACGGGCTAGTCACCTAAGAGTTAAGAACCGCCTTTTTCTG<br>CACTGTGAATAGAAAAAGAAGGGCGGGAGAATATACGGGCGAGGTAA<br>GCACGTCGGAACGGGGTGTGCCCAACTCGTACCGTACGCCCGGACAAG<br>GACCATCTTTCGTACCCCGTTCACCCGGCACAAGTCCGATTGTCTCTCCC<br>GAGAGGCGTCGGCGGAGGTTGGCTAACGCCGTCTCTCCAACCATCGGT | TGCCAGCG<br>GTGTTGAT<br>TAGGTCCA<br>AGTTCTTT<br>GGCCAAA<br>GATCCGCC<br>CTCGGTTT<br>AGCAGTAC<br>CGAACGA<br>GTATACCT<br>TCAAGTGG<br>TGGCACTG<br>AATTAGAC<br>TGAATACT<br>CTGAACTG<br>TAGACTTT<br>TGTGCAAC<br>TGTGTATG<br>GTGTGGAA<br>GACTTGTT<br>TGTACCAC<br>TATCAGCT<br>TTATTGGG<br>GCTCGTTA<br>CTGTTTCA<br>TACAGGTA<br>GATGTCCC<br>CTTTAGAG<br>ATTTCCCT<br>GCAGTTTG<br>CGCTCCAA<br>GTCGCTAG | TAATTA<br>GGCAGT<br>GCTCCTA<br>GCGGAG<br>TGCCGT<br>GAAGTG<br>GTGTCA<br>GTACCC<br>GTCGTG<br>TGGAAA<br>GCCCAG<br>GAGGGT<br>TAGTAC<br>CGACAG<br>TGGGAA<br>ACCCGC<br>TGCACG<br>CAACCT<br>AAAGAC<br>ATTTGCC<br>CTTCGG<br>GGGAGA<br>GGTATG<br>AGACCA<br>CACTAG<br>TCATGG<br>TTGCTTG<br>CGCAAG<br>CATGAC<br>TCATTCA<br>TTGTAA<br>GTTCGT | MEILWEDLRLKIEDR<br>YGVTLPQRSASSLKN<br>QYPKVILRGLPDSGLP<br>WAGVQVNDTGQVV<br>VVDHAEAATLRGSSP<br>AAVDGEAEEPVVPPL<br>PAAEVVESAADAAVP<br>DPQSEIVADQGVETR<br>PVENPPANSRETETE<br>PVEVEPYLEGQYKFF<br>VSKILGKSMWRKPIK<br>YPRRVPETLWRQAN<br>ELIERSIRQGEVSIQSL<br>NCMVYAAGCAVKSS<br>LDKKDQEAKRRESE<br>WYACRKAEIKALERY<br>LNFIDLELKRRSASRP<br>LTSRQRQNLGVLITKY<br>GRARVRSGVRLSELQ<br>AMLRDALVGIRKCM<br>AKRSADKKRKQGKFV<br>PIQRYLEPSSAEPRLS<br>PDTVRAYWNDIVGS<br>SQQSTSDSTIQDWSS<br>NLSVPSQELNASKIM<br>GWWRAAVSKSKPN<br>KAAGPDGIPGVLWK<br>RFRSASEWVCTWLY<br>RLLQKRRIITPRWLSV<br>GRVVLLPKKGPLEDP<br>ANYRPIACLNTVYKLI<br>TSVVEMAVREQIQA |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | TTGGGTTTAAGTAACGCCCCAGTGGCCGGTAGCCAAACTGATGGAGGC | CCTCTTGC | ATTATG | CPGLVPYEQIANRKG |
| | | | | AGAAATGCCGGTCCGTTGCTAAATGCGGGAACGGACCAAAACGCCGGT | GTGTAGTC | AGGCCT | VWGCTHASIVDRMI |
| | | | | GTGGTGGATACAGGTGGAAGAGTCTTTTGGTCTACGCAAGAAAAGACC | AAAGGAAT | CGCGGA | TGASREGKGGGFPDL |
| | | | | AGGCTCAAGTACGAATACGACCGTCTTCGTGAACGACGCCGTCGAGAC | ACATTCGC | ATGCGA | RVLFYDCKKAFDSVN |
| | | | | AAAGTTCGAAATCCTACGGTCGATAAGGCCATGGAAATCCTTTGGGAAG | CGTCGGTG | AAGTCC | RDHMFAVLRVANVN |
| | | | | ATCTCCGGTTGAAAATTGAAGATAGGTACGGTGTCACATTGCCGCAAAG | ACAGGGCT | AAGAGC | VKVVHLLHTLSQQW |
| | | | | AAGCGCAAGCTCTTTGAAAAACCAGTACCCCAAAGTTATTCTGCGGGGG | ATACCCGG | GCCAAC | CVRYELRRNNRVERS |
| | | | | CTCCCAGATTCGGGCCTGCCTTGGGCGGGGGTTCAGGTAAATGATACTG | CGACTACG | TTGTCTC | SPLRVKRGLLQGDTL |
| | | | | GACAAGTCGTAGTCGTAGACCATGCTGAGGCGGCTACCCTTCGGGGGT | GACTTGTT | TTTGGG | SPTWFCLCMAPISASI |
| | | | | CCAGCCCAGCAGCGGTCGACGGGGAGGCCGAAGAACCGGTAGTACCCC | TATTACGT | AGGTTC | KTLNPGPTLRPNMG |
| | | | | CGTTACCCGCGGCAGAGGTCGTTGAATCGGCTGCTGACGCTGCGGTGC | AGTGCAGC | CTCCGG | NGRNRGQVAIQVSH |
| | | | | CCGATCCGCAAAGCGAGATCGTGGCTGACCAGGGTGTGGAGACACGCC | CTCGTTTA | GTTCCTT | VFYMDDLKVYCPRV |
| | | | | CTGTCGAGAACCCCCCCGCTAATAGCCGGGAGACTGAAACGGAACCCG | AGACGAAT | AGGGTT | ADQRRMEQNIPQLF |
| | | | | TAGAGGTAGAGCCTTACCTCGAAGGGCAGTATAAATTCTTCGTTTCTAA | GTGAAAA | GGCGTA | GEIGLSINASKSAAAA |
| | | | | GATCCTTGGGAAATCGATGTGGCGGAAGCCTATCAAATACCCGAGGAG | GAAGGTGT | CCATGCT | AVGRYVESELPVLGT |
| | | | | AGTCCCGGAAACCCTGTGGCGTCAAGCCAATGAGTTGATTGAGAGATC | GATTACTA | TCGTGT | KDEYKYLGIESGFVVN |
| | | | | GATTCGACAGGGGGAAGTGTCGATTCAGAGCCTGAACTGCATGGTTTAT | AGCGTTAT | GAGACC | EVAALDRMQAVLLN |
| | | | | GCTGCTGGGTGCGCTGTTAAGTCTTCGCTGGACAAGAAGGATCAGGAA | GAGTCGG | TAGGCC | RVEAILSVKEHTVGQ |
| | | | | GCTAAGCGGCGTGAATCCGAGTGGTATGCGTGTAGGAAGGCCGAGATT | GTTATCTG | GCTTGG | RRDAIRAKAIPGGAYI |
| | | | | AAGGCACTCGAGAGGTATCTCAATTTCATTGACCTGGAGTTAAAGCGTC | GAAACTCC | ACCTAG | LGHIILSDLDPRGAAE |
| | | | | GCTCTGCGTCGCGGCCGTTGACATCAAGGCAAAGGCAGAACTTGGGTG | GCCCCGCC | AGTTAA | RMRRLDIEIRRLVKSA |
| | | | | TGCTCATCACGAAGTATGGGCGTGCTCGGGTTAGGTCTGGTGTCCGGCT | GCAATGGC | GCTGTT | GILHDKCSTARIHLSC |
| | | | | CTCGGAATTGCAGGCAATGTTACGAGACGCCTTAGTGGGAATCCGAAA | TTCAAGGG | GCATGT | EQGGLAWPSMERAY |
| | | | | GTGTATGGCGAAGCGCTCGGCAGACAAGAAACGGAAACAGGGCAAATT | TCAAACTG | TTGAGG | YVAVAYSASYLLTSQ |
| | | | | TGTTCCTATTCAACGTTACTTAGAGCCTAGCAGTGCGGAGCCTCGACTCT | CTAACATT | ATGCCTT | DETISRARDYFVSGRL |
| | | | | CTCCAGACACGGTTCGTGCATATTGGAATGACATTGTGGGATCTTCCCA | TTAAACCA | AGGCGG | SNKFTVYKHLTSIVDS |
| | | | | ACAGTCAACGTCAGATTCGACGATTCAAGACTGGTCCTCCAATTTAAGC | ATATTTGG | ACGCCA | LGLSVELPDPNGLPT |
| | | | | GTTCCGAGTCAAGAGTTGAACGCAAGTAAGATCATGGGGTGGTGGAGA | CAGCAGCA | TG (SEQ | GQPSVLARTIARAIDA |
| | | | | GCCGCCGTTTCGAAGAGCAAGCCCAACAAAGCTGCTGGTCCTGATGGTA | GACTATGA | ID NO: | KLEAQWKETLLTYQR |
| | | | | TTCCCGGGGTACTGTGGAAACGCTTCAGGTCGGCTAGTGAGTGGGTTTG | TGTCAGAG | 1382) | AGRVERADPTVVDH |
| | | | | TACCTGGTTATATCGCTTATTACAGAAGCGAAGGATAATCACGCCAAGA | TGCCGGG | | ANSYHWLRKAWINE |
| | | | | TGGTTGTCTGTTGGTAGAGTCGTATTGTTACCAAAGAAAGGACCTCTCG | GGTCTATC | | KAYQHAVSVMEGTL |
| | | | | AGGATCCCGCCAACTATAGACCCATCGCGTGCCTGAACACTGTATATAA | GATATAAG | | LEGVNPHGVLTMCR |
| | | | | GTTGATAACCTCGGTAGTAGAAATGGCAGTTCGAGAGCAGATCCAGGC | ACTGAAAG | | ACKAPSASIAHIITGC |
| | | | | TTGTCCTGGACTAGTCCCATACGAGCAGATAGCTAACCGTAAAGGCGTA | CGATAGAC | | AELRKSHMKVRHDG |
| | | | | TGGGGCTGTACGCATGCGAGTATCGTAGACCGTATGATAACCGGTGCA | GTGGAGT | | VTRWLYNALTEVDGS |
| | | | | AGCCGAGAAGGTAAGGGCGGTGGGTTTCCGGACCTACGCGTCCTATTTT | GAAAGGA | | LPKFHYTQQIPAEMR |
| | | | | ACGATTGTAAAAAGGCCTTCGACAGCGTAAACCGAGATCATATGTTCGC | TTCCCTTT | | GERLTVRYDSDIVTP |
| | | | | TGTTTTGAGAGTAGCAAACGTGAACGTTAAGGTCGTGCATCTACTCCAC | GTTAAGAG | | NKPRHNRPDLVVFDS |
| | | | | ACACTATCTCAGCAATGGTGTGTCCGATACGAGCTCCGTCGAAACAACC | AATCGGTA | | TRKVIYIVEVSVTWLS |
| | | | | GTGTGGAGAGAAGTAGCCCGCTGAGGGTGAAAAGAGGACTGCTGCAA | GAATTCAC | | VLQKQYDNKLNRYA |
| | | | | GGCGACACTCTCTCTCCTACATGGTTTTGCCTATGCATGGCTCCAATATC | TTTTTACTT | | VNSNHEFSESIPYPPG |
| | | | | AGCCTCTATTAAAACCCTTAACCCTGGCCCAACCCTTCGGCCGAACATGG | ATTCAAGA | | VNLANEIRVLYPQFT |
| | | | | GGAATGGGCGAAATAGAGGGCAGGTGGCGATCCAAGTTAGTCATGTGT | ACTTAACA | | GGVKVFPMIISPTGE |
| | | | | TCTACATGGATGACTTGAAAGTGTATTGCCCCCGCGTAGCCGATCAACG | GCAACAAG | | VHMQFVPHLAELLE |
| | | | | CAGAATGGAACAGAATATTCCACAGTTGTTCGGTGAAATTGGACTAAGC | CACTCGCG | | NPNIPRILEKIQRSVVL |
| | | | | ATAAATGCGAGTAAGAGCGCAGCAGCCGCAGCCGTGGGAAGATACGTT | AGGATTAC | | GTDYIIRSYFAM (SEQ |
| | | | | GAATCCGAGTTGCCAGTTCTTGGGACGAAGGATGAGTACAAGTACCTG | CGCCCCAG | | ID NO: 1504) |
| | | | | GGAATAGAAAGCGGTTTTGTTGTAAATGAGGTGGCCGCCCTTGACAGA | ATTCGGTC | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATGCAGGCCGTTCTGCTAAACCGTGTAGAAGCGATTCTATCGGTTAAAG<br>AACATACTGTTGGTCAGAGGCGCGACGCTATACGAGCGAAAGCGATCC<br>CTGGGGGGGCCTATATCCTGGGTCACATCATTTTGAGTGACTTGGACCC<br>CAGGGGTGCTGCTGAGCGCATGCGTCGGTTGGATATCGAGATTCGGCG<br>TTTAGTCAAATCAGCTGGTATTCTTCACGACAAGTGTAGTACAGCGCGT<br>ATTCACCTTAGCTGTGAACAGGGAGGTCTAGCTTGGCCGTCGATGGAGA<br>GAGCTTATTATGTAGCAGTTGCATATTCAGCCTCCTATCTTCTGACAAGT<br>CAAGACGAAACTATCAGTCGTGCCAGAGACTACTTCGTCTCGGGTCGAT<br>TGAGTAACAAGTTTACTGTTTACAAGCACCTTACGAGCATCGTAGACTCC<br>CTTGGTTTATCGGTAGAACTGCCGGATCCGAATGGACTTCCTACCGGTC<br>AACCGTCCGTCCTGGCTAGAACTATTGCGAGAGCGATAGATGCCAAGTT<br>GGAAGCGCAGTGGAAGGAAACTTTGCTAACTTACCAGCGCGCAGGGCG<br>AGTCGAAAGGGCAGATCCGACGGTCGTGGACCATGCAAACTCATACCA<br>TTGGTTGAGAAAAGCATGGATAAACGAGAAAGCGTACCAACATGCCGT<br>GAGTGTTATGGAGGGAACTCTTTTGGAGGGAGTGAACCCTCACGGTGT<br>GTTGACCATGTGTAGAGCGTGTAAAGCTCCAAGTGCAAGCATTGCTCAC<br>ATCATTACTGGCTGCGCCGAATTGCGCAAAAGCCATATGAAGGTGAGG<br>CATGATGGAGTTACTCGCTGGCTATACAATGCTCTGACTGAGGTAGATG<br>GTAGCCTACCGAAGTTCCACTATACGCAACAGATCCCGGCAGAGATGAG<br>GGGTGAGCGACTCACTGTCCGTTACGACTCGGACATAGTTACTCCCAAT<br>AAACCTCGTCACAACAGACCGGATCTTGTTGTCTTCGACTCTACTAGAAA<br>GGTGATTTATATAGTAGAGGTCAGTGTAACGTGGTTGAGTGTGTTGCAA<br>AAGCAATACGATAACAAGCTCAACAGGTATGCAGTGAACAGTAATCAC<br>GAGTTCAGTGAGAGCATACCATATCCGCCTGGTGTGAACCTTGCTAACG<br>AGATAAGGGTTTTGTATCCTCAGTTTACTGGGGGTGTGAAGGTATTCCC<br>TATGATTATCTCGCCAACAGGGGAAGTACACATGCAATTTGTGCCCCAC<br>CTTGCAGAGTTACTCGAAAATCCGAACATTCCTCGGATTCTAGAGAAAA<br>TTCAACGCTCGGTTGTGCTTGGTACAGATTACATTATCCGGTCATACTTC<br>GCCATGTAATTAGGCAGTGCTCCTAGCGGAGTGCCGTGAAGTGGTGTC<br>AGTACCCGTCGTGTGGAAAGCCCAGGAGGGTTAGTACCGACAGTGGGA<br>AACCCGCTGCACGCAACCTAAAGACATTTGCCCTTCGGGGGAGAGGTAT<br>GAGACCACACTAGTCATGGTTGCTTGCGCAAGCATGACTCATTCATTGT<br>AAGTTCGTATTATGAGGCCTCGCGGAATGCGAAAGTCCAAGAGCGCCA<br>ACTTGTCTCTTTGGGAGGTTCCTCCGGGTTCCTTAGGGTTGGCGTACCAT<br>GCTTCGTGTGAGACCTAGGCCGCTTGGACCTAGAGTTAAGCTGTTGCAT<br>GTTTGAGGATGCCTTAGGCGGACGCCATG (SEQ ID NO: 1136) | GGCGGTAC<br>TTCACCTG<br>CTTTCTTCC<br>ACTTTCGG<br>AATCTGGC<br>ATCCTGGC<br>TTTCAGTG<br>TGGTGATG<br>GCCGGCTT<br>GAGTTTTC<br>TTGAGTCG<br>TGCGAGTG<br>CCTCATCT<br>GGGACGTC<br>CGGACCGA<br>TTGATGGA<br>GTCTGCAG<br>TGGACGA<br>GGACTTGA<br>TGGACCGT<br>AACCATAG<br>TATATCCC<br>TCATGCGT<br>CTTCTCGA<br>CTCGAGGG<br>GGTAGCTT<br>GCACTACC<br>CACCCTTC<br>TCTTCTCC<br>GATTGGGA<br>TTTAGACC<br>TAGCCCTC<br>TGGTGTGT<br>CTCGACCC<br>GCGATATC<br>AGATTCCT<br>GAATCGAC<br>TGTGAGAA<br>ATGTCTAC<br>GCGCAAA<br>GATCGACC<br>CATTGCCA<br>CCCGGCTA<br>TGTGGATC<br>GGGCTCTT<br>GACTGCTT<br>ATCTCCGG<br>CTTTAATC<br>GCTTGAGG | | |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | AAAGGGG<br>GGTGTCGC<br>CCGAAAG<br>GGTTACGC<br>GATCATCC<br>GATTCCTA<br>CCGTAAAA<br>ACGTAGTT<br>GAAGTAG<br>GATTGAAC<br>CTGAGTAC<br>CAAGTGAA<br>AAGAGTG<br>GCTATAAT<br>GCTCCATG<br>GTATACCC<br>TAGGGATA<br>ACCGTGTC<br>GAGCGCAC<br>TGCTCAAT<br>ACCCTGAT<br>TTGTTAGT<br>GTAGGTAT<br>GTCTAGTG<br>GCTGCCTA<br>GGCAGATT<br>CGCCTATT<br>CACTACGT<br>AAAATCTG<br>GGTGAGTA<br>CCATAAGA<br>ACCTCCTG<br>TAGGGCCA<br>GGAGTCAA<br>ACTAGTCC<br>AGGTTCGG<br>TATGCTTC<br>GGTATACT<br>CTCTCACG<br>GGCTAGTC<br>ACCTAAGA<br>GTTAAGAA<br>CCGCCTTT<br>TTCTGCAC<br>TGTGAATA<br>GAAAAAG<br>AAGGGCG<br>GGAGAAT<br>ATACGGGC | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | GAGGTAA | | |
| | | | | | GCACGTCG | | |
| | | | | | GAACGGG | | |
| | | | | | GTGTGCCC | | |
| | | | | | AACTCGTA | | |
| | | | | | CCGTACGC | | |
| | | | | | CCGGACAA | | |
| | | | | | GGACCATC | | |
| | | | | | TTTCGTAC | | |
| | | | | | CCCGTTCA | | |
| | | | | | CCCGGCAC | | |
| | | | | | AAGTCCGA | | |
| | | | | | TTGTCTCT | | |
| | | | | | CCCGAGAG | | |
| | | | | | GCGTCGGC | | |
| | | | | | GGAGGTT | | |
| | | | | | GGCTAACG | | |
| | | | | | CCGTCTCT | | |
| | | | | | CCAACCAT | | |
| | | | | | CGGTTTGG | | |
| | | | | | GTTTAAGT | | |
| | | | | | AACGCCCC | | |
| | | | | | AGTGGCCG | | |
| | | | | | GTAGCCAA | | |
| | | | | | ACTGATGG | | |
| | | | | | AGGCAGA | | |
| | | | | | AATGCCGG | | |
| | | | | | TCCGTTGC | | |
| | | | | | TAAATGCG | | |
| | | | | | GGAACGG | | |
| | | | | | ACCAAAAC | | |
| | | | | | GCCGGTGT | | |
| | | | | | GGTGGATA | | |
| | | | | | CAGGTGG | | |
| | | | | | AAGAGTCT | | |
| | | | | | TTTGGTCT | | |
| | | | | | ACGCAAGA | | |
| | | | | | AAAGACCA | | |
| | | | | | GGCTCAAG | | |
| | | | | | TACGAATA | | |
| | | | | | CGACCGTC | | |
| | | | | | TTCGTGAA | | |
| | | | | | CGACGCCG | | |
| | | | | | TCGAGACA | | |
| | | | | | AAGTTCGA | | |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | | AATCCTAC GGTCGATA AGGCC (SEQ ID NO: 1259) | | |
| R4 | R4_AL | U29445 | *Ascaris lumbricoides* | GGGGCCGGTGGGTTTACTCACTTCTGACCCACCACCAACGGAACGAGG | GGGGCCG | TAGTCG | MPCSTNSFFERGTPE |
| | | | | GAAAGCAGAGCTGGGGCCCTCTTCCGATTGGCATGGAACCGACCTCCAC | GTGGGTTT | CTAAGG | PHREPISGTDSSESLG |
| | | | | GTGGTGGCCCTGGGCAACGGAATTCAAGAGAGGATTTAATCCTCTCTAT | ACTCACTT | GGTCCG | MGTHRSPRLNDDEVI |
| | | | | CATTTGCAAGATGGATGAGATCGAGGTATCCGGCAAACAGGTTCCAAG | CTGACCCA | GAAATG | NGPKGHESDPVHVV |
| | | | | TGAGCACCTTTCCCATAGCTGGGAATATGGGTTAGGCGTCCTCTGACAT | CCACCAAC | GTCCGG | RAPRTLHPRRLELPIG |
| | | | | ATAAGAGGAATCAGACTCGTTCGCGCCCGGTCATTAACATCGATCAGCG | GGAACGA | TCCTGC | VNNLGEASQLRQDS |
| | | | | GGAGGGCCGGACTGAAGTAAATTTCCTGTTGGCCCGAGTGCAGGTGGA | GGGAAAG | GCTACC | AIAEEAQLESTENHD |
| | | | | GCTCGGACCCGAAAAACGATCCCTAAGAGGACCACAACCCGAAGGGAT | CAGAGCTG | CGGTTC | GRRPPLRGGRKLWS |
| | | | | GGACGCAGTCGCCCCGGCACGTTTGGTGTTGGTTATCCTGGAGTGTTGT | GGGCCCTC | TGGTAG | EKEIATLRRLCEAYGN |
| | | | | GGGACGAATAGCTATGCCTTGTTCAACTAACTCTTTTTTTGAACGAGGG | TTCCGATT | CACGTTC | RQVCWKEVQRKFAD |
| | | | | ACCCCTGAGCCCCATCGTGAGCCAATCTCAGGGACTGACTCTTCGGAGT | GGCATGG | AAGCGC | FHEERTVAALATKW |
| | | | | CCTTAGGTATGGGTACCCACCGTTCACCTCGGCTAAATGATGACGAGGT | AACCGACC | TCAATC | GALKRPRAPMVGAP |
| | | | | GATAAACGGCCCCAAGGGTCACGAAAGTGACCCGGTTCATGTAGTGCG | TCCACGTG | GCCTGC | PTPDHDPERGPAGE |
| | | | | TGCGCCTCGAACGCTACACCCGAGGCGATTGGAACTCCCAATCGGAGTA | GTGGCCCT | CTTGTA | GDGGTTSQENVPTD |
| | | | | AATAATCTCGGAGAAGCCTCTCAACTACGGCAAGATTCAGCAATAGCTG | GGGCAAC | GGCAGT | DPIPANGPTEGKESD |
| | | | | AGGAAGCCCAATTGGAGAGCACCGAGAACCATGATGGACGTCGCCCTC | GGAATTCA | CCATCTG | VRPAVACRCTEPEEQ |
| | | | | CTTTGAGAGGCGGCAGGAAGCTCTGGAGTGAAAAGGAGATCGCCACAT | AGAGAGG | TGGAAG | LMESDVRPPAVVRLA |
| | | | | TAAGGAGATTGTGTGAGGCCTATGGAAATAGGCAGGTATGCTGGAAAG | ATTTAATC | TCGCGC | DPEQHTMKSGVKPV |
| | | | | AGGTTCAGAGGAAGTTTGCGGACTTCCACGAGGAAAGAACAGTGGCTG | CTCTCTAT | TCTTGAT | ALDGSADLEERPKEK |
| | | | | CGTTAGCCACGAAGTGGGGGCTCTTAAACGCCCGAGAGCTCCGATGG | CATTTGCA | ACAGAT | DIEQMGVDFEGEPRF |
| | | | | TTGGTGCGCCACCGACTCCTGATCATGATCCAGAGCGTGGACCAGCGG | AGATGGAT | GTGGAC | RAFRKAFYGYFRWA |
| | | | | GCGAGGGAGATGGAGGTACAACCTCGCAAGAGAATGTGCCTACCGATG | GAGATCGA | GGATGG | VNSFDREPVKRVRRD |
| | | | | ATCCAATACCCGCGAACGGCCCGACAGAGGGCAAGGAATCGGATGTGA | GGTATCCG | AAGCAG | CPKVFYAYADYLIATG |
| | | | | GACCAGCCGTGGCCTGTAGGTGCACGGAACCGGAGGAGCAACTGATG | GCAAACAG | ATGATA | SSKALGPNQSRIGRL |
| | | | | GAGTCGGATGTGAGACCGCCTGCAGTCGTAAGACTTGCAGATCCGGAG | GTTCCAAG | GAGCCG | NGLVYAAARTIHQF |
| | | | | CAGCATACGATGAAGTCGGGTGTGAAACCGGTTGCACTTGACGGGTCA | TGAGCACC | GTGACG | WREEVGHRQQGEK |
| | | | | GCGGATCTGGAGGAGCGTCCGAAAGAGAAGGATATCGAGCAGATGGG | TTTCCCAT | GCCCTA | GWYTKTKATREDLQ |
| | | | | TGTTGACTTTGAAGGGGAACCGAGGTTTCGTGCCTTTCGGAAAGCCTTT | AGCTGGG | CTAGCC | MLISMMESELARRKE |
| | | | | TACGGGTATTTCAGATGGGCTGTCAACTCGTTTGATAGGGAACCTGTCA | AATATGGG | AAACGC | KRKPGAKELENIHKLV |
| | | | | AGCGAGTTAGGCGGGACTGTCCCAAGGTATTTTACGCTTATGCGGATTA | TTAGGCGT | (SEQ ID | ARLGTRSTSGIVRRLE |
| | | | | CCTTATCGCAACCGGAAGTTCTAAGGCGTTGGGACCGAATCAATCCAGG | CCTCTGAC | NO: | MTRQRLKLLEDRISLH |
| | | | | ATTGGTCGCTTGAACGGATTGGTCTATGCGGCAGCTAGAACAATCCACC | ATATAAGA | 1383) | EQEKRRKRLRKQFAE |
| | | | | AATTCTGGAGAGAAGAGGTAGGCCATCGTCAGCAAGGCGAGAAGGGA | GGAATCAG | | TPSLKLLTKGAKDRG |
| | | | | TGGTACACGAAAACCAAGGCAACCCGTGAAGACCTTCAGATGCTCATCT | ACTCGTTC | | DTMVTMKSVMDFW |
| | | | | CTATGATGGAATCTGAACTTGCAAGAAGAAAGGAGAAGAGGAAGCCCG | GCGCCCGG | | RPIIGRRVTSNPDQL |
| | | | | GCGCGAAAGAGCTGGAGAATATCCATAAGCTAGTTGCAAGACTTGGAA | TCATTAAC | | QVLRDWRDEQKKAY |
| | | | | CGCGCAGCACATCGGGCATCGTCAGAAGGCTGGAGATGACAAGACAGA | ATCGATCA | | PADLDLEKADLEEKYE |
| | | | | GGCTCAAACTGTTGGAAGACAGAATAAGTTTGCATGAGCAAGAGAAGA | GCGGGAG | | GAIRRIQPWKAPGPD |
| | | | | GGCGGAAACGATTGCGCAAGCAATTTGCGGAAACCCCTTCTCTAAAATT | GGCCGGA | | GLHAHWWKALPSAK |
| | | | | ACTCACAAAAGGAGCCAAGGATAGGGGCGATACGATGGTAACCATGAA | CTGAAGTA | | RLLGELVVDWLTTGK |
| | | | | ATCTGTAATGGACTTCTGGAGACCAATAATTGGCAGACGAGTTACCTCC | AATTTCCT | | VTTGWMCRGRTILIP |
| | | | | AATCCGGACCAATTGCAAGTCTTGAGAGACTGGAGAGATGAGCAGAAG | GTTGGCCC | | KKGDRGDPSNYRPIT |
| | | | | AAGGCTTATCCGGCAGACCTGGATTTAGAAAAGGCCGATCTTGAGGAG | GAGTGCA | | CLNTCYKVLTSVMNS |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AAATATGAGGGAGCAATCAGGAGAATCCAACCGTGGAAAGCTCCCGGT | GGTGGAG | | VILSHLSRGEALPMN |
| | | | | CCCGACGGATTACATGCCCACTGGTGGAAAGCTTTACCGTCGGCCAAGA | CTCGGACC | | QRAMRKREWGCTH |
| | | | | GGCTACTGGGTGAACTGGTGGTTGATTGGCTGACAACAGGTAAGGTTA | CGAAAAAC | | AMVLDRAMVMDA |
| | | | | CCACTGGCTGGATGTGCCGAGGGAGGACAATCCTGATCCCTAAGAAGG | GATCCCTA | | MAQKKHSLSVAWLD |
| | | | | GTGATAGGGGCGACCCTTCTAATTACCGACCTATAACATGTTTAAATACA | AGAGGAC | | YRKAYDSVSHEYIRW |
| | | | | TGTTATAAGGTGCTAACATCGGTAATGAATTCAGTCATTCTGAGTCACCT | CACAACCC | | AINSVNIPRSVQLTLK |
| | | | | GAGCAGAGGCGAAGCTTTACCAATGAACCAGCGAGCAATGCGGAAACG | GAAGGGA | | RLMSDWETRFESTQ |
| | | | | CGAGTGGGGTTGCACCCACGCTATGGTCCTTGACAGGGCCATGGTAAT | TGGACGCA | | CRPKLRSDKMKVLN |
| | | | | GGATGCAATGGCTCAAAAGAAACACTCATTAAGTGTGGCCTGGCTTGAC | GTCGCCCC | | GIFQGDSLSPTLFVLCI |
| | | | | TATCGTAAAGCATACGATAGTGTGTCGCATGAATATATTCGCTGGGCGA | GGCACGTT | | APISYALNKGVGQCQ |
| | | | | TTAACTCCGTGAATATACCCCGGAGTGTTCAGCTGACGCTCAAGAGGCT | TGGTGTTG | | SSSGWSAGYGFEIGH |
| | | | | CATGAGTGACTGGGAGACACGCTTTGAGTCGACGCAATGCCGGCCGAA | GTTATCCT | | QFYMDDLKLYARTPA |
| | | | | GTTAAGGTCTGACAAAATGAAAGTGCTGAATGGCATCTTTCAAGGTGAC | GGAGTGTT | | MLDSQIQVVSEVSEA |
| | | | | TCGTTATCACCAACCCTTTTTGTATTATGCATAGCACCTATCAGCTACGCA | GTGGGAC | | MGLHLNLSKCAKAH |
| | | | | CTCAATAAGGGTGTCGGCCAGTGTCAATCCTCATCCGGCTGGAGTGCAG | GAATAGCT | | YAPHGAGGAQEAVE |
| | | | | GTTACGGTTTTGAGATTGGACATCAGTTCTATATGGACGATCTTAAACTG | (SEQ ID | | GAEGSRKGEIPILGLR |
| | | | | TACGCTAGGACGCCTGCGATGCTAGACTCCCAAATCCAGGTGGTGTCTG | NO: 1260) | | STYKYLGVEQRLLPM |
| | | | | AGGTGTCGGAAGCAATGGGACTCCATTTGAATTTGAGTAAATGTGCGA | | | EVALKEFEDKFMDRA |
| | | | | AAGCACATTATGCTCCGCATGGGGGGGGCGGAGCGCAAGAAGCTGTGG | | | ETIFASELTWGQMAT |
| | | | | AAGGTGCAGAAGGATCGAGGAAGGGAGAAATCCCGATACTCGGGCTTC | | | AYNTIAIAGLRYVYSN |
| | | | | GAAGCACCTATAAATATCTTGGAGTGGAACAACGACTCCTTCCGATGGA | | | TNGASPKLLEALKRA |
| | | | | AGTAGCCCTCAAAGAGTTCGAGGATAAGTTTATGGATCGAGCAGAAAC | | | ATLDTRIRDLLRRHKC |
| | | | | AATCTTCGCTAGCGAACTCACATGGGGGCAGATGGCCACAGCGTATAAT | | | RFRNSFVERLYIPREC |
| | | | | ACTATAGCTATCGCTGGTCTACGATACGTCTATAGTAATACAAATGGAG | | | GGYGLKSVEDTLRESI |
| | | | | CATCACCAAAGCTTCTAGAAGCCCTGAAAAGGGCGGCCACCTTAGACAC | | | LATWSYIATNPHLAG |
| | | | | GCGGATAAGAGATCTTTTGAGGCGACATAAATGTCGGTTTCGAAATAGC | | | QQYFFERLAARGKRT |
| | | | | TTTGTCGAGAGGCTGTATATCCCTAGAGAATGCGGTGGATACGGGTTAA | | | PMADGVKILLDLGVE |
| | | | | AATCAGTGGAGGATACGCTGCGAGAGAGTATCCTCGCTACGTGGAGTT | | | PQVDLKRRTVTVDGI |
| | | | | ACATCGCCACGAACCCGCATTTGGCTGGACAACAGTATTTCTTCGAGAG | | | VFEDPTKLHRYLVGKL |
| | | | | GCTTGCAGCAAGAGGCAAGCGCACCCCGATGGCGGACGGGGTAAAGA | | | LKARTEARIRRWKEA |
| | | | | TATTGTTGGATCTGGGAGTGGAACCCCAGGTGGACTTGAAGCGAAGGA | | | SLAGRLVNDTSIDMR |
| | | | | CGGTGACCGTCGACGGTATAGTCTTCGAAGACCCGACCAAGCTTCATCG | | | LSCLWMKKGFVSAR |
| | | | | ATACCTGGTGGGAAAGCTCTTAAAAGCAAGAACTGAGGCGAGGATTCG | | | NLRDALAVQEGSLLT |
| | | | | AAGATGGAAGGAAGCCAGCTTAGCTGGACGGTTGGTAAATGACACAAG | | | RACPALKGKGGQEV |
| | | | | TATTGATATGCGACTATCATGCTTGGATGAAAAAAGGTTTTGTGAGT | | | CRCCHAAPETAEHIT |
| | | | | GCGAGGAACCTCAGAGATGCGCTTGCTGTGCAAGAGGGGAGTTTGCTT | | | SACRYWLPSLYVERH |
| | | | | ACTAGAGCATGCCCTGCTCTAAAGGGTAAAGGCGGCCAAGAAGTTTGC | | | DSVARNLYYVICCRY |
| | | | | CGGTGTTGCCATGCAGCGCCGGAAACTGCAGAGCACATAACATCAGCCT | | | GITPVHYSNRVSPLSE |
| | | | | GCCGCTATTGGCTTCCAAGTCTCTACGTTGAGAGACATGACTCGGTAGC | | | NSQCRVLWNMDM |
| | | | | AAGGAACCTCTATTACGTCATATGCTGCCGCTACGGCATAACACCGGTG | | | QTRTPMKHRKPDIVV |
| | | | | CATTACTCAAATAGGGTATCACCGCTCTCGGAGAATAGCCAATGCCGCG | | | FDLKREKILMFEVSIA |
| | | | | TTCTTTGGAACATGGATATGCAGACTCGGACGCCAATGAAGCATCGAAA | | | HASGLLKQREIKINRY |
| | | | | GCCTGATATAGTCGTCTTTGATCTCAAGAGGGAAAAGATCCTCATGTTC | | | TVNSEELPDETITPYP |
| | | | | GAAGTTTCGATAGCCCATGCCAGCGGGTTATTGAAACAGCGGGAAATC | | | PGPNLAADLAATYG |
| | | | | AAGATCAATCGGTATACGGTGAACTCCGAAGAGTTGCCTGATGAGACCA | | | WQVEFAPVVVGTCG |
| | | | | TAACACCGTATCCGCCTGGGCCGAATTTGGCCGCTGACCTCGCTGCCAC | | | EHVPAVKEDLQRTLD |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CTATGGTTGGCAGGTTGAATTTGCCCCAGTGGTGGTTGGCACGTGTGGT<br>GAGCACGTACCAGCCGTCAAAGAGGACCTGCAAAGAACGTTGGATCTA<br>AAACCTCATCAAGTCGAAGCCCTTCTTGAAAGGATATCCCGATCGGCGG<br>TGATCGGAACGGCTAGAGTAGTCCGAGCACACCTCGCCTGCTCCTAGTC<br>GCTAAGGGGTCCGGAAATGGTCCGGTCCTGCGCTACCCGGTTCTGGTA<br>GCACGTTCAAGCGCTCAATCGCCTGCCTTGTAGGCAGTCCATCTGTGGA<br>AGTCGCGCTCTTGATACAGATGTGGACGGATGGAAGCAGATGATAGAG<br>CCGGTGACGGCCCTACTAGCCAAACGC (SEQ ID NO: 1137) | | | LKPHQVEALLERISRS<br>AVIGTARVVRAHLAC<br>S (SEQ ID NO: 1505) |
| R4 | R4_Hmel | — | *Heliconius melpomene* | ATAAATAATAATAATAATAATAATAATAAGCCCCCTAAAATCCAACCATA<br>CGTCCGAGTCGAACATCTGATTCTCGTGGGGGGCGGACACGTGAAAAT<br>AAATTACTTACACGGCTAACATGGCTCTGGTAACCCTTTTTATGGAGAAT<br>ATGGAAAATAAAAGATATAATTTGCGGCCGCTACCCGGGGGTCGCCGG<br>GGCGCATCTGGAGCTAACGCTGGATGCCACAGCATGCGAACCGTTGGC<br>GACGGGGGACTGAGCAGGCGGGTTCCCCTCGAAAAAAATGTTACAGCC<br>GAACAATCATCCTCACCACTCACTTCTTCTTCCTCTCATTCACCGGTATCA<br>AGCATACCCTCACCATCCTCAACTCGCACCCTATTAAATTCCCCTAATTCA<br>TCACCAACATCATCACATTCATCACTGGTTATAAGGTCAGCAGATGTTGT<br>GCAGGAGGCACTTGCCAATTACCCTGCACCCACTGCGGGCTCTATTCGT<br>GCGCGAAAAAAATGGACCGACATAATGAACCGTTATATTTGGCGCACAT<br>ATCTTATTATAACAAAATGCGAAACCACGTTATTGAATAATTATTTAGAA<br>CCCCTACATCAAGAATTTAGTAGTAAATTTCCCGAAATGCAGGTAACTAG<br>ACAACGTATAGGAGATCAACGTAGAGCAATAATAAGAAATAAACTACTA<br>TCAGATGATACCTTAGCTCAAATTTTAATTGAAGTAAAAGAACTATTACA<br>AATCGGTGATCAACCACTTACACAAAATAACATTCATTCAACTCAACTTT<br>CACACTCAAACACTAGAATAAAATGGTCAAACGAACTTAATGAAGAAAT<br>TGTCAAATGTTACTTTGAAGTCACCCTACTTGAAGTTAATAAGACTTCTT<br>ATCGTAAAAACCTGTACAGTTTATTTATATCTAGAAATCCACACCTATCA<br>CACCTTACAGAACAAAGAATAGCTGACCAAAGACGACTAATATTTATGA<br>ACAAAAGTGTACACAACGATAGAATTATTGAATTAAAAAGAGAAGTAG<br>AAATTAAATTAGCTAACAGTAATTCTTTAACAAAAAATATTACAGAGTCA<br>AATTCTCCTAGCAGTCAAACAAATGAAATAAATGATTCTGCATATGTACA<br>AAGTAATTTACAACCCGTTGAACCACTAGACCAACATTGTATAAATAGAC<br>ACAATTTAATAGAAAAACATTATGTTGAACAAGAATTTAATAATGCTTTA<br>ATTCAATTTAACAATACAAATCCTGAAACCAGACCCTATATACCAAGACA<br>AAAGTCATCGCGTAAATTTTCCCAAATTGTCAGTTTCTTAAATAGTGAAG<br>TACTTCCAAAACATTTAAATAACGAATTAGATTTCAATGCTCTTCATAACA<br>TTATATATACMGCTGYCTACACTGCATCTCTGTGTAATGGAACAAAATTC<br>AGTTTTATTGATAATTACCGACCTCGTAACAGCAAGCCATCGTGGCAAA<br>GAAGACTTGAAAGTAGAATAGACAAATATAGATTGCAAATAGGTAGAC<br>TTACACAATATATATCAGGAAATAGGAACCGTAAAATATTAAAAACTGT<br>AGAAGAAATAAAAACACAATATAAAATTCATTCACATCACGAAGAACCT<br>AATACAGAATTACCACATTTCTTAGACACACTAAAACAAAAATTAAATGC<br>AACTTCGAACAGACTTAGAAGATATTTGACATGTACAAAACGGAAGCAA<br>CAAAATAATACATTCGTTAATAACGAAAAACATTTTTATAGAACTCTATC<br>TAGCACAAACCAAAATACCACAACACAATTACWAGAACATCCAACGGA<br>AAATAATTTGCAACAATACTGGGCCAATATTTGGGAAACTTCAATAGAA<br>CAYAATGCAGACGCAGAATGGTTAAATAAAATACCTGACKTAGAAATAA<br>ATKTAATGAAATTCAAAGATATATCCATAGAAACATTCAATCAAATCATC | ATAAATAA<br>TAATAATA<br>ATAATAAT<br>AATAAGCC<br>CCCTAAAA<br>TCCAACCA<br>TACGTCCG<br>AGTCGAAC<br>ATCTGATT<br>CTCGTGGG<br>GGGCGGA<br>CACGTGAA<br>AATAA<br>(SEQ ID<br>NO: 1261) | TAACTTA<br>TTGTCA<br>GAATTC<br>CTTACTA<br>GTAATA<br>ATAATTA<br>TCGCTG<br>AAAATC<br>TCCACCC<br>AAATATT<br>GCTTGG<br>CTATATG<br>CTCGCA<br>ATTTTTG<br>GTTAAC<br>GTACCC<br>CAATGA<br>TTTGGG<br>AGAACA<br>AAAATG<br>GTAAAA<br>CTATAAT<br>AATAAT<br>AATTATA<br>TTAATAT<br>(SEQ ID<br>NO:<br>1384) | ITYTANMALVTLFME<br>NMENKRYNLRPLPG<br>GRRGASGANAGCHS<br>MRTVGDGGLSRRVP<br>LEKNVTAEQSSSPLTS<br>SSSHSPVSSIPSPSSTR<br>TLLNSPNSSPTSSHSS<br>LVIRSADVVQEALAN<br>YPAPTAGSIRARKKW<br>TDIMNRYIWRTYLIIT<br>KCETTLLNNYLEPLHQ<br>EFSSKFPEMQVTRQR<br>IGDQRRAIIRNKLLSD<br>DTLAQILIEVKELLQIG<br>DQPLTQNNIHSTQLS<br>HSNTRIKWSNELNEE<br>IVKCYFEVTLLEVNKT<br>SYRKNLYSLFISRNPH<br>LSHLTEQRIADQRRLI<br>FMNKSVHNDRIIELK<br>REVEIKLANSNSLTKN<br>ITESNSPSSQTNEIND<br>SAYVQSNLQPVEPLD<br>QHCINRHNLIEKHYV<br>EQEFNNALIQFNNTN<br>PETRPYIPRQKSSRKF<br>SQIVSFLNSEVLPKHL<br>NNELDFNALHNIIYTA<br>XYTASLCNGTKFSFID<br>NYRPRNSKPSWQRR<br>LESRIDKYRLQIGRLT<br>QYISGNRNRKILKTVE<br>EIKTQYKIHSHHEEPN<br>TELPHFLDTLKQKLNA<br>TSNRLRRYLTCTKRK<br>QQNNTFVNNEKHFY<br>RTLSSTNQNTTTQLX<br>EHPTENNLQQYWAN<br>IWETSIEHNADAEWL<br>NKIPDXEINXMKFKDI |

TABLE 3-continued

| 1. Family | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | CAGCGAACACACAATTGGAAGGCACCGGGAACCGATAATATACACAAC<br>TAYTGGTACAAAAAGCTAACATGCACTCATTCACTTCTTCTTAAACACAT<br>AAACCAGTTCATACAATCACCTTGCACACTACCTTTATTTATAACAAACG<br>GAATAACGTATATGTTACCGAAAGGCTTAGATCCCACAAACCCAGCTAA<br>CTATAGGCCAATAACATGCCTCCAAACGATATATAAAATTATCACTGCGT<br>GTATTACTGACATAATTTATAAACATATCGATCAAAATAACATATTAGCT<br>GAACAACAGAAAGGCTGTAGGAAAAATAGTCAAGGGTGTAAAGAGCA<br>GCTTACTATAGACGCAATAGTTATGAAACAGGCACATAATAAAAATAHT<br>AATACRATGTATATAGACTACAGAAAAGCATTTGATTCAGTTCCACACA<br>GTTGGTTACTATATATTTTAAAAAAGTACAAGATTCACCCCATTCTAATA<br>ACATTTTTAAGCTCCGTYATGCTCTCATGGAAAACTAGATTAAAATTGAT<br>TAACAATAATGAAACACTGATTACTGATTGGATTAAAATACAACGAGGC<br>ATCTTTCAAGGTGATGCGCTGAGTCCATTATGGTTCTGTCTAGCGTTAAA<br>CCCTCTCTCTGAATTGCTTAATAATACCAATACAGGATTTAAACTAAAAC<br>ATAATAACACATATCATATAATTTCACATTTAATGTACATGGACGATATC<br>AAACTATACGCCAGTAATAATAAAGAACTAAAAATACTAGCCGACCTCA<br>CACAATCCTTCTCTACAGACATACGCATGGAATTTGGAATTGAAAAATGC<br>AAGGTACATTCAATTAAACGTGGCAAATCACAACAAAATACATATATAC<br>TTAACACTGGTGAACAAATTGAATCAATGGACGAAAATAGCACGTATAA<br>ATACCTTGGATTTCAACAAGCTAAGCAAATACAACAAAAACAAACCAAG<br>ATAGAACTAACCAATAAATTTAAATTTCGTTTGAATCAAATTTTAAGATC<br>ACAATTAAACTCACGTAATATTATAAAAGCCATCAACACATACGCAATAC<br>CGATCCTTACTTACTCTTTTGCTATAATAAACTGGTCTCAAACTGATTTAT<br>CGAATCTGCAACGTATAATAAATACACACATGACTACACATAGGAAACA<br>TCACCCTAAATCATGTATCCAGCGTCTAACTATATCACGTCTGGATGGAG<br>GACGAGGTCTCATTGATATTCGTAACCTACATAATAATCTAGTGACTAAA<br>TTCCGAAATTACTTTTACGCTAAGGCTGAAATTAGTGAACTACACAAATT<br>CATAGTTAATATAGATAATAAATATACACCACTTAATTTAAACGATAGAA<br>ATATACAACTAAATCAAACTTTGATAACTAAGCAGCAAAAAATAGAAGC<br>ATGGTCTTTAAAGTCACTACACGGTAGACATCTAGCCGATCTTAGCCAA<br>ACTCACGTCGACAAAGTTGCGTCGAACGAATGGCTACGACGGGGAGAT<br>CTCTTCCCAGAGACGGAAGCCTTCATGATGGCTATTCAGGACCAAGTAA<br>TAGACACTAGGAACTATCAAAAACACATCATAAAAAGACCAAATATGGT<br>AAACGATTTATGCAGAAGATGCTATTCTAGTCCTGAAACAATCCAACAC<br>ATTACCGGAGCCTGTAAAACCATAGTACAAACCGATTACAAACATAGAC<br>ATGATCAGGTCGCTGCAATTATTCATCAACACCTAGCATTTAAACATTCT<br>CTCATCACACAAGCACAAAAAACTCCCTATTACAAATATTCACCTCAGGC<br>TATTTTAGAATCTACAAATTTTAAGCTGTATTGGGATCGTACAATCATCA<br>CAGATAAAACCGTACACTACAATAGACCGGATATTTTACTTCATGATAAA<br>GTWAAAAWTTCTGTATACTTGATAGACATAGCCATTCCAAATACACACA<br>ATCTTGCATCCACTTTTTCAAACAAAATAGATAAGTATACAGATTTAACC<br>ATAGAGCTCAAAAGTCAATGGAAAGTCCAATCCGTCACTACAGTACCAA<br>TAGTTCTTTCAACAACCGGAGTAGTACCTCATACGCTACACACGAGTCTG<br>GAAACTTTGGGTATTCACCGGTTAAGTTATATTCTTTTACAGAAAGCCGC<br>AATCTTAAATACATGCCGTATAGTTAGGAAGTTTTTATCATCAAATAATT | | | SIETFNQIIQRTHNW<br>KAPGTDNIHNYWYK<br>KLTCTHSLLLKHINQFI<br>QSPCTLPLFITNGITY<br>MLPKGLDPTNPANY<br>RPITCLQTIYKIITACIT<br>DIIYKHIDQNNILAEQ<br>QKGCRKNSQGCKEQ<br>LTIDAIVMKQAHNKN<br>XNTMYIDYRKAFDSV<br>PHSWLLYILKKYKIHPI<br>LITFLSSVMLSWKTRL<br>KLINNNETLITDWIKI<br>QRGIFQGDALSPLWF<br>CLALNPLSELLNNTNT<br>GFKLKHNNTYHIISHL<br>MYMDDIKLYASNNK<br>ELKILADLTQSFSTDIR<br>MEFGIEKCKVHSIKR<br>GKSQQNTYILNTGEQ<br>IESMDENSTYKYLGF<br>QQAKQIQQKQTKIEL<br>TNKFKFRLNQILRSQL<br>NSRNIIKAINTYAIPILT<br>YSFAIINWSQTDLSNL<br>QRIINTHMTTHRKHH<br>PKSCIQRLTISRLDGG<br>RGLIDIRNLHNNLVTK<br>FRNYFYAKAEISELHK<br>FIVNIDNKYTPLNLND<br>RNIQLNQTLITKQQKI<br>EAWSLKSLHGRHLAD<br>LSQTHVDKVASNEW<br>LRRGDLFPETEAFM<br>MAIQDQVIDTRNYQ<br>KHIIKRPNMVNDLCR<br>RCYSSPETIQHITGAC<br>KTIVQTDYKHRHDQV<br>AAIIHQHLAFKHSLIT<br>QAQKTPYYKYSPQAI<br>LESTNFKLYWDRTIIT<br>DKTVHYNRPDILLHD<br>KVKXSVYLIDIAIPNTH<br>NLASTFSNKIDKYTDL<br>TIELKSQWKVQSVTT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | AACTTATTGTCAGAATTCCTTACTAGTAATAATAATTATCGCTGAAAATC<br>TCCACCCAAATATTGCTTGGCTATATGCTCGCAATTTTTGGTTAACGTAC<br>CCCAATGATTTGGGAGAACAAAAATGGTAAAACTATAATAATAATAATT<br>ATATTAATAT (SEQ ID NO: 1138) | | | VPIVLSTTGVVPHTLH<br>TSLETLGIHRLSYILLQ<br>KAAILNTCRIVRKFLSS<br>NN (SEQ ID NO:<br>1506) |
| R4 | Rex6 | — | *Takifugu rubripes* | TTCTATGCGCCTTATGCGACTGGATAGGCCAGTGGTTTACGCCGCTGAC<br>TTTGGTGCGGAAGGTTGTCGGTTCGAATCCAGGCGAGCCCTTAGGCAA<br>GGCTCCTTACGCATATATGCCTACACCTCGGTATGAGCGGAACMWTAA<br>CTGATAGAGTCATACCGGCTCGGACGTCGCCCGGGTCAACAAGGTCCG<br>CGTCAGGGGTCGGGGAACCAGGGCCACCTGATGTCAAATTGGCTACTG<br>GAACAAGGCATTCATGGAGCAGGGCAGAGAACGTGGTACTGATGGAG<br>TGTTACTACGGGAGTAACCCCAGCGAGAGAGGGTACATGCAGAGGATG<br>TGGGAGAAATGGGTGCTTCGAAACCCCACATCCTCACTGACTAAGAAGC<br>AGCTCTTAGCTCAGTGTTCGAATATCCGCAATAAGAAGCTGCTATCACA<br>GCTAGAGATTGACGAGGCACGGCGNTGTGCCTCACCCACGGTACAAAT<br>ATGCTACGGCAAGGGGGAGCCAGGACGCCAGGTCAGCNTGGGGGTGA<br>TTTCATCATCACCCCCCAATATCGAGATTGGGTACAAAGCCCCAATGACA<br>GACGGACTCGGCACAAGGGCAGCTGACCTGAGAGAGAGAATCATGAA<br>GTCCTGGGGGAACTCAACTACCTCCCTGCCAAGGCTAACACACAAAGTA<br>CCAGACCAATCTCTACTGGAGGACATGAACACGGCACTGTCAACCATCC<br>CTACCACTACCATCACTGAGACCAATCAGCTGATGTATGCAGCGGCAAC<br>AGTAATCCTACAGATGCTTGGCTATAAGATGAAGAGCATGAACAGCCAG<br>AAGGAGCAAATGGCCCCATGGAGGAGAAGGCTAGAGGCAAAAATCAT<br>GGCGACACGGAGAGAAGTCAGCCTTCTAACAGAGCTGAGTAGAGGCGT<br>GAATCTAAGGACAGAGCNGCCCAAGAAATATAACAAACTGTCCACAACT<br>GAGGCACTGGAGACTGCTAAGCAAAGGCTCACAGCCCTGGCTACCCGA<br>CTAAAGAGGTACACAAGAGAAGTAGAGGCAAGGAGAATAAACAAGGT<br>GTTCTCCACCAATCCAGCNAAGGTCTACTCTCAATGGCAGGGCAACAAG<br>ATGACAACAGACCCCCCCAGGGCTGAGACTGAGCAATACTGGAAGAGT<br>ATCTGGGAGAAAGAGGCAACGCACAACACTANTGCCCAATGGCTGCAA<br>GACCTACAGACAGAGCACAGCCAACTTCCAGAACAAGACCCAGTAGTCA<br>TCACCTTAGCAGACATCCAAACAAGAGTGTCCAAAATGAAGAGCTGGAC<br>AGCACCAGGGCCCGATAAGATCCACGCCTACTGGCTTAAGAAGCTGACT<br>GCACTCCATGAACGCCTGGCAGCACAGATGAACCAGCTGCTAACATCAG<br>GGAACCACCCAGAGTGGCTAACCCAGGGCCGGACAGTCCTCATAATGA<br>AGGACCCCCAGAAGGGCACAATACCATCCAACTACCGGCCCATAACCTG<br>CCTCAGCACCACATGGAAGCTCCTATCAGGCATCATAGCGGCTAAGATC<br>AGTAGGCACATGGATCAATACATGAGCAGAGCACAGAAAGGCATAGGC<br>AACAACACCAGAGGTGCCAAGCACCAGCTACTGGTCGACAGGGCAATC<br>GCCCAGGACTGTAGGACGCGGCACACCAACCTGTGCACTGCCTGGATT<br>GATTACAAGAAAGCCTATGACTCAATGCCGCACACATGGATACTGGAGT<br>GCCTAAAGCTGTATAACATCAACAGGACACTAAGAGAGTTCATCCAGAA<br>CTCCATGAAGCTGTGGAACACGACTCTGGAGGCCAACTCAAAGCCAATT<br>GCGCGGGTGAGCATCAGATGCGGCATATATCAAGGAGATGCCCTGTCC<br>CCCCTGCTGTTCTGCATAGGCCTAAACCCCCTCAGCCAGATCATCACAAA<br>GAGTGGCTATGGGTACCAGTTCCGAAGTGGAACAACCGTCAGCCACCTC<br>CTCTACATGGATGACATCAAGCTGTATGCCAAGAACGAGCGTGACATCG<br>ACTCCCTGATTCACCTCACTAGGATCTACAGCAAAGACATCGGGATGTC | TTCTATGC<br>GCCTTATG<br>CGACTGGA<br>TAGGCCAG<br>TGGTTTAC<br>GCCGCTGA<br>CTTTGGTG<br>CGGAAGG<br>TTGTCGGT<br>TCGAATCC<br>AGGCGAG<br>CCCTTAGG<br>CAAGGCTC<br>CTTACGCA<br>TATATGCC<br>TACACCTC<br>GGT (SEQ<br>ID NO:<br>1262) | TAGAGG<br>ACCCGA<br>GTCTGA<br>AGGAAG<br>GAGGCA<br>CCGCCC<br>AGGAGG<br>GCGAGG<br>AAGAGA<br>TTTTTTT<br>TTATATA<br>TATATAT<br>ATATATA<br>TA (SEQ<br>ID NO:<br>1385) | MSGTXTDRVIPARTS<br>PGSTRSASGVGEPGP<br>PDVKLATGTRHSWS<br>RAENVVLMECYYGS<br>NPSERGYMQRMWE<br>KWVLRNPTSSLTKKQ<br>LLAQCSNIRNKKLLSQ<br>LEIDEARRCASPTVQI<br>CYGKGEPGRQVSXG<br>VISSSPPNIEIGYKAP<br>MTDGLGTRAADLRE<br>RIMKSWGNSTTSLPR<br>LTHKVPDQSLLEDM<br>NTALSTIPTTTITETN<br>QLMYAAATVILQML<br>GYKMKSMNSQKEQ<br>MAPWRRRLEAKIMA<br>TRREVSLLTELSRGVN<br>LRTEXPKKYNKLSTTE<br>ALETAKQRLTALATRL<br>KRYTREVEARRINKVF<br>STNPAKVYSQWQGN<br>KMTTDPPRAETEQY<br>WKSIWEKEATHNTX<br>AQWLQDLQTEHSQL<br>PEQDPVVITLADIQTR<br>VSKMKSWTAPGPDK<br>IHAYWLKKLTALHERL<br>AAQMNQLLTSGNHP<br>EWLTQGRTVLIMKD<br>PQKGTIPSNYRPITCL<br>STTWKLLSGIIAAKISR<br>HMDQYMSRAQKGI<br>GNNTRGAKHQLLVD<br>RAIAQDCRTRHTNLC<br>TAWIDYKKAYDSMP<br>HTWILECLKLYNINRT<br>LREFIQNSMKLWNTT<br>LEANSKPIARVSIRCGI<br>YQGDALSPLLFCIGLN<br>PLSQIITKSGYGYQFR<br>SGTTVSHLLYMDDIK<br>LYAKNERDIDSLIHLT |

TABLE 3-continued

| 1. Fam-ily | 2. Element | 3. Accession | 4. Organism | 5. DNA Sequence | 6. Predicted 5'UTR | 7. Predicted 3'UTR | 8. Predicted Amino Acid Sequence |
|---|---|---|---|---|---|---|---|
| | | | | ATTCGGACTAGATAAATGTGGGCGGATGATATCTAGAAGAGGAAAGGT | | | RIYSKDIGMSFGLDKC |
| | | | | GATCGCAACTGATGGGGTTGAACTACCTGAAGGGAACATCACAGATGT | | | GRMISRRGKVIATDG |
| | | | | GCAGGACAGTTACAAATACCTGGGGATCCCGCAGGCAAATGGTAACCA | | | VELPEGNITDVQDSY |
| | | | | TGAGGAGGCAGCTAGGAGGTCAGCCACAGCCAAATACCTACAGAGGTT | | | KYLGIPQANGNHEEA |
| | | | | AAGGCAGGTCCTGAAAAGTCAGCTGAATGGTAAGAATAAGATCCAGGC | | | ARRSATAKYLQRLRQ |
| | | | | CATAAACACCTACGCCCTGCCAGTAATCAGATACCCTGCTGGCATAATAC | | | VLKSQLNGKNKIQAI |
| | | | | CCTGGCCACTGGAAGAGATACAAGCCACTGACATCAAGACAAGGAAGC | | | NTYALPVIRYPAGIIP |
| | | | | TGAATGGTAAGCATAAGATCCAGGCCATAAACACCTACGCCCTGCCAGT | | | WPLEEIQATDIKTRKL |
| | | | | AATCAGATACCCTGCTGGCATAATACCCTGGCCACTGGAAGAGATACAA | | | NGKHKIQAINTYALP |
| | | | | GCCACTGACATCAAGACAAGGAAGCTCCTCACCATGCACGGAGGGTTTC | | | VIRYPAGIIPWPLEEI |
| | | | | ACCCTAAGTCCAGCGTCCTGAGGCTGTACACGAAGCGAAAGGAAGGGG | | | QATDIKTRKLLTMHG |
| | | | | GCCGAGGACTAGTAAGTGTCCGAACTACTGTCCAGGAGGAAACAACAA | | | GFHPKSSVLRLYTKRK |
| | | | | GCCTCCGAGAATACATCAAGAAGATGGCCCCCACTGACCGACTGCTGAG | | | EGGRGLVSVRTTVQE |
| | | | | TGAATGCCTCAGGCAACAAAAGCCCACCAAGGAGGAGGAGCCTGAGG | | | ETTSLREYIKKMAPTD |
| | | | | GGCTATCATGGAAGGACAAGCCCCTGCATGGNATGTACCACCGACAAA | | | RLLSECLRQQKPTKEE |
| | | | | TTGAGGAAGTGGCTGATATCGAGAAAACATACCAGTGGCTGGAAAAGG | | | EPEGLSWKDKPLHG |
| | | | | CCGGACTGAAAGACAGCACAGAGGCACTACTCATGGCTGCACAAGAAC | | | MYHRQIEEVADIEKT |
| | | | | AGGCCCTGAGCACCAGAGCAATAGAGGCCAGGGTCTACCATACCAGAC | | | YQWLEKAGLKDSTEA |
| | | | | AAGACCCCAGGTGCAGGCTGTGTGGAGACGCCCCTGAGACAGTCCAGC | | | LLMAAQEQALSTRAI |
| | | | | ACATCACAGCAGGGTGCAAGATGTTGGCAGGCAAGGCATACATGGAGC | | | EARVYHTRQDPRCRL |
| | | | | GGCATAACCAGGTGGCTGGCATAGTGTACAGGAACATCTGCACTGAGT | | | CGDAPETVQHITAGC |
| | | | | ATGGACTGGAGGTCCCAGGGTCCAGGTGGGAGACACCCCCGAAAGTGC | | | KMLAGKAYMERHN |
| | | | | TGGAGAACAAGCAGGCCAAGATCCTGTGGGACTTCCAGATCCAGACTG | | | QVAGIVYRNICTEYGL |
| | | | | ACAAGATGGTGGTGGCCAACCAGCCTGACATAGTGGTGGTGGATAAAC | | | EVPGSRWETPPKVLE |
| | | | | ACCAGAAGACAGTGGTGGTGATAGATGTAGCAATCCCAAGTGATAGCA | | | NKQAKILWDFQIQTD |
| | | | | ACATCAGGAAGAAGGAACACGAGAAGCTGGAGAAGTACCAAGGGCTG | | | KMVVANQPDIVVVD |
| | | | | AAGGAGGAGATGGAGAGAATGTGGGGCATGAAGGCAACAGTGGTCCC | | | KHQKTVVVIDVAIPS |
| | | | | AGTAGTGATTGGGACACTAGGGGCAGTAACACCCAAGCTGAGTAGATG | | | DSNIRKKEHEKLEKYQ |
| | | | | GCTCCAACAGATACCAGGAACCACATCAGAGATCTCTGTCCAGAAGAGC | | | GLKEEMERMWGMK |
| | | | | GCAGTCCTAGGAACAGCTAAGATCCTGCGCAGAACCCTCAGACTCCCAG | | | ATVVPVVIGTLGAVT |
| | | | | GCCTCTGGTAGAGGACCCGAGTCTGAAGGAAGGAGGCACCGCCCAGG | | | PKLSRWLQQIPGTTS |
| | | | | AGGGCGAGGAAGAGATTTTTTTTTATATATATATATATATATATA (SEQ | | | EISVQKSAVLGTAKIL |
| | | | | ID NO: 1139) | | | RRTLRLPGLW (SEQ |
| | | | | | | | ID NO: 1507) |

Gene Writers, e.g. Thermostable GENE WRITER™ Genome Editor Polypeptides

While not wishing to be bound by theory, in some embodiments, retrotransposases that evolved in cold environments may not function as well at human body temperature. This application provides a number of thermostable GENE WRITER™ genome editor polypeptides, including proteins derived from avian retrotransposases. Exemplary avian transposase sequences in Table 3 include those of Taeniopygia guttata (zebra finch; transposon name R2-1_TG), *Geospiza fortis* (medium ground finch; transposon name R2-1_Gfo), *Zonotrichia albicollis* (white-throated sparrow; transposon name R2-1_ZA), and Tinamus guttatus (white-throated tinamou; transposon name R2-1_TGut).

Thermostability may be measured, e.g., by testing the ability of a GENE WRITER™ to polymerize DNA in vitro at a high temperature (e.g., 37° C.) and a low temperature (e.g., 25° C.). Suitable conditions for assaying in vitro DNA polymerization activity (e.g., processivity) are described, e.g., in Bibillo and Eickbush, "High Processivity of the Reverse Transcriptase from a Non-long Terminal Repeat Retrotransposon" (2002) JBC 277, 34836-34845. In some embodiments, the thermostable GENE WRITER™ polypeptide has an activity, e.g., a DNA polymerization activity, at 37° ° C. that is no less than 70%, 75%, 80%, 85%, 90%, or 95% of its activity at 25° C. under otherwise similar conditions.

In some embodiments, a GENE WRITER™ polypeptide (e.g., a sequence of Table 1, 2, or 3 or a sequence having at least 70%, 75%, 80%, 85%, 90%, 95%, 96%, 97%, 98%, or 99% identity thereto) is stable in a subject chosen from a mammal (e.g., human) or a bird. In some embodiments, a GENE WRITER™ polypeptide described herein is functional at 37° C. In some embodiments, a GENE WRITER™ polypeptide described herein has greater activity at 37° C. than it does at a lower temperature, e.g., at 30° C., 25° C., or 20° C. In some embodiments, a GENE WRITER™ polypeptide described herein has greater activity in a human cell than in a zebrafish cell.

In some embodiments, a GENE WRITER™ polypeptide is active in a human cell cultured at 37° C., e.g., using an assay of Example 6 or Example 7 herein.

In some embodiments, the assay comprises steps of: (1) introducing HEK293T cells into one or more wells of 6.4 mm diameter, at 10,000 cells/well, (2) incubating the cells at 37° ° C. for 24 hr, (3) providing a transfection mixture comprising 0.5 μl if FuGENE® HD transfection reagent and 80 ng DNA (wherein the DNA is a plasmid comprising, in order, (a) CMV promoter, (b) 100 bp of sequence homologous to the 100 bp upstream of the target site, (c) sequence encoding a 5' untranslated region that binds the GENE WRITER™ protein, (d) sequence encoding the GENE WRITER™ protein, (e) sequence encoding a 3' untranslated region that binds the GENE WRITER™ protein (f) 100 bp of sequence homologous to the 100 bp downstream of the target site, and (g) BGH polyadenylation sequence) and 10 μl Opti-MEM and incubating for 15 min at room temperature, (4) adding the transfection mixture to the cells, (5) incubating the cells for 3 days, and (6) assaying integration of the exogenous sequence into a target locus (e.g., rDNA) in the cell genome, e.g., wherein one or more of the preceding steps are performed as described in Example 6 herein.

In some embodiments, the GENE WRITER™ polypeptide results in insertion of the heterologous object sequence (e.g., the GFP gene) into the target locus (e.g., rDNA) at an average copy number of at least 0.01, 0.025, 0.05, 0.075, 0.1, 0.15, 0.2, 0.25, 0.3, 0.4, 0.5, 0.75, 1, 1.25, 1.5, 1.75, 2, 2.5, 3, 4, or 5 copies per genome. In some embodiments, a cell described herein (e.g., a cell comprising a heterologous sequence at a target insertion site) comprises the heterologous object sequence at an average copy number of at least 0.01, 0.025, 0.05, 0.075, 0.1, 0.15, 0.2, 0.25, 0.3, 0.4, 0.5, 0.75, 1, 1.25, 1.5, 1.75, 2, 2.5, 3, 4, or 5 copies per genome.

In some embodiments, a GENE WRITER™ causes integration of a sequence in a target RNA with relatively few truncation events at the terminus. For instance, in some embodiments, a GENE WRITER™ protein (e.g., of SEQ ID NO: 1016) results in about 25-100%, 50-100%, 60-100%, 70-100%, 75-95%, 80%-90%, or 86.17% of integrants into the target site being non-truncated, as measured by an assay described herein, e.g., an assay of Example 6 and FIG. 8. In some embodiments, a GENE WRITER™ protein (e.g., of SEQ ID NO: 1016) results in at least about 30%, 40%, 50%, 60%, 70%, 80%, or 90% of integrants into the target site being non-truncated, as measured by an assay described herein. In some embodiments, an integrant is classified as truncated versus non-truncated using an assay comprising amplification with a forward primer situated 565 bp from the end of the element (e.g., a wild-type transposon sequence, e.g., of *Taeniopygia guttata*) and a reverse primer situated in the genomic DNA of the target insertion site, e.g., rDNA. In some embodiments, the number of full-length integrants in the target insertion site is greater than the number of integrants truncated by 300-565 nucleotides in the target insertion site, e.g., the number of full-length integrants is at least 1.1×, 1.2×, 1.5×, 2×, 3×, 4×, 5×, 6×, 7×, 8×, 9×, or 10× the number of the truncated integrants, or the number of full-length integrants is at least 1.1×-10×, 2×-10×, 3×-10×, or 5×-10× the number of the truncated integrants.

In some embodiments, a system or method described herein results in insertion of the heterologous object sequence only at one target site in the genome of the target cell. Insertion can be measured, e.g., using a threshold of above 1%, 1.5%, 2%, 2.5%, 3%, 3.5%, 4%, 4.5%, 5%, e.g., as described in Example 8. In some embodiments, a system or method described herein results in insertion of the heterologous object sequence wherein less than 1%, 1.5%, 2%, 2.5%, 3%, 3.5%, 4%, 4.5%, 5%, 10%, 20%, 30%, 40%, or 50% of insertions are at a site other than the target site, e.g., using an assay described herein, e.g., an assay of Example 8.

In some embodiments, a system or method described herein results in "scarless" insertion of the heterologous object sequence, while in some embodiments, the target site can show deletions or duplications of endogenous DNA as a result of insertion of the heterologous sequence. The mechanisms of different retrotransposons could result in different patterns of duplications or deletions in the host genome occurring during retrotransposition at the target site. In some embodiments, the system results in a scarless insertion, with no duplications or deletions in the surrounding genomic DNA. In some embodiments, the system results in a deletion of less than 1, 2, 3, 4, 5, 10, 50, or 100 bp of genomic DNA upstream of the insertion. In some embodiments, the system results in a deletion of less than 1, 2, 3, 4, 5, 10, 50, or 100 bp of genomic DNA downstream of the insertion. In some embodiments, the system results in a duplication of less than 1, 2, 3, 4, 5, 10, 50, or 100 bp of genomic DNA upstream of the insertion. In some embodiments, the system results in a duplication of less than 1, 2, 3, 4, 5, 10, 50, or 100 bp of genomic DNA downstream of the insertion.

In some embodiments, a GENE WRITER™ described herein, or a DNA-binding domain thereof, binds to its target site specifically, e.g., as measured using an assay of Example 21. In some embodiments, the GENE WRITER™ or DNA-binding domain thereof binds to its target site more strongly than to any other binding site in the human genome. For example, in some embodiments, in an assay of Example 21, the target site represents more than 50%, 60%, 70%, 80%, 90%, or 95% of binding events of the GENE WRITER™ or DNA-binding domain thereof to human genomic DNA.

Genetically Engineered, e.g., Dimerized GENE WRITER™ Genome Editor Polypeptides

Figures 17A, 17B, 17C, 17D, 17E, 17F:
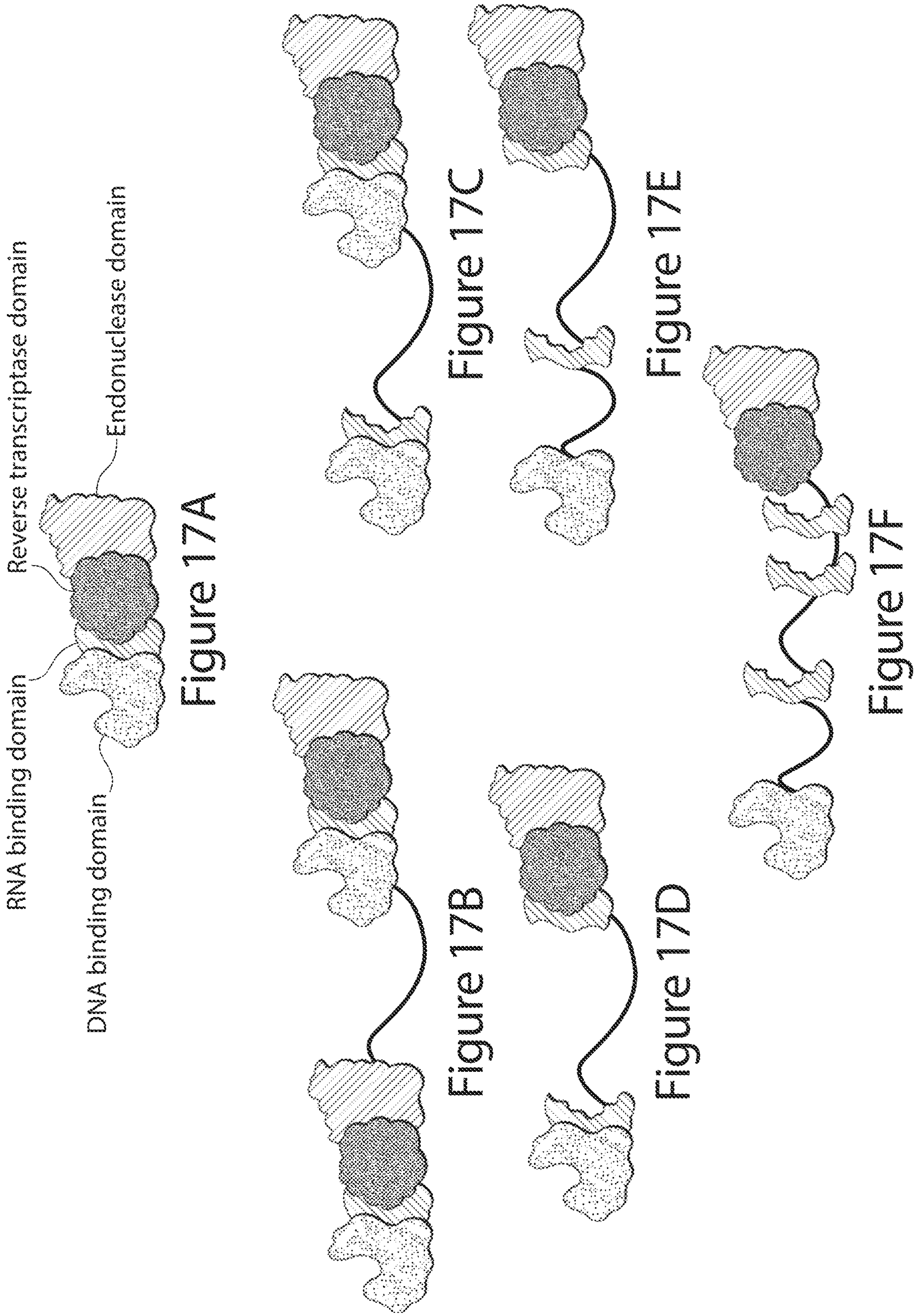
FIGS. 17A-17F are schematic diagrams depicting various covalently dimerized GENE WRITER™ protein configurations. The proteins depicted are.
Figure 19:
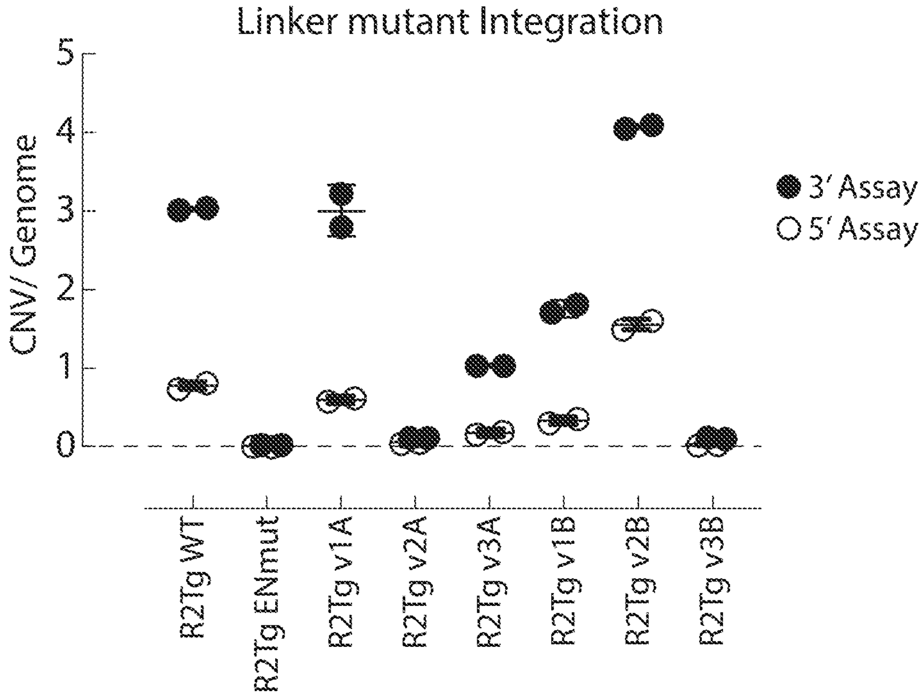
FIG. 19 is a graph showing linker mutant integration into the genome of HEK293T cells, assessed by a ddPCR assay evaluating copy number of R2Tg integration per genome. In v1 mutants, an insertion is located at the N-terminal side of an alpha helical region of R2Tg that preceded the predicted −1 RNA binding motif; in v2 mutants, an insertion is located at the C-terminal side of an alpha helical region of R2Tg that preceded the predicted-1 RNA binding motif; and in v3 mutants, an insertion is located C-terminal to a random coil region that came after the predicted c-myb DNA binding motif of R2Tg.

Some non-LTR retrotransposons utilize two subunits to complete retrotransposition (Christensen et al PNAS 2006). In some embodiments, a retrotransposase described herein comprises two connected subunits as a single polypeptide. For instance, two wild-type retrotransposases could be joined with a linker to form a covalently "dimerized" protein (see FIG. 17). In some embodiments, the nucleic acid coding for the retrotransposase codes for two retrotransposase subunits to be expressed as a single polypeptide. In some embodiments, the subunits are connected by a peptide linker, such as has been described herein in the section entitled "Linker" and, e.g., in Chen et al Adv Drug Deliv Rev 2013. In some embodiments, the two subunits in the polypeptide are connected by a rigid linker. In some embodiments, the rigid linker consists of the motif $(EAAAK)_n$ (SEQ ID NO: 1534). In other embodiments, the two subunits in the polypeptide are connected by a flexible linker. In some embodiments, the flexible linker consists of the motif $(Gly)_n$. In some embodiments, the flexible linker consists of the motif $(GGGGS)_n$ (SEQ ID NO: 1535). In some embodiments, the rigid or flexible linker consists of 1, 2, 3, 4, 5, 10, 15, or more amino acids in length to enable retrotransposition. In some embodiments, the linker consists of a combination of rigid and flexible linker motifs.

Based on mechanism, not all functions are required from both retrotransposase subunits. In some embodiments, the fusion protein may consist of a fully functional subunit and a second subunit lacking one or more functional domains. In some embodiments, one subunit may lack reverse transcriptase functionality. In some embodiments, one subunit may lack the reverse transcriptase domain. In some embodiments, one subunit may possess only endonuclease activity. In some embodiments, one subunit may possess only an endonuclease domain. In some embodiments, the two subunits comprising the single polypeptide may provide complimentary functions.

In some embodiments, one subunit may lack endonuclease functionality. In some embodiments, one subunit may lack the endonuclease domain. In some embodiments, one subunit may possess only reverse transcriptase activity. In some embodiments, one subunit may possess only a reverse transcriptase domain. In some embodiments, one subunit may possess only DNA-dependent DNA synthesis functionality.

Linkers:

In some embodiments, domains of the compositions and systems described herein (e.g., the endonuclease and reverse transcriptase domains of a polypeptide or the DNA binding domain and reverse transcriptase domains of a polypeptide) may be joined by a linker. A composition described herein comprising a linker element has the general form S1-L-S2, wherein S1 and S2 may be the same or different and represent two domain moieties (e.g., each a polypeptide or nucleic acid domain) associated with one another by the linker. In some embodiments, a linker may connect two polypeptides. In some embodiments, a linker may connect two nucleic acid molecules. In some embodiments, a linker may connect a polypeptide and a nucleic acid molecule. A linker may be a chemical bond, e.g., one or more covalent bonds or non-covalent bonds. A linker may be flexible, rigid, and/or cleavable. In some embodiments, the linker is a peptide linker. Generally, a peptide linker is at least 2, 3, 4, 5, 6, 7, 8, 9, 10 or more amino acids in length, e.g., 2-50 amino acids in length, 2-30 amino acids in length.

The most commonly used flexible linkers have sequences consisting primarily of stretches of Gly and Ser residues ("GS" linker). Flexible linkers may be useful for joining domains that require a certain degree of movement or interaction and may include small, non-polar (e.g. Gly) or polar (e.g. Ser or Thr) amino acids. Incorporation of Ser or Thr can also maintain the stability of the linker in aqueous solutions by forming hydrogen bonds with the water molecules, and therefore reduce unfavorable interactions between the linker and the other moieties. Examples of such linkers include those having the structure $[GGS]^{\geq 1}$ or $[GGGS]^{\geq 1}$ (SEQ ID NO: 1536). Rigid linkers are useful to keep a fixed distance between domains and to maintain their independent functions. Rigid linkers may also be useful when a spatial separation of the domains is critical to preserve the stability or bioactivity of one or more components in the agent. Rigid linkers may have an alpha helix-structure or Pro-rich sequence, (XP)n, with X designating any amino acid, preferably Ala, Lys, or Glu. Cleavable linkers may release free functional domains in vivo. In some embodiments, linkers may be cleaved under specific conditions, such as the presence of reducing reagents or proteases. In vivo cleavable linkers may utilize the reversible nature of a disulfide bond. One example includes a thrombin-sensitive sequence (e.g., PRS) between the two Cys residues. In vitro thrombin treatment of CPRSC (SEQ ID NO: 1537) results in the cleavage of the thrombin-sensitive sequence, while the reversible disulfide linkage remains intact. Such linkers are known and described, e.g., in Chen et al. 2013. Fusion Protein Linkers: Property, Design and Functionality. Adv Drug Deliv Rev. 65(10): 1357-1369. In vivo cleavage of linkers in compositions described herein may also be carried out by proteases that are expressed in vivo under pathological conditions (e.g. cancer or inflammation), in specific cells or tissues, or constrained within certain cellular compartments. The specificity of many proteases offers slower cleavage of the linker in constrained compartments.

In some embodiments the amino acid linkers are (or are homologous to) the endogenous amino acids that exist between such domains in a native polypeptide. In some embodiments the endogenous amino acids that exist between such domains are substituted but the length is unchanged from the natural length. In some embodiments, additional amino acid residues are added to the naturally existing amino acid residues between domains.

In some embodiments, the amino acid linkers are designed computationally or screened to maximize protein function (Anad et al., FEBS Letters, 587:19, 2013).

Template RNA Component of GENE WRITER™ Gene Editor System

TheGENE WRITER™ systems described herein can transcribe an RNA sequence template into host target DNA sites by target-primed reverse transcription. By writing DNA sequence(s) via reverse transcription of the RNA sequence template directly into the host genome, the GENE WRITER™ system can insert an object sequence into a target genome without the need for exogenous DNA sequences to be introduced into the host cell (unlike, for example, CRISPR systems), as well as eliminate an exogenous DNA insertion step. Therefore, the GENE WRITER™ system provides a platform for the use of customized RNA sequence templates containing object sequences, e.g., sequences comprising heterologous gene coding and/or function information.

Figure 3:
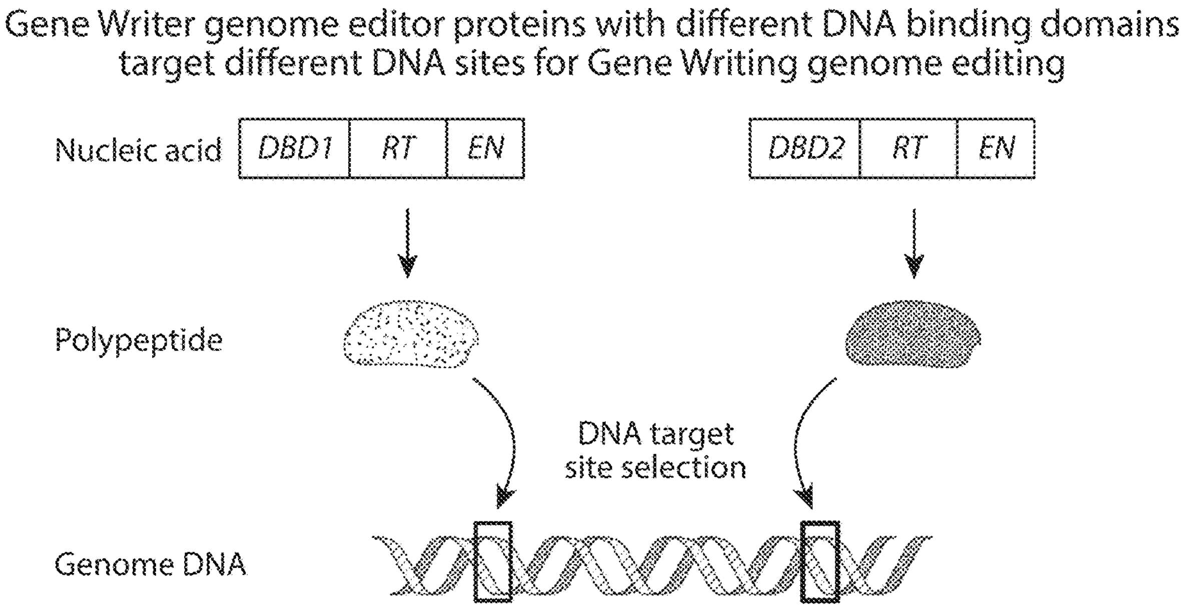
FIG. 3 is a schematic of a GENE WRITER™ genome editor polypeptide comprising a heterologous DNA binding domain designed to target different sites of the genome.
Figure 4:
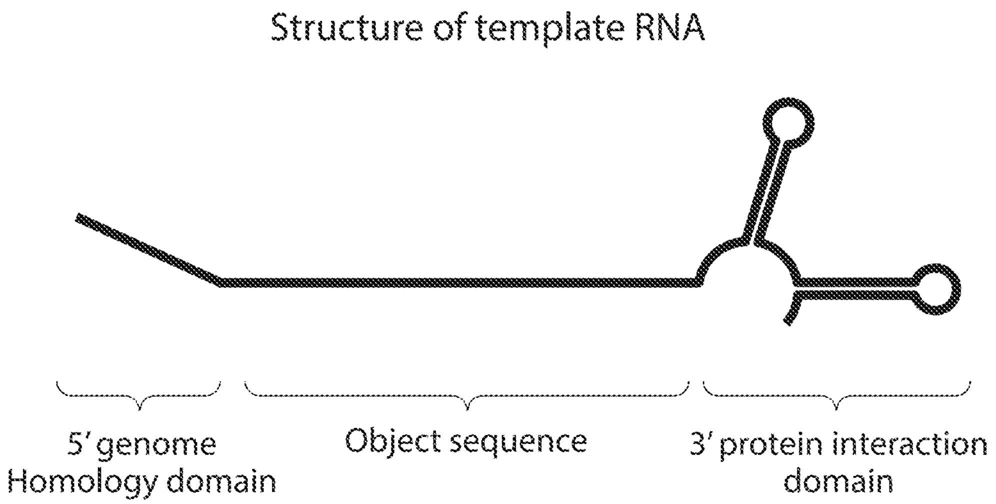
FIG. 4 is a schematic of the structure of GENE WRITER™ genome editor template RNA.
Figure 5:
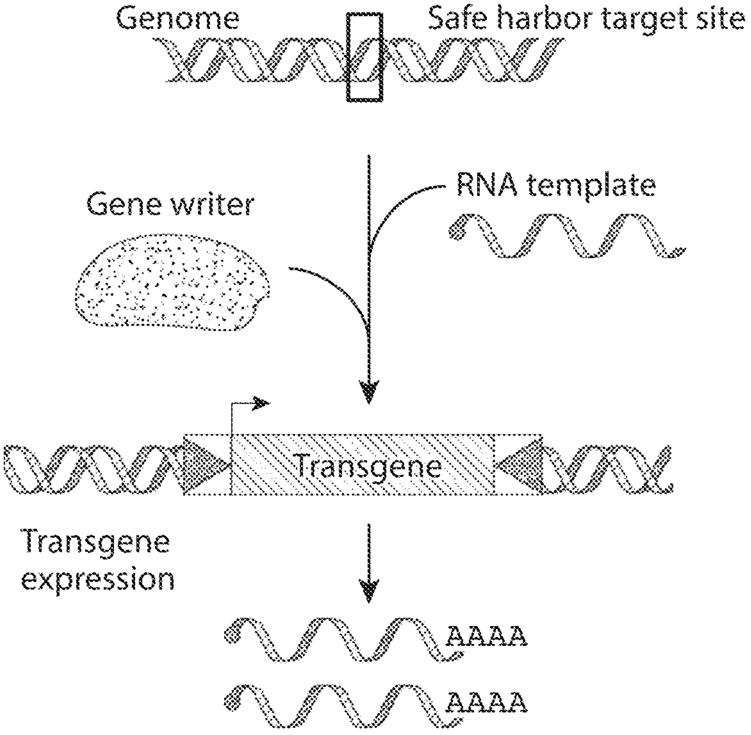
FIG. 5 is a schematic showing the GENE WRITING™ genome editing system to add a gene expression unit into a safe harbor site in the genome.
Figure 6:
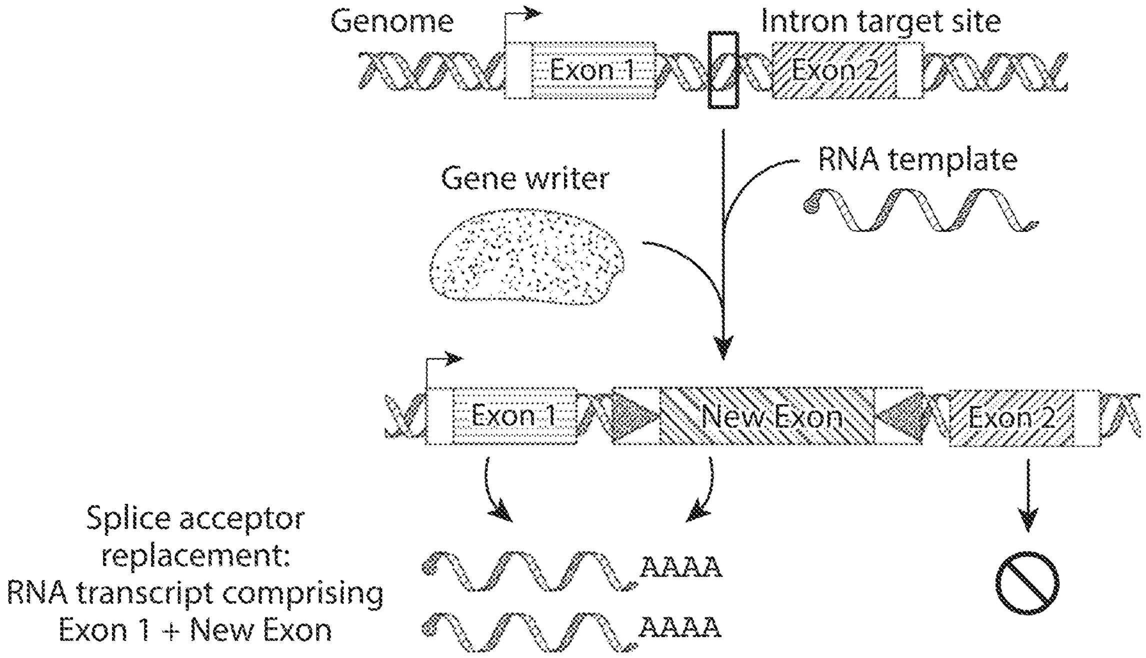
FIG. 6 is a schematic showing GENE WRITING™ genome editing to add a new exon into an specific intron in the genome and replace downstream exons.

In some embodiments the template RNA encodes a GENE WRITER™ protein in cis with a heterologous object sequence. Various cis constructs were described, for example, in Kuroki-Kami et al (2019) *Mobile DNA* 10:23 (incorporated by reference herein in its entirety), and can be used in combination with any of the embodiments described herein. For instance, in some embodiments, the template RNA comprises a heterologous object sequence, a sequence encoding a GENE WRITER™ protein (e.g., a protein comprising (i) a reverse transcriptase domain and (ii) an endonuclease domain, e.g., as described herein), a 5' untranslated region, and a 3' untranslated region. The components may be included in various orders. In some embodiments, the GENE WRITER™ protein and heterologous object sequence are encoded in different directions (sense vs. anti-sense), e.g., using an arrangement shown in FIG. 3A of Kuroki-Kami et al, Id. In some embodiments the GENE WRITER™ protein and heterologous object sequence are encoded in the same direction. In some embodiments, the nucleic acid encoding the polypeptide and the template RNA or the nucleic acid encoding the template RNA are covalently linked, e.g., are part of a fusion nucleic acid and/or are part of the same transcript. In some embodiments, the fusion nucleic acid comprises RNA or DNA.

The nucleic acid encoding the GENE WRITER™ polypeptide may, in some instances, be 5' of the heterologous object sequence. For example, in some embodiments, the template RNA comprises, from 5' to 3', a 5' untranslated region, a sense-encoded GENE WRITER™ polypeptide, a sense-encoded heterologous object sequence, and 3' untranslated region. In some embodiments, the template RNA comprises, from 5' to 3', a 5' untranslated region, a sense-encoded GENE WRITER™ polypeptide, anti-sense-encoded heterologous object sequence, and 3' untranslated region.

In some embodiments, the RNA further comprises homology to the DNA target site.

It is understood that, when a template RNA is described as comprising an open reading frame or the reverse complement thereof, in some embodiments the template RNA must be converted into double stranded DNA (e.g., through reverse transcription) before the open reading frame can be transcribed and translated.

In certain embodiments, customized RNA sequence template can be identified, designed, engineered and constructed to contain sequences altering or specifying host genome function, for example by introducing a heterologous coding region into a genome; affecting or causing exon structure/alternative splicing; causing disruption of an endogenous gene; causing transcriptional activation of an endogenous gene; causing epigenetic regulation of an endogenous DNA; causing up- or down-regulation of operably liked genes, etc. In certain embodiments, a customized RNA sequence template can be engineered to contain sequences coding for exons and/or transgenes, provide for binding sites to transcription factor activators, repressors, enhancers, etc., and combinations of thereof. In other embodiments, the coding sequence can be further customized with splice acceptor sites, poly-A tails. In certain embodiments the RNA sequence can contain sequences coding for an RNA sequence template homologous to the RLE transposase, be engineered to contain heterologous coding sequences, or combinations thereof.

The template RNA may have some homology to the target DNA. In some embodiments the template RNA has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 175, 200 or more bases of exact homology to the target DNA at the 3' end of the RNA. In some embodiments the template RNA has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 160, 175, 180, or 200 or more bases of at least 50%, 60%, 70%, 80%, 85%, 90%, 95%, 97%, 98%, 99% or 100% homology to the target DNA, e.g., at the 5' end of the template RNA. In some embodiments the template RNA has a 3' untranslated region derived from a non-LTR retrotransposon, e.g. a non-LTR retrotransposons described herein. In some embodiments the template RNA has a 3' region of at least 10, 15, 20, 25, 30, 40, 50, 60, 80, 100, 120, 140, 160, 180, 200 or more bases of at least 50%, 60%, 70%, 80%, 85%, 90%, 95%, 97%, 98%, 99% or 100% homology to the 3' sequence of a non-LTR retrotransposon, e.g., a non-LTR retrotransposon described herein, e.g. a non-LTR retrotransposon in Table 1, 2, or 3. In some embodiments the template RNA has a 5' untranslated region derived from a non-LTR retrotransposon, e.g. a non-LTR retrotransposons described herein. In some embodiments the template RNA has a 5' region of at least 10, 15, 20, 25, 30, 40, 50, 60, 80, 100, 120, 140, 160, 180, or 200 or more bases of at least 40%, 50%, 60%, 70%, 80%, 90%, 95% or greater homology to the 5' sequence of a non-LTR retrotransposon, e.g., a non-LTR retrotransposon described herein, e.g. a non-LTR retrotransposon described in Table 2 or 3.

The template RNA component of a GENE WRITER™ genome editing system described herein typically is able to bind the GENE WRITER™ genome editing protein of the system. In some embodiments the template RNA has a 3' region that is capable of binding a GENE WRITER™ genome editing protein. The binding region, e.g., 3' region, may be a structured RNA region, e.g., having at least 1, 2 or 3 hairpin loops, capable of binding the GENE WRITER™ genome editing protein of the system.

The template RNA component of a GENE WRITER™ genome editing system described herein typically is able to bind the GENE WRITER™ genome editing protein of the system. In some embodiments the template RNA has a 5' region that is capable of binding a GENE WRITER™ genome editing protein. The binding region, e.g., 5' region, may be a structured RNA region, e.g., having at least 1, 2 or 3 hairpin loops, capable of binding the GENE WRITER™ genome editing protein of the system. In some embodiments, the 5' untranslated region comprises a pseudoknot, e.g., a pseudoknot that is capable of binding to the GENE WRITER™ protein.

In some embodiments, the template RNA (e.g., an untranslated region of the hairpin RNA, e.g., a 5' untranslated region) comprises a stem-loop sequence. In some embodiments, the template RNA (e.g., an untranslated region of the hairpin RNA, e.g., a 5' untranslated region) comprises a hairpin. In some embodiments, the template RNA (e.g., an untranslated region of the hairpin RNA, e.g., a 5' untranslated region) comprises a helix. In some embodiments, the template RNA (e.g., an untranslated region of the hairpin RNA, e.g., a 5' untranslated region) comprises a psuedoknot. In some embodiments the template RNA comprises a ribozyme. In some embodiments the ribozyme is similar to an hepatitis delta virus (HDV) ribozyme, e.g., has a secondary structure like that of the HDV ribozyme and/or has one or more activities of the HDV ribozyme, e.g., a self-cleavage activity. See, e.g., Eickbush et al., Molecular and Cellular Biology, 2010, 3142-3150.

In some embodiments, the template RNA (e.g., an untranslated region of the hairpin RNA, e.g., a 3' untranslated region) comprises one or more stem-loops or helices. Exemplary structures of R2 3' UTRs are shown, for example, in Ruschak et al. "Secondary structure models of the 3' untranslated regions of diverse R2 RNAs" RNA. 2004 June; 10(6): 978-987, e.g., at FIG. 3, therein, and in Eikbush and Eikbush, "R2 and R2/R1 hybrid non-autonomous retrotransposons derived by internal deletions of full-length elements" Mobile DNA (2012) 3:10; e.g., at FIG. 3 therein, which articles are hereby incorporated by reference in their entirety.

In some embodiments, a template RNA described herein comprises a sequence that is capable of binding to a GENE WRITER™ protein described herein. For instance, in some embodiments, the template RNA comprises an MS2 RNA sequence capable of binding to an MS2 coat protein sequence in the GENE WRITER™ protein. In some embodiments, the template RNA comprises an RNA sequence capable of binding to a B-box sequence. In some embodiments, the template RNA comprises an RNA sequence (e.g., a crRNA sequence and/or tracrRNA sequence) capable of binding to a dCas sequence in the GENE WRITER™ protein. In some embodiments, in addition to or in place of a UTR, the template RNA is linked (e.g., covalently) to a non-RNA UTR, e.g., a protein or small molecule.

In some embodiments the template RNA has a poly-A tail at the 3' end. In some embodiments the template RNA does not have a poly-A tail at the 3' end.

In some embodiments the template RNA has a 5' region of at least 10, 15, 20, 25, 30, 40, 50, 60, 80, 100, 120, 140, 160, 180, 200 or more bases of at least 40%, 50%, 60%, 70%, 80%, 90%, 95% or greater homology to the 5' sequence of a non-LTR retrotransposon, e.g., a non-LTR retrotransposon described herein.

The template RNA of the system typically comprises an object sequence for insertion into a target DNA. The object sequence may be coding or non-coding.

In some embodiments a system or method described herein comprises a single template RNA. In some embodiments a system or method described herein comprises a plurality of template RNAs.

In some embodiments, the object sequence may contain an open reading frame. In some embodiments the template RNA has a Kozak sequence. In some embodiments the template RNA has an internal ribosome entry site. In some embodiments the template RNA has a self-cleaving peptide such as a T2A or P2A site. In some embodiments the template RNA has a start codon. In some embodiments the template RNA has a splice acceptor site. In some embodiments the template RNA has a splice donor site. In some embodiments the template RNA has a microRNA binding site downstream of the stop codon. In some embodiments the template RNA has a polyA tail downstream of the stop codon of an open reading frame. In some embodiments the template RNA comprises one or more exons. In some embodiments the template RNA comprises one or more introns. In some embodiments the template RNA comprises a eukaryotic transcriptional terminator. In some embodiments the template RNA comprises an enhanced translation element or a translation enhancing element. In some embodiments the RNA comprises the human T-cell leukemia virus (HTLV-1) R region. In some embodiments the RNA comprises a posttranscriptional regulatory element that enhances nuclear export, such as that of Hepatitis B Virus (HPRE) or Woodchuck Hepatitis Virus (WPRE). In some embodiments, in the template RNA, the heterologous object sequence encodes a polypeptide and is coded in an antisense direction with respect to the 5' and 3' UTR. In some embodiments, in the template RNA, the heterologous object sequence encodes a polypeptide and is coded in a sense direction with respect to the 5' and 3' UTR.

In some embodiments, a nucleic acid described herein (e.g., a template RNA or a DNA encoding a template RNA) comprises a microRNA binding site. In some embodiments, the microRNA binding site is used to increase the target-cell specificity of a GENE WRITER™ system. For instance, the microRNA binding site can be chosen on the basis that is recognized by a miRNA that is present in a non-target cell type, but that is not present (or is present at a reduced level relative to the non-target cell) in a target cell type. Thus, when the template RNA is present in a non-target cell, it would be bound by the miRNA, and when the template RNA is present in a target cell, it would not be bound by the miRNA (or bound but at reduced levels relative to the non-target cell). While not wishing to be bound by theory, binding of the miRNA to the template RNA may interfere with insertion of the heterologous object sequence into the genome. Accordingly, the heterologous object sequence would be inserted into the genome of target cells more efficiently than into the genome of non-target cells. A system having a microRNA binding site in the template RNA (or DNA encoding it) may also be used in combination with a nucleic acid encoding a GENE WRITER™ polypeptide, wherein expression of the GENE WRITER™ polypeptide is regulated by a second microRNA binding site, e.g., as described herein, e.g., in the section entitled "Polypeptide component of GENE WRITER™ gene editor system".

In some embodiments, the object sequence may contain a non-coding sequence. For example, the template RNA may comprise a promoter or enhancer sequence. In some embodiments the template RNA comprises a tissue specific promoter or enhancer, each of which may be unidirectional or bidirectional. In some embodiments the promoter is an RNA polymerase I promoter, RNA polymerase II promoter, or RNA polymerase III promoter. In some embodiments the promoter comprises a TATA element. In some embodiments the promoter comprises a B recognition element. In some embodiments the promoter has one or more binding sites for transcription factors. In some embodiments the non-coding sequence is transcribed in an antisense-direction with respect to the 5' and 3' UTR. In some the non-coding sequence is transcribed in a sense direction with respect to the 5' and 3' UTR.

In some embodiments, a nucleic acid described herein (e.g., a template RNA or a DNA encoding a template RNA) comprises a promoter sequence, e.g., a tissue specific promoter sequence. In some embodiments, the tissue-specific promoter is used to increase the target-cell specificity of a GENE WRITER™ system. For instance, the promoter can be chosen on the basis that it is active in a target cell type but not active in (or active at a lower level in) a non-target cell type. Thus, even if the promoter integrated into the genome of a non-target cell, it would not drive expression (or only drive low level expression) of an integrated gene. A system having a tissue-specific promoter sequence in the template RNA may also be used in combination with a microRNA binding site, e.g., in the template RNA or a nucleic acid encoding a GENE WRITER™ protein, e.g., as described herein. A system having a tissue-specific promoter sequence in the template RNA may also be used in combination with a DNA encoding a GENE WRITER™ polypeptide, driven by a tissue-specific promoter, e.g., to achieve higher levels of GENE WRITER™ protein in target cells than in non-target cells.

In some embodiments the template RNA comprises a microRNA sequence, a siRNA sequence, a guide RNA sequence, a piwi RNA sequence.

In some embodiments the template RNA comprises a site that coordinates epigenetic modification. In some embodiments the template RNA comprises an element that inhibits, e.g., prevents, epigenetic silencing. In some embodiments the template RNA comprises a chromatin insulator. For example, the template RNA comprises a CTCF site or a site targeted for DNA methylation.

In order to promote higher level or more stable gene expression, the template RNA may include features that prevent or inhibit gene silencing. In some embodiments, these features prevent or inhibit DNA methylation. In some embodiments, these features promote DNA demethylation. In some embodiments, these features prevent or inhibit histone deacetylation. In some embodiments, these features prevent or inhibit histone methylation. In some embodiments, these features promote histone acetylation. In some embodiments, these features promote histone demethylation. In some embodiments, multiple features may be incorporated into the template RNA to promote one or more of these modifications. CpG dinculeotides are subject to methylation by host methyl transferases. In some embodiments, the template RNA is depleted of CpG dinucleotides, e.g., does not comprise CpG nucleotides or comprises a reduced number of CpG dinucleotides compared to a corresponding unaltered sequence. In some embodiments, the promoter driving transgene expression from integrated DNA is depleted of CpG dinucleotides.

In some embodiments the template RNA comprises a gene expression unit composed of at least one regulatory region operably linked to an effector sequence. The effector sequence may be a sequence that is transcribed into RNA (e.g., a coding sequence or a non-coding sequence such as a sequence encoding a micro RNA).

In some embodiments the object sequence of the template RNA is inserted into a target genome in an endogenous intron. In some embodiments the object sequence of the template RNA is inserted into a target genome and thereby acts as a new exon. In some embodiments the insertion of the object sequence into the target genome results in replacement of a natural exon or the skipping of a natural exon.

In some embodiments the object sequence of the template RNA is inserted into the target genome in a genomic safe harbor site, such as AAVS1, CCR5, or ROSA26. In some embodiment the object sequence of the template RNA is added to the genome in an intergenic or intragenic region. In some embodiments the object sequence of the template RNA is added to the genome 5' or 3' within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of an endogenous active gene. In some embodiments the object sequence of the template RNA is added to the genome 5' or 3' within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of an endogenous promoter or enhancer. In some embodiments the object sequence of the template RNA can be, e.g., 50-50,000 base pairs (e.g., between 50-40,000 bp, between 500-30,000 bp between 500-20,000 bp, between 100-15,000 bp, between 500-10,000 bp, between 50-10,000 bp, between 50-5,000 bp. In some embodiments, the heterologous object sequence is less than 1,000, 1,300, 1500, 2,000, 3,000, 4,000, 5,000, or 7,500 nucleotides in length.

In some embodiments the genomic safe harbor site is a NATURAL HARBOR™ site. In some embodiments the NATURAL HARBOR™ site is ribosomal DNA (rDNA). In some embodiments the NATURAL HARBOR™ site is 5S rDNA, 18S rDNA, 5.8S rDNA, or 28S rDNA. In some embodiments the NATURAL HARBOR™ site is the Mutsu site in 5S rDNA. In some embodiments the NATURAL HARBOR™ site is the R2 site, the R5 site, the R6 site, the R4 site, the R1 site, the R9 site, or the RT site in 28S rDNA. In some embodiments the NATURAL HARBOR™ site is the R8 site or the R7 site in 18S rDNA. In some embodiments the NATURAL HARBOR™ site is DNA encoding transfer RNA (tRNA). In some embodiments the NATURAL HARBOR™ site is DNA encoding tRNA-Asp or tRNA-Glu. In some embodiments the NATURAL HARBOR™ site is DNA encoding spliceosomal RNA. In some embodiments the NATURAL HARBOR™ site is DNA encoding small nuclear RNA (snRNA) such as U2 snRNA.

Thus, in some aspects, the present disclosure provides a method of inserting a heterologous object sequence into a NATURAL HARBOR™ site. In some embodiments, the method comprises using a GENE WRITER™ system described herein, e.g., using a polypeptide of any of Tables 1-3 or a polypeptide having sequence similarity thereto, e.g., at least 80%, 85%, 90%, or 95% identity thereto. In some embodiments, the method comprises using an enzyme, e.g., a retrotransposase, to insert the heterologous object sequence into the NATURAL HARBOR™ site. In some aspects, the present disclosure provides a host human cell comprising a heterologous object sequence (e.g., a sequence encoding a therapeutic polypeptide) situated at a NATURAL HARBOR™ site in the genome of the cell. In some embodiments, the NATURAL HARBOR™ site is a site described in Table 4 below. In some embodiments, the heterologous object sequence is inserted within 20, 50, 100, 150, 200, 250, 500, or 1000 base pairs of a sequence shown in Table 4. In some embodiments, the heterologous object sequence is inserted within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of a sequence shown in Table 4. In some embodiments, the heterologous object sequence is inserted into a site having at least 70%, 75%, 80%, 85%, 90%, 95%, 96%, 97%, 98%, or 99% identity to a sequence shown in Table 4. In some embodiments, the heterologous object sequence is inserted within 20, 50, 100, 150, 200, 250, 500, or 1000 base pairs, or within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb, of a site having at least 70%, 75%, 80%, 85%, 90%, 95%, 96%, 97%, 98%, or 99% identity to a sequence shown in Table 4. In some embodiments, the heterologous object sequence is inserted within a gene indicated in Column 5 of Table 4, or within 20, 50, 100, 150, 200, 250, 500, or 1000 base pairs, or within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb, of the gene.

TABLE 4

Natural Harbor ™ sites. Column 1 indicates a retrotransposon that inserts into the Natural Harbor ™ site. Column 2 indicates the gene at the Natural Harbor ™ site. Columns 3 and 4 show exemplary human genome sequence 5' and 3' of the insertion site (for example, 250 bp). Columns 5 and 6 list the example gene symbol and corresponding Gene ID.

| Target Site | Target Gene | 5' flanking sequence | 3' flanking sequence | Example Gene Symbol | Example Gene ID |
|---|---|---|---|---|---|
| R2 | 28S rDNA | CCGGTCCCCCCCGCCGGGTCC GCCCCCGGGGCCGCGGTTCC GCGCGGCGCCTCGCCTCGGC CGGCGCCTAGCAGCCGACTT AGAACTGGTGCGGACCAGGG GAATCCGACTGTTTAATTAAA ACAAAGCATCGCGAAGGCCC GCGGCGGGTGTTGACGCGAT GTGATTTCTGCCCAGTGCTCT GAATGTCAAAGTGAAGAAAT TCAATGAAGCGCGGGTAAAC GGCGGGAGTAACTATGACTC TCTTAAG (SEQ ID NO: 1508) | GTAGCCAAATGCCTCGTCATC TAATTAGTGACGCGCATGAAT GGATGAACGAGATTCCCACT GTCCCTACCTACTATCCAGCG AAACCACAGCCAAGGGAACG GGCTTGGCGGAATCAGCGGG GAAAGAAGACCCTGTTGAGC TTGACTCTAGTCTGGCACGGT GAAGAGACATGAGAGGTGTA GAATAAGTGGGAGGCCCCCG GCGCCCCCCCGGTGTCCCCGC GAGGGGCCCGGGGCGGGGT CCGCCG (SEQ ID NO: 1513) | RNA28SN1 | 106632264 |
| R4 | 28S rDNA | GCGGTTCCGCGCGGCGCCTC GCCTCGGCCGGCGCCTAGCA GCCGACTTAGAACTGGTGCG GACCAGGGGAATCCGACTGT TTAATTAAAACAAAGCATCGC GAAGGCCCGCGGCGGGTGTT GACGCGATGTGATTTCTGCCC AGTGCTCTGAATGTCAAAGT GAAGAAATTCAATGAAGCGC GGGTAAACGGCGGGAGTAAC TATGACTCTCTTAAGGTAGCC AAATGCCTCGTCATCTAATTA GTGACG (SEQ ID NO: 1509) | CGCATGAATGGATGAACGAG ATTCCCACTGTCCCTACCTACT ATCCAGCGAAACCACAGCCA AGGGAACGGGCTTGGCGGA ATCAGCGGGGAAAGAAGACC CTGTTGAGCTTGACTCTAGTC TGGCACGGTGAAGAGACATG AGAGGTGTAGAATAAGTGGG AGGCCCCCGGCGCCCCCCCG GTGTCCCCGCGAGGGGCCCG GGGCGGGGTCCGCCGGCCCT GCGGGCCGCCGGTGAAATAC CACTACTC (SEQ ID NO: 1514) | RNA28SN1 | 106632264 |
| R5 | 28S rDNA | TCCCCCCCGCCGGGTCCGCCC CCGGGGCCGCGGTTCCGCGC GGCGCCTCGCCTCGGCCGGC GCCTAGCAGCCGACTTAGAA CTGGTGCGGACCAGGGGAAT CCGACTGTTTAATTAAAACAA AGCATCGCGAAGGCCCGCGG CGGGTGTTGACGCGATGTGA TTTCTGCCCAGTGCTCTGAAT GTCAAAGTGAAGAAATTCAA TGAAGCGCGGGTAAACGGCG GGAGTAACTATGACTCTCTTA AGGTAG (SEQ ID NO: 1510) | CCAAATGCCTCGTCATCTAAT TAGTGACGCGCATGAATGGA TGAACGAGATTCCCACTGTCC CTACCTACTATCCAGCGAAAC CACAGCCAAGGGAACGGGCT TGGCGGAATCAGCGGGGAAA GAAGACCCTGTTGAGCTTGA CTCTAGTCTGGCACGGTGAA GAGACATGAGAGGTGTAGAA TAAGTGGGAGGCCCCCGGCG CCCCCCCGGTGTCCCCGCGAG GGGCCCGGGGCGGGGTCCG CCGGCCC (SEQ ID NO: 1515) | RNA28SN1 | 106632264 |
| R9 | 28S rDNA | CGGCGCGCTCGCCGGCCGAG GTGGGATCCCGAGGCCTCTC CAGTCCGCCGAGGGCGCACC ACCGGCCCGTCTCGCCCGCCG CGCCGGGGAGGTGGAGCAC GAGCGCACGTGTTAGGACCC GAAAGATGGTGAACTATGCC TGGGCAGGGCGAAGCCAGA GGAAACTCTGGTGGAGGTCC GTAGCGGTCCTGACGTGCAA ATCGGTCGTCCGACCTGGGT ATAGGGGCGAAAGACTAATC GAACCATCTAG (SEQ ID NO: 1511) | TAGCTGGTTCCCTCCGAAGTT TCCCTCAGGATAGCTGGCGCT CTCGCAGACCCGACGCACCCC CGCCACGCAGTTTTATCCGGT AAAGCGAATGATTAGAGGTC TTGGGGCCGAAACGATCTCA ACCTATTCTCAAACTTTAAAT GGGTAAGAAGCCCGGCTCGC TGGCGTGGAGCCGGGCGTGG AATGCGAGTGCCTAGTGGGC CACTTTTGGTAAGCAGAACTG GCGCTGCGGGATGAACCGAA CGCC (SEQ ID NO: 1516) | RNA28SN1 | 106632264 |
| R8 | 18S rDNA | GCATTCGTATTGCGCCGCTAG AGGTGAAATTCTTGGACCGG CGCAAGACGGACCAGAGCGA AAGCATTTGCCAAGAATGTTT TCATTAATCAAGAACGAAAGT CGGAGGTTCGAAGACGATCA GATACCGTCGTAGTTCCGACC ATAAACGATGCCGACCGGCG ATGCGGCGGCGTTATTCCCAT | TGAAACTTAAAGGAATTGAC GGAAGGGCACCACCAGGAGT GGAGCCTGCGGCTTAATTTG ACTCAACACGGGAAACCTCA CCCGGCCCGGACACGGACAG GATTGACAGATTGATAGCTCT TTCTCGATTCCGTGGGTGGTG GTGCATGGCCGTTCTTAGTTG GTGGAGCGATTTGTCTGGTT | RNA18SN1 | 106631781 |

TABLE 4-continued

Natural Harbor ™ sites. Column 1 indicates a retrotransposon that inserts into the Natural Harbor ™ site. Column 2 indicates the gene at the Natural Harbor ™ site. Columns 3 and 4 show exemplary human genome sequence 5' and 3' of the insertion site (for example, 250 bp). Columns 5 and 6 list the example gene symbol and corresponding Gene ID.

| Target Site | Target Gene | 5' flanking sequence | 3' flanking sequence | Example Gene Symbol | Example Gene ID |
|---|---|---|---|---|---|
| | | GACCCGCCGGGCAGCTTCCG GGAAACCAAAGTCTTTGGGT TCCGGGGGGAGTATGGTTGC AAAGC (SEQ ID NO: 1512) | AATTCCGATAACGAACGAGA CTCTGGCATGCTAACTAGTTA CGCGACCCCCGAGCGGTCGG CGTCCC (SEQ ID NO: 1517) | | |
| R4-2_SRa | tRNA-Asp | | | TRD-GTC1-1 | 100189207 |
| LIN25_SM | tRNA-Glu | | | TRE-CTC1-1 | 100189384 |
| R1 | 28S rDNA | TAGCAGCCGACTTAGAACTG GTGCGGACCAGGGGAATCCG ACTGTTTAATTAAAACAAAGC ATCGCGAAGGCCCGCGGCGG GTGTTGACGCGATGTGATTTC TGCCCAGTGCTCTGAATGTCA AAGTGAAGAAATTCAATGAA GCGCGGGTAAACGGCGGGA GTAACTATGACTCTCTTAAGG TAGCCAAATGCCTCGTCATCT AATTAGTGACGCGCATGAAT GGATGAACGAGATTCCCACT GTCCCT (SEQ ID NO: 1518) | ACCTACTATCCAGCGAAACCA CAGCCAAGGGAACGGGCTTG GCGGAATCAGCGGGGAAAG AAGACCCTGTTGAGCTTGACT CTAGTCTGGCACGGTGAAGA GACATGAGAGGTGTAGAATA AGTGGGAGGCCCCCGGCGCC CCCCCGGTGTCCCCGCGAGG GGCCCGGGGCGGGGTCCGCC GGCCCTGCGGGCCGCCGGTG AAATACCACTACTCTGATCGT TTTTTCACTGACCCGGTGAGG CGGGGGG (SEQ ID NO: 1524) | RNA28SN1 | 106632264 |
| R6 | 28S rDNA | CCCCCCGCCGGGTCCGCCCCC GGGGCCGCGGTTCCGCGCGG CGCCTCGCCTCGGCCGGCGC CTAGCAGCCGACTTAGAACT GGTGCGGACCAGGGGAATCC GACTGTTTAATTAAAACAAAG CATCGCGAAGGCCCGCGGCG GGTGTTGACGCGATGTGATT TCTGCCCAGTGCTCTGAATGT CAAAGTGAAGAAATTCAATG AAGCGCGGGTAAACGGCGG GAGTAACTATGACTCTCTTAA GGTAGCC (SEQ ID NO: 1519) | AAATGCCTCGTCATCTAATTA GTGACGCGCATGAATGGATG AACGAGATTCCCACTGTCCCT ACCTACTATCCAGCGAAACCA CAGCCAAGGGAACGGGCTTG GCGGAATCAGCGGGGAAAG AAGACCCTGTTGAGCTTGACT CTAGTCTGGCACGGTGAAGA GACATGAGAGGTGTAGAATA AGTGGGAGGCCCCCGGCGCC CCCCCGGTGTCCCCGCGAGG GGCCCGGGGCGGGGTCCGCC GGCCCTG (SEQ ID NO: 1525) | RNA28SN1 | 106632264 |
| R7 | 18S rDNA | GCGCAAGACGGACCAGAGCG AAAGCATTTGCCAAGAATGTT TTCATTAATCAAGAACGAAAG TCGGAGGTTCGAAGACGATC AGATACCGTCGTAGTTCCGAC CATAAACGATGCCGACCGGC GATGCGGCGGCGTTATTCCC ATGACCCGCCGGGCAGCTTC CGGGAAACCAAAGTCTTTGG GTTCCGGGGGGAGTATGGTT GCAAAGCTGAAACTTAAAGG AATTGACGGAAGGGCACCAC CAGGAGT (SEQ ID NO: 1520) | GGAGCCTGCGGCTTAATTTG ACTCAACACGGGAAACCTCA CCCGGCCCGGACACGGACAG GATTGACAGATTGATAGCTCT TTCTCGATTCCGTGGGTGGTG GTGCATGGCCGTTCTTAGTTG GTGGAGCGATTTGTCTGGTT AATTCCGATAACGAACGAGA CTCTGGCATGCTAACTAGTTA CGCGACCCCCGAGCGGTCGG CGTCCCCCAACTTCTTAGAGG GACAAGTGGCGTTCAGCCAC CCGAG (SEQ ID NO: 1526) | RNA18SN1 | 106631781 |
| RT | 28S rDNA | GGCCGGGCGCGACCCGCTCC GGGGACAGTGCCAGGTGGG GAGTTTGACTGGGGCGGTAC ACCTGTCAAACGGTAACGCA GGTGTCCTAAGGCGAGCTCA GGGAGGACAGAAACCTCCCG TGGAGCAGAAGGGCAAAAG CTCGCTTGATCTTGATTTTCA GTACGAATACAGACCGTGAA AGCGGGGCCTCACGATCCTTC TGACCTTTTGGGTTTTAAGCA GGAGGTGTCAGAAAAGTTAC CACAGGGAT (SEQ ID NO: 1521) | AACTGGCTTGTGGCGGCCAA GCGTTCATAGCGACGTCGCTT TTTGATCCTTCGATGTCGGCT CTTCCTATCATTGTGAAGCAG AATTCACCAAGCGTTGGATTG TTCACCCACTAATAGGGAACG TGAGCTGGGTTTAGACCGTC GTGAGACAGGTTAGTTTTACC CTACTGATGATGTGTTGTTGC CATGGTAATCCTGCTCAGTAC GAGAGGAACCGCAGGTTCAG ACATTTGGTGTATGTGCTTGG C (SEQ ID NO: 1527) | RNA28SN1 | 106632264 |

TABLE 4-continued

Natural Harbor ™ sites. Column 1 indicates a retrotransposon that inserts into the Natural Harbor ™ site. Column 2 indicates the gene at the Natural Harbor ™ site. Columns 3 and 4 show exemplary human genome sequence 5' and 3' of the insertion site (for example, 250 bp). Columns 5 and 6 list the example gene symbol and corresponding Gene ID.

| Target Site | Target Gene | 5' flanking sequence | 3' flanking sequence | Example Gene Symbol | Example Gene ID |
|---|---|---|---|---|---|
| Mutsu | 5S rDNA | GTCTACGGCCATACCACCC (SEQ ID NO: 1522) | TGAACGCGCCCGATCTCGTCT GATCTCGGAAGCTAAGCAGG GTCGGGCCTGGTTAGTACTT GGATGGGAGACCGCCTGGGA ATACCGGGTGCTGTAGGCTTT (SEQ ID NO: 1528) | RNA5S1 | 100169751 |
| Utopia/ Keno | U2 snRNA | ATCGCTTCTCGGCCTTTTGGC TAAGATCAAGTGTAGTA (SEQ ID NO: 1523) | TCTGTTCTTATCAGTTTAATAT CTGATACGTCCTCTATCCGAG GACAATATATTAAATGGATTT TTGGAGCAGGGAGATGGAAT AGGAGCTTGCTCCGTCCACTC CACGCATCGACCTGGTATTGC AGTACCTCCAGGAACGGTGC ACCC (SEQ ID NO: 1529) | RNU2-1 | 6066 |

In some embodiments, a system or method described herein results in insertion of a heterologous sequence into a target site in the human genome. In some embodiments, the target site in the human genome has sequence similarity to the corresponding target site of the corresponding wild-type retrotransposase (e.g., the retrotransposase from which the GENE WRITER™ was derived) in the genome of the organism to which it is native. For instance, in some embodiments, the identity between the 40 nucleotides of human genome sequence centered at the insertion site and the 40 nucleotides of native organism genome sequence centered at the insertion site is less than 99.5%, 99%, 98%, 97%, 96%, 95%, 90%, 85%, 80%, 75%, 70%, 60%, or 50%, or is between 50-60%, 60-70%, 70-80%, 80-90%, or 90-100%. In some embodiments, the identity between the 100 nucleotides of human genome sequence centered at the insertion site and the 100 nucleotides of native organism genome sequence centered at the insertion site is less than 99.5%, 99%, 98%, 97%, 96%, 95%, 90%, 85%, 80%, 75%, 70%, 60%, or 50%, or is between 50-60%, 60-70%, 70-80%, 80-90%, or 90-100%. In some embodiments, the identity between the 500 nucleotides of human genome sequence centered at the insertion site and the 500 nucleotides of native organism genome sequence centered at the insertion site is less than 99.5%, 99%, 98%, 97%, 96%, 95%, 90%, 85%, 80%, 75%, 70%, 60%, or 50%, or is between 50-60%, 60-70%, 70-80%, 80-90%, or 90-100%.

Production of Compositions and Systems

As will be appreciated by one of skill, methods of designing and constructing nucleic acid constructs and proteins or polypeptides (such as the systems, constructs and polypeptides described herein) are routine in the art. Generally, recombinant methods may be used. See, in general, Smales & James (Eds.), *Therapeutic Proteins: Methods and Protocols* (Methods in Molecular Biology), Humana Press (2005); and Crommelin, Sindelar & Meibohm (Eds.), *Pharmaceutical Biotechnology: Fundamentals and Applications*, Springer (2013). Methods of designing, preparing, evaluating, purifying and manipulating nucleic acid compositions are described in Green and Sambrook (Eds.), *Molecular Cloning: A Laboratory Manual* (Fourth Edition), Cold Spring Harbor Laboratory Press (2012).

Exemplary methods for producing a therapeutic pharmaceutical protein or polypeptide described herein involve expression in mammalian cells, although recombinant proteins can also be produced using insect cells, yeast, bacteria, or other cells under control of appropriate promoters. Mammalian expression vectors may comprise non-transcribed elements such as an origin of replication, a suitable promoter, and other 5' or 3' flanking non-transcribed sequences, and 5' or 3' non-translated sequences such as necessary ribosome binding sites, a polyadenylation site, splice donor and acceptor sites, and termination sequences. DNA sequences derived from the SV40 viral genome, for example, SV40 origin, early promoter, splice, and polyadenylation sites may be used to provide other genetic elements required for expression of a heterologous DNA sequence. Appropriate cloning and expression vectors for use with bacterial, fungal, yeast, and mammalian cellular hosts are described in Green & Sambrook, *Molecular Cloning: A Laboratory Manual* (Fourth Edition), Cold Spring Harbor Laboratory Press (2012).

Various mammalian cell culture systems can be employed to express and manufacture recombinant protein. Examples of mammalian expression systems include CHO, COS, HEK293, HeLA, and BHK cell lines. Processes of host cell culture for production of protein therapeutics are described in Zhou and Kantardjieff (Eds.), *Mammalian Cell Cultures for Biologics Manufacturing* (*Advances in Biochemical Engineering/Biotechnology*), Springer (2014). Compositions described herein may include a vector, such as a viral vector, e.g., a lentiviral vector, encoding a recombinant protein. In some embodiments, a vector, e.g., a viral vector, may comprise a nucleic acid encoding a recombinant protein.

Purification of protein therapeutics is described in Franks, Protein Biotechnology: *Isolation, Characterization, and Stabilization*, Humana Press (2013); and in Cutler, *Protein Purification Protocols* (*Methods in Molecular Biology*), Humana Press (2010).

Applications

By integrating coding genes into a RNA sequence template, the GENE WRITER™ system can address therapeutic needs, for example, by providing expression of a therapeutic transgene in individuals with loss-of-function mutations, by replacing gain-of-function mutations with normal transgenes, by providing regulatory sequences to eliminate gain-of-function mutation expression, and/or by controlling the expression of operably linked genes, transgenes and systems thereof. In certain embodiments, the RNA sequence template encodes a promotor region specific to the therapeutic needs of the host cell, for example a tissue specific promotor or enhancer. In still other embodiments, a promotor can be operably linked to a coding sequence.

In embodiments, the GENE WRITER™ gene editor system can provide therapeutic transgenes expressing, e.g., replacement blood factors or replacement enzymes, e.g., lysosomal enzymes. For example, the compositions, systems and methods described herein are useful to express, in a target human genome, agalsidase alpha or beta for treatment of Fabry Disease; imiglucerase, taliglucerase alfa, velaglucerase alfa, or alglucerase for Gaucher Disease; sebelipase alpha for lysosomal acid lipase deficiency (Wolman disease/CESD); laronidase, idursulfase, elosulfase alpha, or galsulfase for mucopolysaccharidoses; alglucosidase alpha for Pompe disease. For example, the compositions, systems and methods described herein are useful to express, in a target human genome factor I, II, V, VII, X, XI, XII or XIII for blood factor deficiencies.

In some embodiments, the heterologous object sequence encodes an intracellular protein (e.g., a cytoplasmic protein, a nuclear protein, an organellar protein such as a mitochondrial protein or lysosomal protein, or a membrane protein). In some embodiments, the heterologous object sequence encodes a membrane protein, e.g., a membrane protein other than a CAR, and/or an endogenous human membrane protein. In some embodiments, the heterologous object sequence encodes an extracellular protein. In some embodiments, the heterologous object sequence encodes an enzyme, a structural protein, a signaling protein, a regulatory protein, a transport protein, a sensory protein, a motor protein, a defense protein, or a storage protein.

Administration

The composition and systems described herein may be used in vitro or in vivo. In some embodiments the system or components of the system are delivered to cells (e.g., mammalian cells, e.g., human cells), e.g., in vitro or in vivo. In some embodiments, the cells are eukaryotic cells, e.g., cells of a multicellular organism, e.g., an animal, e.g., a mammal (e.g., human, swine, bovine) a bird (e.g., poultry, such as chicken, turkey, or duck), or a fish. In some embodiments, the cells are non-human animal cells (e.g., a laboratory animal, a livestock animal, or a companion animal). In some embodiments, the cell is a stem cell (e.g., a hematopoietic stem cell), a fibroblast, or a T cell. In some embodiments, the cell is a non-dividing cell, e.g., a non-dividing fibroblast or non-dividing T cell. In some embodiments, the cell is an HSC and p53 is not upregulated or is upregulated by less than 10%, 5%, 2%, or 1%, e.g., as determined according to the method described in Example 30. The skilled artisan will understand that the components of the GENE WRITER™ system may be delivered in the form of polypeptide, nucleic acid (e.g., DNA, RNA), and combinations thereof.

For instance, delivery can use any of the following combinations for delivering the retrotransposase (e.g., as DNA encoding the retrotransposase protein, as RNA encoding the retrotransposase protein, or as the protein itself) and the template RNA (e.g., as DNA encoding the RNA, or as RNA):

1. Retrotransposase DNA+template DNA
2. Retrotransposase RNA+template DNA
3. Retrotransposase DNA+template RNA
4. Retrotransposase RNA+template RNA
5. Retrotransposase protein+template DNA
6. Retrotransposase protein+template RNA
7. Retrotransposase virus+template virus
8. Retrotransposase virus+template DNA
9. Retrotransposase virus+template RNA
10. Retrotransposase DNA+template virus
11. Retrotransposase RNA+template virus
12. Retrotransposase protein+template virus As indicated above, in some embodiments, the DNA or RNA that encodes the retrotransposase protein is delivered using a virus, and in some embodiments, the template RNA (or the DNA encoding the template RNA) is delivered using a virus.

In one embodiments the system and/or components of the system are delivered as nucleic acid. For example, the GENE WRITER™ polypeptide may be delivered in the form of a DNA or RNA encoding the polypeptide, and the template RNA may be delivered in the form of RNA or its complementary DNA to be transcribed into RNA. In some embodiments the system or components of the system are delivered on 1, 2, 3, 4, or more distinct nucleic acid molecules. In some embodiments the system or components of the system are delivered as a combination of DNA and RNA. In some embodiments the system or components of the system are delivered as a combination of DNA and protein. In some embodiments the system or components of the system are delivered as a combination of RNA and protein. In some embodiments the GENE WRITER™ genome editor polypeptide is delivered as a protein.

In some embodiments the system or components of the system are delivered to cells, e.g. mammalian cells or human cells, using a vector. The vector may be, e.g., a plasmid or a virus. In some embodiments delivery is in vivo, in vitro, ex vivo, or in situ. In some embodiments the virus is an adeno associated virus (AAV), a lentivirus, an adenovirus. In some embodiments the system or components of the system are delivered to cells with a viral-like particle or a virosome. In some embodiments the delivery uses more than one virus, viral-like particle or virosome.

In one embodiment, the compositions and systems described herein can be formulated in liposomes or other similar vesicles. Liposomes are spherical vesicle structures composed of a uni- or multilamellar lipid bilayer surrounding internal aqueous compartments and a relatively impermeable outer lipophilic phospholipid bilayer. Liposomes may be anionic, neutral or cationic. Liposomes are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011 for review).

Vesicles can be made from several different types of lipids; however, phospholipids are most commonly used to generate liposomes as drug carriers. Methods for preparation of multilamellar vesicle lipids are known in the art (see for example U.S. Pat. No. 6,693,086, the teachings of which relating to multilamellar vesicle lipid preparation are incorporated herein by reference). Although vesicle formation can be spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011 for review). Extruded lipids can be prepared by extruding through filters of decreasing size, as described in Templeton et al., Nature Biotech, 15:647-652, 1997, the teachings of which relating to extruded lipid preparation are incorporated herein by reference.

Lipid nanoparticles are another example of a carrier that provides a biocompatible and biodegradable delivery system for the pharmaceutical compositions described herein. Nanostructured lipid carriers (NLCs) are modified solid lipid nanoparticles (SLNs) that retain the characteristics of the SLN, improve drug stability and loading capacity, and prevent drug leakage. Polymer nanoparticles (PNPs) are an important component of drug delivery. These nanoparticles can effectively direct drug delivery to specific targets and improve drug stability and controlled drug release. Lipid-polymer nanoparticles (PLNs), a new type of carrier that combines liposomes and polymers, may also be employed. These nanoparticles possess the complementary advantages of PNPs and liposomes. A PLN is composed of a core-shell structure; the polymer core provides a stable structure, and the phospholipid shell offers good biocompatibility. As such, the two components increase the drug encapsulation efficiency rate, facilitate surface modification, and prevent leakage of water-soluble drugs. For a review, see, e.g., Li et al. 2017, Nanomaterials 7, 122.

Exosomes can also be used as drug delivery vehicles for the compositions and systems described herein. For a review, see Ha et al. July 2016. Acta Pharmaceutica *Sinica* B. Volume 6, Issue 4, Pages 287-296.

A GENE WRITER™ system can be introduced into cells, tissues and multicellular organisms. In some embodiments the system or components of the system are delivered to the cells via mechanical means or physical means.

Formulation of protein therapeutics is described in Meyer (Ed.), *Therapeutic Protein Drug Products: Practical Approaches to formulation in the Laboratory, Manufacturing, and the Clinic*, Woodhead Publishing Series (2012).

All publications, patent applications, patents, and other publications and references (e.g., sequence database reference numbers) cited herein are incorporated by reference in their entirety. For example, all GENBANK™, UNIGENE™, and ENTREZ™ sequences referred to herein, e.g., in any Table herein, are incorporated by reference. Unless otherwise specified, the sequence accession numbers specified herein, including in any Table herein, refer to the database entries current as of Aug. 27, 2018. When one gene or protein references a plurality of sequence accession numbers, all of the sequence variants are encompassed.

EXAMPLES

The invention is further illustrated by the following examples. The examples are provided for illustrative purposes only and are not to be construed as limiting the scope or content of the invention in any way.

Example 1: Delivery of a GENE WRITER™ System to Mammalian Cells

This example describes a GENE WRITER™ genome editing system delivered to a mammalian cell for site-specific insertion of exogenous DNA into a mammalian cell genome.

In this example, the polypeptide component of the GENE WRITER™ system is the R2Bm protein from *Bombyx mori* and the template RNA component is RNA for the R2Bm retrotransposase from *Bombyx mori* containing a mutation in the reverse transcriptase domain that renders the retrotransposase inactive.

HEK293T cells are transfected with the following test agents:

1. Scrambled RNA control
2. RNA coding for the polypeptide described above
3. Template RNA described above
4. Combination of 2 and 3

After transfection, HEK293T cells are cultured for at least 4 days and then assayed for site-specific genome editing. Genomic DNA is isolated from each group of HEK293 cells. PCR is conducted with primers that flank the R2Bm integration site in 28s rRNA genes. The PCR product is run on an agarose gel to measure the length of the amplified DNA.

A PCR product of the expected length, indicative of a successful GENE WRITING™ genome editing event that inserts the sequence for the mutated R2Bm retrotransposase into the target genome, is observed only in cells that were transfected with the complete GENE WRITER™ system of group 4 above.

Example 2: Site-Specific Targeted Delivery of a GENE WRITER™ System into Insect Cells This example describes a GENE WRITER™ genome editing system delivered to an insect cell at a specific target site of the genome.

In this example, the polypeptide component of the GENE WRITER™ system is derived from R2Bm of *Bombyx mori*, which is modified by replacing its DNA binding domain in the amino terminus of the polypeptide with a heterologous zinc-finger DNA binding domain. The zinc finger DNA binding domain is known to bind to DNA in the BmBLOS2 loci of *B. mori* cells (Takasu et al., insect Biochemistry and Molecular Biology 40(10): 759-765, 2010). The template RNA is RNA for the R2Bm retrotransposase from *Bombyx mori* containing a mutation in the reverse transcriptase domain that renders the retrotransposase inactive. Furthermore, the template RNA is modified at the 5' end to have 180 bases of homology to the target DNA site.

*B. mori* insect cell lines are transfected with the following test agents:

1. Scrambled RNA control
2. RNA coding for polypeptide component described above
3. Template RNA described above
4. Combination of 2 and 3

After transfection, the cells are cultured for at least 4 days and assayed for site-specific GENE WRITING™ genome editing. Genomic DNA is isolated from the cells and PCR is conducted with primers that flank the target integration site in the genome. The PCR product is run on an agarose gel to measure the length of DNA. A PCR product of the expected length, indicative of a successful GENE WRITING™ genome editing event that inserts the sequence for the mutated R2Bm retrotransposase into the target insect cell genome, is observed only in cells that were transfected with the complete GENE WRITER™ system of group 4 above.

Example 3: Site-Specific Targeted Delivery of a GENE WRITER™ System into Mammalian Cells This example describes a GENE WRITER™ genome editor system used to insert a heterologous sequence into a specific site of the mammalian genome.

In this example, the polypeptide of the system is the R2Bm protein from *Bombyx mori* and the template RNA component is RNA coding for the GFP protein and flanked at the 5' end by the 5' UTR and at the 3' end by the 3' UTR of the R2Bm retrotransposase from *Bombyx mori*. The GFP gene has an internal ribosomal entry site upstream of its start codon and a polyA tail downstream of its stop codon.

HEK293 cells are transfected with the following test agents:

1. Scrambled RNA control
2. RNA coding for the polypeptide described above
3. Template RNA coding for GFP described above
4. Combination of 2 and 3

After transfection, HEK293 cells are cultured for at least 4 days and then assayed for a site-specific GENE WRITING™ genome editing event. Genomic DNA is isolated from the HEK293 cells and PCR is conducted with primers that flank the R2Bm integration site in 28s rRNA genes. The PCR product is run on an agarose gel to measure the length of DNA. A PCR product of the expected length, indicative of a successful GENE WRITING™ genome editing event, is detected in cells transfected with the test agent of group 4 (complete GENE WRITER™ system). This result demonstrates that a GENE WRITING™ genome editing system can insert a novel transgene into the mammalian cell genome.

The transfected cells are cultured for a further 10 days, and after multiple cell culture passages are assayed for GFP expression via flow cytometry. The percent of cells that are GFP positive from each cell population are calculated. GFP positive cells are detected in the population of HEK293 cells that were transfected with the test agent of group 4 (complete GENE WRITER™ system). This result demonstrates that the novel transgene written into the mammalian cell genome is expressed.

Example 4: Targeted Delivery of a Gene Expression Unit into Mammalian Cells Using a GENE WRITER™ System This example describes the making and using of a GENE WRITER™ genome editor to insert a heterologous gene expression unit into the mammalian genome.

In this example, the polypeptide of the GENE WRITER™ system is derived from the R2Bm polypeptide of *Bombyx mori* as modified by replacing its DNA binding domain in the amino terminus of the polypeptide with a heterologous zinc-finger DNA binding domain. The zinc finger DNA binding domain is known to bind to DNA in the AAVS1 locus of human cells (Hockemeyer et al., Nature Biotechnology 27(9): 851-857, 2009). The template RNA comprises a gene expression unit. A gene expression unit comprises at least one regulatory sequence operably linked to at least one coding sequence. In this example, the regulatory sequences include the CMV promoter and enhancer, an enhanced translation element, and a WPRE. The coding sequence is the GFP open reading frame. The gene expression unit is flanked at the 5' end by 180 bases of homology to the target DNA site and at the 3' end by the 3' UTR of the R2Bm retrotransposase from *Bombyx mori*.

HEK293 cells are transfected with the following test agents:

1. Scrambled control RNA
2. RNA coding for the polypeptide component described above
3. Template RNA comprising the gene expression unit (as described above)

4. The complete GENE WRITER™ system comprising both (2) and (3)

After transfection, HEK293 cells are cultured for at least 4 days and assayed for site-specific GENE WRITING™ genome editing. Genomic DNA is isolated from the HEK293 cells and PCR is conducted with primers that flank the target integration site in the genome. The PCR product is run on an agarose gel to measure the length of DNA. A PCR product of the expected length, indicative of a successful GENE WRITING™ genome editing event, is detected in cells transfected with the test agent of group 4 (complete GENE WRITER™ system).

The transfected cells are cultured for a further 10 days, and after multiple cell culture passages are assayed for GFP expression via flow cytometry. The percent of cells that are GFP positive from each cell population are calculated. GFP positive cells are detected in the population of HEK293 cells that were transfected with group 4 test agent, demonstrating that a gene expression unit added into the mammalian cell genome via GENE WRITING™ genome editing is expressed.

Example 5: Targeted Delivery of a Gene Expression Unit into an Intronic Region of Mammalian Cells Using a GENE WRITER™ System This example describes the making and use of a GENE WRITING™ genome editing system to add a heterologous sequence into an intronic region to act as a splice acceptor for an upstream exon.

The target integration site is the first intron of the albumin locus. Splicing into the first intron a new exon containing a splice acceptor site at the 5' end and a polyA tail at the 3' end will result in a mature mRNA containing the first natural exon of the albumin locus spliced to the new exon. Because the first exon of albumin is removed upon protein processing, the cell expressing the newly formed gene unit will secrete a mature protein comprising only the new exon.

In this example, the GENE WRITER™ genome editor polypeptide is derived from the R2Bm GENE WRITER™ genome editor of *Bombyx mori* as modified by replacing the DNA binding domain in the amino terminus of the polypeptide with a heterologous zinc-finger DNA binding domain. The zinc finger DNA binding domain is known to bind tightly to the albumin locus in the first intron as described in Sarma et al., Blood 126, 15: 1777-1784, 2015. The template RNA is RNA coding for EPO with a splice acceptor site immediately 5' to the first amino acid of mature EPO (the start codon and signal peptide is removed) and a 3' polyA tail downstream of the stop codon. The EPO RNA is further flanked at the 5' end by 180 bases of homology to target DNA site and at the 3' end by the 3' UTR of the R2Bm retrotransposase from *Bombyx mori*.

HEK293 cells are transfected with the following test agents:

1. Scrambled control RNA
2. RNA coding for the polypeptide described above
3. Template RNA comprising the EPO splice acceptor described above
4. The complete GENE WRITER™ system comprising both (2) and (3)

After transfection, HEK293 cells are cultured for at least 4 days and assayed for site-specific GENE WRITING™ genome editing and appropriate mRNA processing. Genomic DNA is isolated from the HEK293 cells. Reverse transcription-PCR is conducted to measure the mature mRNA containing the first natural exon of the albumin locus and the new exon. The RT-PCR reaction is conducted with forward primers that bind to the first natural exon of the albumin locus and with reverse primers that bind to EPO. The RT-PCR product is run on an agarose gel to measure the length of DNA. A PCR product of the expected length is detected in cells transfected with the test agent of group 4, indicative of a successful GENE WRITING™ genome editing event and a successful splice event. This result demonstrates that a GENE WRITING™ genome editing system can add a heterologous sequence encoding a gene into an intronic region to act as a splice acceptor for the upstream exon.

The transfected cells are cultured for a further 10 days, and after multiple cell culture passages are assayed for EPO secretion in the cell supernatant. The amount of EPO in the supernatant is measured via an EPO ELISA kit. EPO is detected in HEK293 cells that were transfected with the test agent of group 4, demonstrating that a heterologous sequence can be added into an intronic region via GENE WRITING™ genome editing, to act as a splice acceptor for the upstream exon and is actively expressed.

Example 6: Targeted Delivery of R2Tg Retrotransposon to Mammalian Cells

This example describes targeted integration of the R2Tg retrotransposon element (see first row of Table 3 herein) to mammalian cells via DNA or RNA delivery.

R2Tg is an endogenous retrotransposon from the zebra finch (*Taenopygia guttata*). Because non-LTR R2 elements are not present in the human genome and are thought to be highly site-specific, the ability of R2Tg to accurately and efficiently integrate itself into the human genome would demonstrate the capability to perform genomic targeted integration and possibly enable human gene therapy.

In the DNA delivery method, plasmid harboring R2Tg (PLV014) was designed and synthesized such that the R2Tg element was codon optimized and flanked by its native un-translated regions (UTRs), with or without further flanking by 100 bp homology to the rDNA target locus. The R2Tg element expression was driven by the mammalian CMV promoter. Further, a 1 bp deletion mutant (678*) having a frameshift in the coding sequence of the retrotransposase was constructed as an inactivated control ("frameshift mutant"). Each plasmid was introduced into HEK393T cells via FuGENE® HD transfection reagent. HEK293T cells were seeded in 96-well plate, 10,000 cells/well 24 hr before transfection. On the transfection day, 0.5 μl transfection reagent and 80 ng DNA was mixed in 10 μl Opti-MEM and incubated for 15 min at room temperature. Then the transfection mixture was added to the medium of the seeded cells. 3 days after transfection, genomic DNA was extracted for retrotransposition assays.

Next, integration of the R2Tg transposase into the human genome was assessed. Based on homology to the finch genome, a putative integration site in human rDNA was tested. Advanced MISEQ™ and ddPCR assays were used to assess integration.

Figure 7:
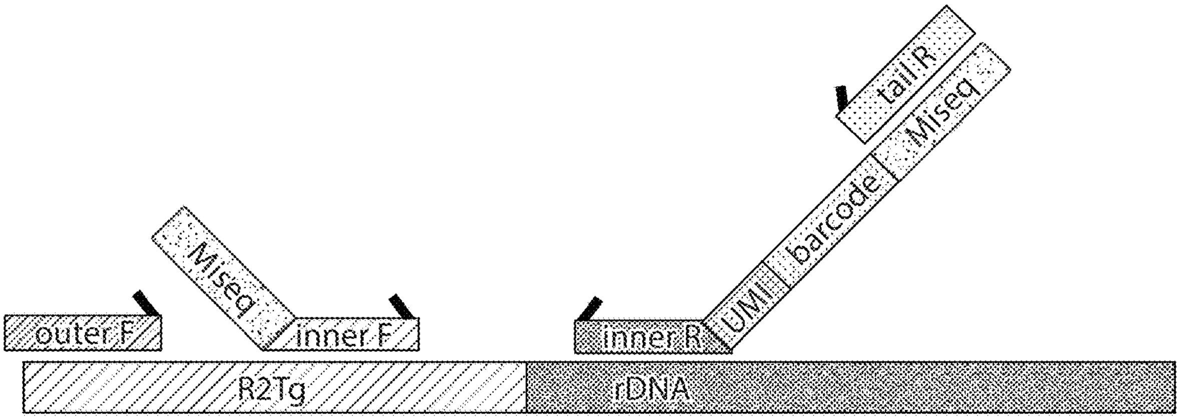
FIG. 7 illustrates a schematic of MISEQ™ library construction. Nested PCR was performed across the R2Tg-rDNA junction using (1) outer forward primer and tailed inner reverse primer followed by (2) tailed inner forward primer and tail reverse primer. The inner reverse primer contains a 1-4 base stagger, an 8-nucleotide randomized UMI, and a multiplexing barcode. The UMI allows for counting of individual amplification events to eliminate PCR bias.
Figure 8A:
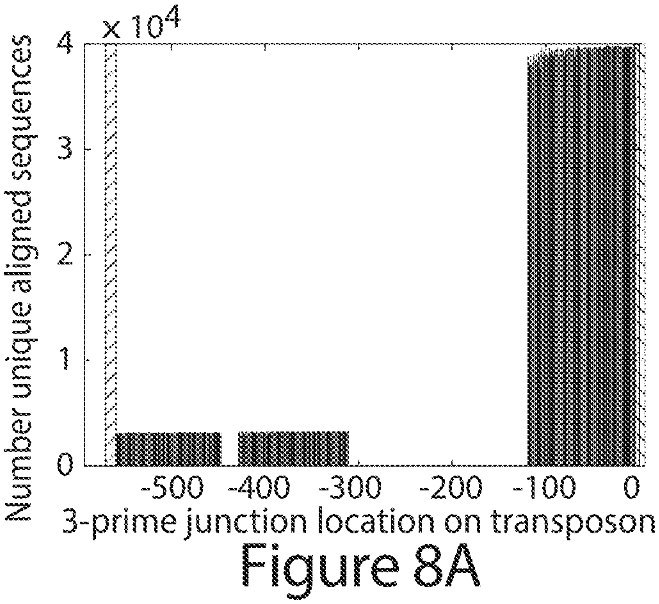
FIGS. 8A-8B: Results of MISEQ™ and MATLAB™ analysis of DNA-mediated R2Tg integration into Hek293T cells. Each graph shows analysis of (FIG. 8A) the experimental R2Tg (FIG. 8B) and 1 bp deletion negative control. The y-axis indicates aligned counts of unique sequences determined via unique UMIs found via MATLAB™. The X-axis indicates the sequence position of sequence coverage. The vertical gray line at the left of the graph indicates the position of the forward primer, while the vertical gray line at the right of the graph indicates the expected Tg-rDNA junction site. Bars at the right end of the graph indicate insertion without a truncation, and bars at the left end of the graph indicate truncation.
Figure 8B:
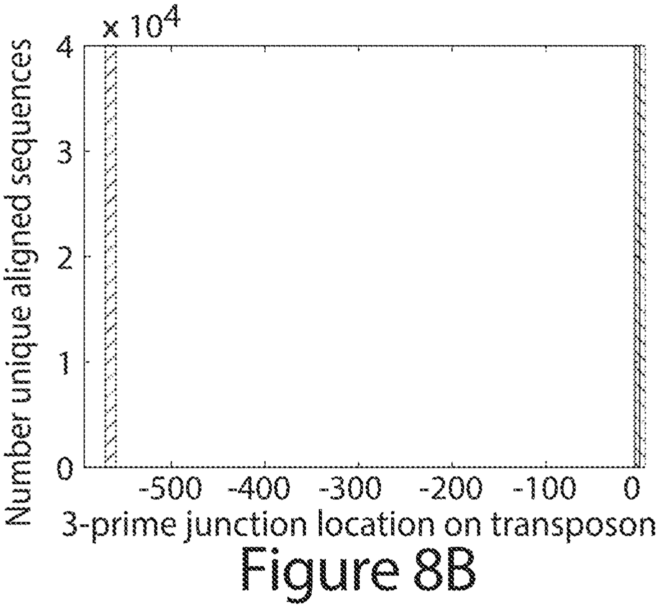
Figure 9:
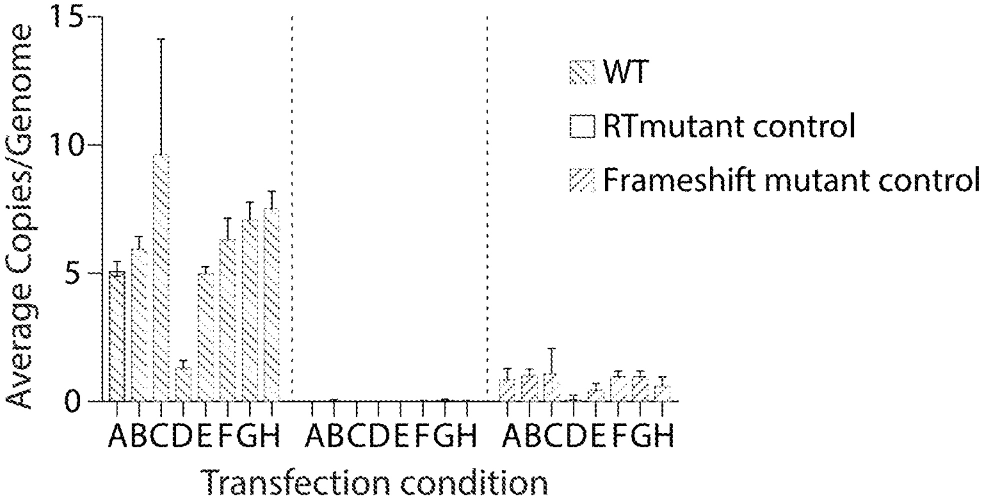
FIG. 9 shows a ddPCR evaluation of copy number variation of the R2Tg-rDNA junction in human cells across transfection conditions. Forward primer and probe were expected to bind to the 3' UTR of the R2Tg, while reverse primer was targeted to the human rDNA. The resulting ddPCR signal was normalized to that of reference assay RPP30 to determine copy number. Significantly higher average copies per genome were found with the wildtype (WT, left set of bars) R2Tg as compared to genetic control altering translation with a 1-bp deletion (Frameshift mutant control, right set of bars).

Bias in MISEQ™ library construction was eliminated by introducing random unique molecular indices (UMIs) into initial PCRs (FIG. 7). Nested PCR was performed by first amplifying the expected 3' junction of R2Tg and the rDNA locus for 30 cycles. One MISEQ™ adapter, a multiplexing barcode, and an 8 bp UMI were introduced at this step. A second PCR was used to further enrich for expected products and add the second MISEQ™ adapter. Samples were sequenced on the MISEQ™ for 300 cycles. After demultiplexing, the samples were analyzed via MATLAB™. First, the UMI on each sequence was located by searching for neighboring sequence. A database of UMIs was created and next collapsed by uniqueness. For each unique read, for a search was performed for the sequence of the expected rDNA integration site and isolated sequences of aligned human genomic DNA and exogenous DNA. Exogenous DNA was then aligned to the expected integration sequence. Results of the MISEQ™ analysis pipeline are shown in FIGS. 8A-8B. Extensive unique integrations into the predicted integration site were found in cells treated with the wildtype R2Tg construct flanked by 100 bp homology to the target rDNA locus, but not with the frameshift mutant controls. Most integration events have a complete template RNA sequence integrated in the 565 bp most proximal to the integration site as demonstrated by sequencing reads that align perfectly to the expected sequence. A subset of integration events with the experimental R2Tg have either a ~300 bp or ~450 truncation as based upon sequencing reads that align to the expected sequence after a gap directly adjacent to the target site (FIG. 8A). More specifically, 86.17% of integrants observed were non-truncated in the 565 bp most proximal to the integration site. In contrast, FIG. 8B shows no integration events detected. Constructs without flanking rDNA homology showed insignificant integration signals near noise.

ddPCR was next performed to confirm integration and assess integration efficiency. A Taqman probe was designed to the 3'UTR portion of the R2Tg element. A forward primer was synthesized to bind directly upstream of the probe, and a reverse primer was synthesized to bind the rDNA. Therefore, amplification of the expected product across the integration junction degrades the probe and creates a fluorescent signal. ddPCR was performed on several replicate experiments of the above plasmids to determine the average copy number of the R2Tg integration event. The results of ddPCR copy number analysis (in comparison to reference gene RPP30) are shown in FIG. 9. Across several plasmid transfection conditions, average integration of 5 or more copies of R2Tg per genome at the target site when delivered with homology was noted with significant increase above control constructs. In contrast, the average copy number per genome in the frameshift mutant negative control was typically lower than 1. Insignificant signal was seen when constructs without homology were delivered to cells. The experiments collectively suggest efficient integration of the R2Tg retrotransposon into human cells at the target site.

In the RNA delivery method, R2Tg RNA (RNAV019) was designed such that the R2Tg element was codon optimized and flanked by its native untranslated regions (UTRs). More specifically, the construct includes, in order: a T7 promoter, a 5' 28S target homology region 100 nucleotides in length, a R2Tg wild-type 5' UTR, the R2Tg codon-optimized coding sequence, a R2Tg wild type 3' UTR, and a 3' 28S target homology region 100 nucleotides in length. The 100 bp 28S homology sequences were added outside of the UTRs to enhance the integration. R2Tg RNA was synthesized, and cap and polyA tail were added. The R2Tg element transcription was driven by the T7 promoter. The RNA was introduced into HEK393T cells via Lipofectamine™ RNAiMAX or TransIT®-mRNA transfection reagent with series of RNA dosages. HEK293T cells were seeded in 96-well plate 24 hr before transfection. On the transfection day, transfection reagent and RNA were mixed in 10 μl Opti-MEM, and the transfection mixture was added to the medium of the seeded cells. 3 days after transfection, genomic DNA was extracted to measure retrotransposition efficiency using ddPCR with the same design as the DNA delivery.

Figure 12:
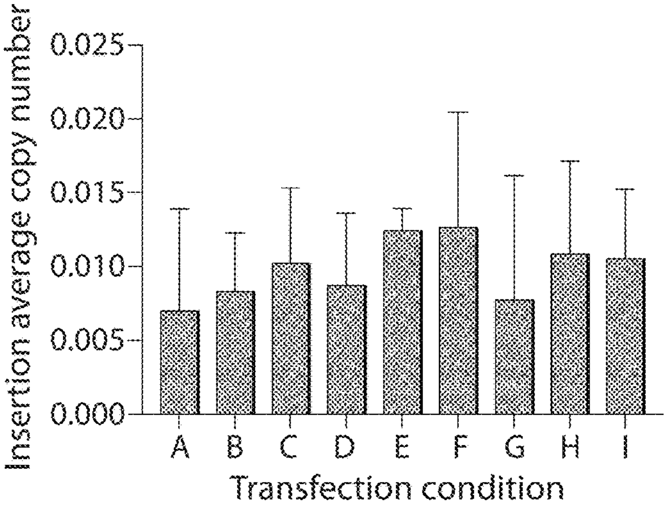
FIG. 12 is a graph showing retrotransposition efficiency measured by ddPCR (digital droplet PCR) using different transfection conditions. Bars A-C represent samples that were transfected using 0.15 μl Lipofectamine™ RNAiMAX with 100 ng, 250 ng, or 500 ng respectively. Bars D-F represent samples that were transfected using 0.3 μl Lipofectamine™ RNAiMAX with 100 ng, 250 ng, or 500 ng respectively. Bars G-I represent samples that were transfected using 1 μl TransIT®-mRNA transfection kit with 100 ng, 250 ng, or 500 ng respectively.

The results of ddPCR copy number analysis (normalized to reference gene RPP30) are shown in FIG. 12. Across several transfection conditions, the average integration was measured to be 0.01 of R2Tg copies per genome, significantly above the limit of detection. The results indicate successful integration of the R2Tg retrotransposon into human cells using an RNA delivery method.

Example 7: Targeted Delivery of a Heterologous Object Sequence Using R2Tg Retrotransposon to Mammalian Cells This example describes the delivery of a transgene to human cells by utilizing the R2Tg retrotransposon system with multiple delivery machineries, including RNA-mediated delivery of a heterologous object sequence to human cells by utilizing the R2Tg retrotransposon system.

R2 proteins recognize their template RNA structure in untranslated regions (UTRs) of each element to form ribonucleoprotein particles, which serve as the intermediates of downstream integration into a host genome. Therefore, the decoupling of UTRs from their native context and the introduction of UTRs into alternate exogenous sequence was engineered to deliver into the genome a desired nucleic acid using R2Tg machinery.

Figure 13:
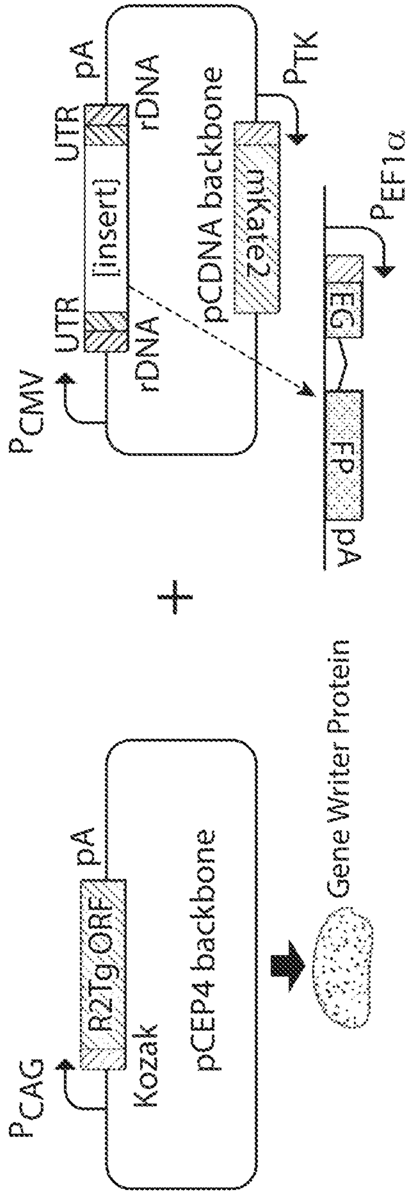
FIG. 13. Schematic of trans-transgene delivery machinery. This schematic illustrates a driver plasmid (left) with a pCEP4 backbone, which encodes the reverse transcriptase R2Tg, with a promoter and Kozak sequence upstream, and a polyadenylation signal downstream. The driver plasmid can drive expression of the GENE WRITER™ protein. The transgene plasmid (right), with a pCDNA backbone, comprises (in order) a CMV promoter, an rDNA homology sequence, a 5' UTR, an antisense-orientation insert, a 3' UTR, a second rDNA homology sequence, a second polyadenylation signal, and a TK promoter driving a mKate2 marker. The antisense-orientation insert comprises an EF1α promoter, a coding region for EGFP that comprises an intron, and a polyadenylation signal. Use of the CMV promoter in the trangene plasmid drives expression of a template RNA comprising the rDNA homology regions, the UTRs, and the antisense-orientation insert.
Figure 14:
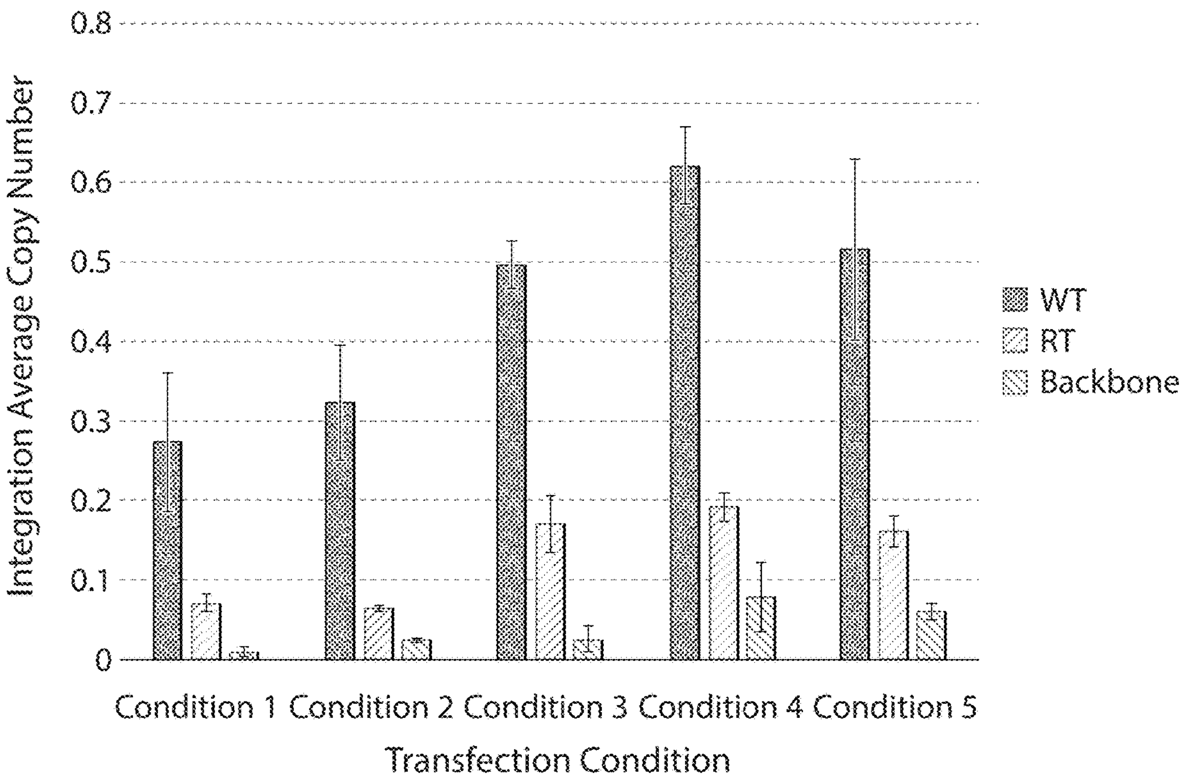
FIG. 14 shows ddPCR evaluation of copy number variation of the transgene-rDNA junction in human cells across transfection conditions. Forward primer and probe were designed to bind to the 3' UTR of the R2Tg, while reverse primer was targeted to the human rDNA. The resulting ddPCR signal was normalized to that of reference assay RPP30 to determine copy number. Significantly higher average copies per genome were found with the wildtype (WT) R2Tg as compared to backbone construct with no R2Tg sequence involved. Condition 1 denotes a driver plasmid: transgene plasmid molar ratio of 9:1; condition 2 denotes the ratio is 4:1, condition 3 denotes the ratio is 1:1, condition 4 denotes the ratio is 1:4, and condition 5 denotes the ratio is 1:9.

Trans-transgene integration was tested by constructing 1) R2Tg coding sequence and 2) transgene cassette flanked by R2Tg UTR sequences and 100 bp homology to 28S rDNA into separate driver and transgene plasmids, respectively. FIG. 13 illustrates the dual plasmid system. The dual plasmids were introduced into HEK293T cells via FuGENE® HD transfection reagent at multiple driver to transgene molar ratios. In addition to the WT R2Tg driver, backbone plasmid was used as a control. HEK293T cells were seeded in 96-well plates at 10,000 cells/well 24 hr before transfection. On the transfection day, transfection reagent and plasmids were mixed in 10 μl Opti-MEM and incubated for 15 minutes at room temperature, then added to the medium of the seeded cells. 3 days after transfection, genomic DNA was extracted for ddPCR assays to investigate the trans-retrotransposition efficiency. FIG. 14 demonstrates the ddPCR results for conditions with excess of transgene relative to driver.

Similar to the trans-transgene delivery with plasmids, RNA delivery was performed by constructing an amplicon of the coding sequence of R2Tg preceded by the T7 promoter sequence. The constructed amplicons contained the experimental R2Tg element as well as the 1 bp deletion frameshift mutant control. Separately, an amplicon was constructed that contained exogenous sequence coding for GFP and an EGF1-alpha reporter that was flanked regions sufficient to drive integration into the genome by R2Tg. More specifically, the construct included: a T7 promoter driving transcription of the RNA, wherein the RNA comprises, from 5' to 3', (a) a 5' 28S homology region of 10 nt in length, (b) a 5' untranslated region, (c) an anti-sense TKpA polyA sequence, (d) an anti-sense heterologous object sequence that encodes GFP, (e) an anti-sense Kozak sequence, (f) an anti-sense EF1 alpha promoter, (g) a 3' untranslated region that binds the GENE WRITER™ protein, and (h) a 3' 28S homology region of 10 nt in length. Each RNA was transcribed via the New England Biolabs HiScribe T7 ARCA kit and purified via Zymo RNA clean and concentrator.

The resulting heterologous object RNA and R2Tg RNA (either the experiment R2Tg element or frameshift mutant) were introduced into human HEK293T cells via TransIT®-mRNA Transfection Kit at 1:1 molar ratio. HEK293T cells were seeded in 96-well plate, 40,000 cells/well 24 hr before transfection. On the transfection day, 1 μl transfection reagent and 500 ng total RNA was mixed in 10 μl Opti-MEM and incubated for 5 min at room temperature. Then the transfection mixture was added to the medium of the seeded cells. 3 days after transfection, genomic DNA was extracted for PCR assays.

Figure 10:
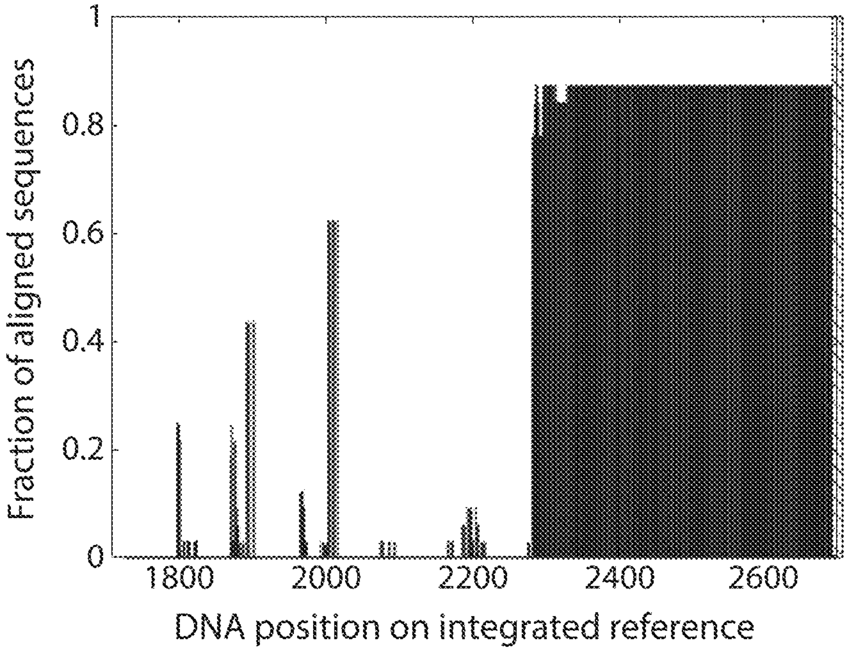
FIG. 10 illustrates the sequence alignment and coverage of TOPO cloning the nested PCR product from Example 7. The gray line at the right edge of the graph indicates the expected transgene-rDNA junction. Most sequences showed high alignment to the expected integrated product.
Figure 11:
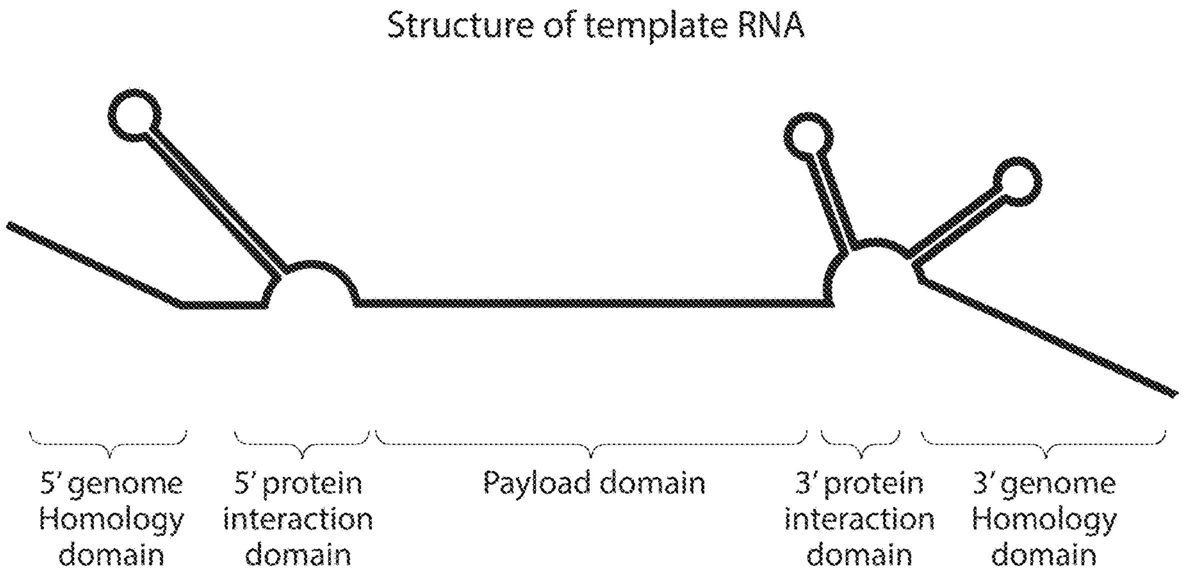
FIG. 11 is a schematic of an exemplary template RNA. It comprises a payload domain in the center (e.g., a heterologous object sequence, e.g., comprising a promoter and a protein-coding sequence). The payload domain is flanked by 5' and 3' protein interaction domains, e.g., sequences capable of binding the GENE WRITER™ polypeptide, e.g., 5' and 3' UTR sequences shown in Table 3. Flanking the protein interaction domains are 5' and 3' homology domains, which have homology to the desired insertion region in the genome.

Nested PCR was performed by with a first 30 rounds of PCR across the 3' end of the expected transgene-rDNA junction, followed by 20 additional rounds of PCR amplification using an inner primer set. One of three replicates of nested PCR performed on genomic DNA extracted from cells treated with the wild-type transposase reaction produced a PCR product of the expected size (approximately 596 bp). In contrast, no PCR product was observed in genomic DNA extracted from cells treated with the frameshift-inactivated R2Tg mutant control, or no-transfection control. The PCR product was gel-purified via Zero Blunt® TOPO® PCR Cloning Kit, and the resulting colonies were Sanger sequenced. Each individual PCR product sequence was then aligned to the expected integration sequence. The fraction of PCR product sequences that align to the expected integrated heterologous object sequence is shown in FIG. 10. The majority of PCR products had the expected integrant as demonstrated by the sequencing alignment directly adjacent to the expected integration site at the right side of the alignment figure. This demonstrates RNA-mediated integration of the exogenous sequence via R2Tg machinery into human cells.

Example 8: Targeted Delivery of R2Tg Retrotransposon to Mammalian Cells

This example describes targeted integration of the R2Tg retrotransposon element to mammalian cells via DNA delivery.

Plasmid harboring R2Tg (PLV014) and control plasmid were designed and synthesized as described above in Example 6. Each plasmid was introduced into HEK393T cells via FuGENE® HD transfection reagent. HEK293T cells were seeded in 96-well plate, 10,000 cells/well 24 hr before transfection. On the transfection day, 0.5 μl transfection reagent and 80 ng DNA was mixed in 10 μl Opti-MEM and incubated for 15 min at room temperature. Then the transfection mixture was added to the medium of the seeded cells. 3 days after transfection, genomic DNA was extracted for retrotransposition assays or cells were frozen and underwent targeted locus amplification.

Target locus amplification was performed against hg38 reference human genome and the rDNA locus sequence hsu13369 (GENBANK™: U13369.1). Two independent primer sets were used to perform targeted locus amplification. Analysis with both primer sets showed that the 28S rDNA locus sequence is the only integration site detected above a 1% threshold. Thus, integration of the R2Tg transposon in mammalian cells is specific to this target site.

Example 9: Improved Trans RNA-Templated Integration into Mammalian Cells by RNA Refolding or Ratio of Driver to Template RNA RNA templates are designed as in previous examples. Two RNAs consisting of a driver and a transgene payload are delivered to mammalian cells. To better promote folding, denaturing the payload RNA by heating to 95 C and cooling to room temperature are performed to encourage proper secondary structure formation. In some embodiments, cooling the RNA to room temperate will increase integration efficiency.

The molar ratio of transgene to driver is also varied to evaluate suitable stoichiometry of components. Integration is analyzed via ddPCR and sequencing. In some embodiments, a higher ratio of driver to transgene is used. In some embodiments, a higher ratio of transgene to driver is used.

Previous examples with cis transgene integration are similarly assayed for stoichiometry of driver to payload. Integration is analyzed via ddPCR and sequencing. In some embodiments, a higher ratio of driver transcription or translation to transgene transcription will result in higher integration efficiency. In some embodiments, a higher ratio of transgene transcription to driver transcription and translation will result in higher integration efficiency.

Example 10: Hybrid Capture Assay

Figure 15A:
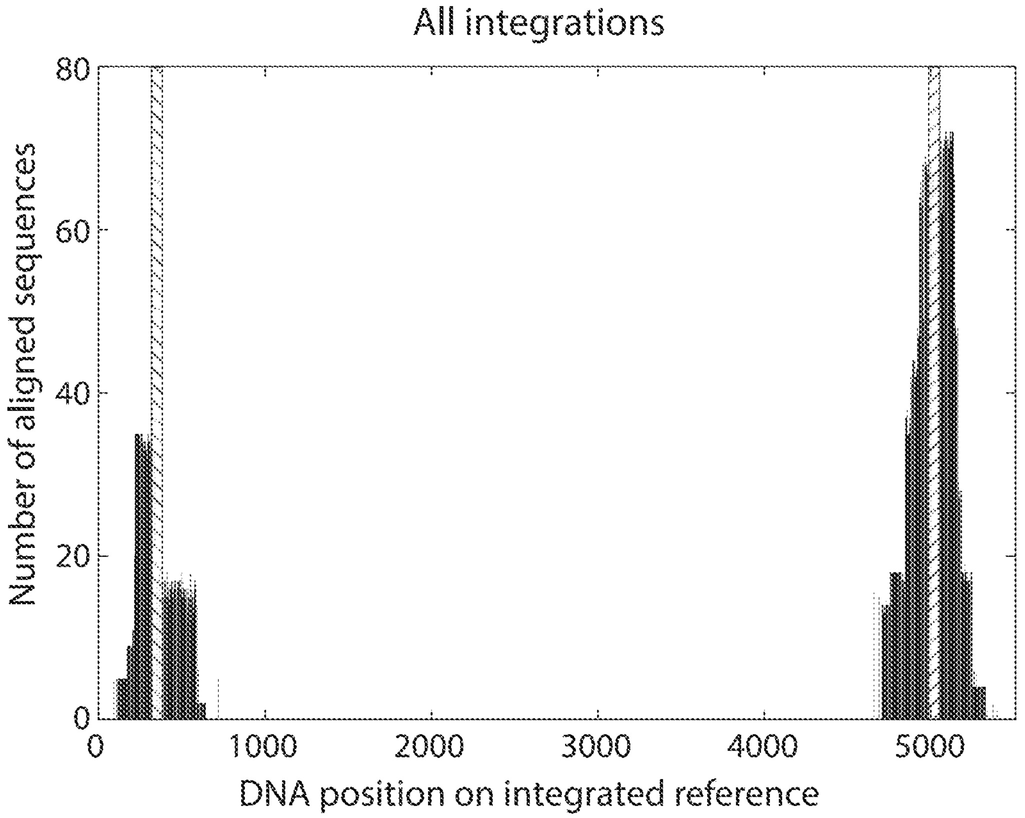
FIGS. 15A and 15B.
Figure 15B:
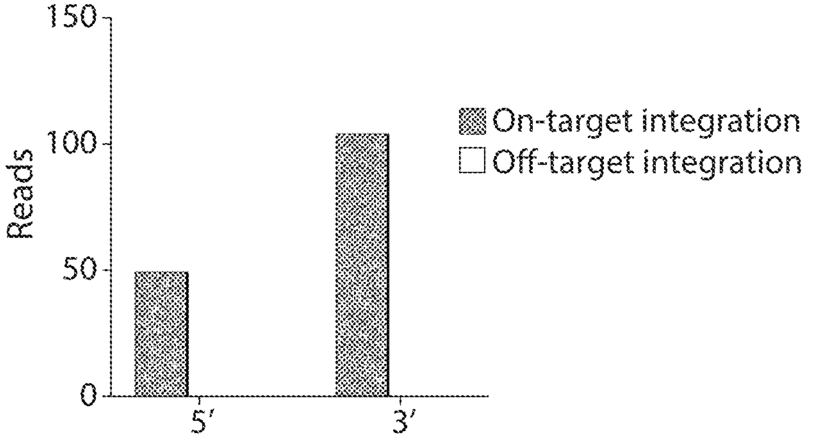

A hybrid capture experiment was performed to obtain an unbiased view of the specificity of retrotransposon integration into a target site. Retrotransposon experiments were performed as in previous examples by integrating R2Tg flanked by its native UTRs and 100 bp of homology to either side of the expected R2 rDNA target. The rDNA target site had two flanking sets of 100 nucleotides identity to the corresponding native target site. The retrotransposon was delivered to human 293T cells via plasmid or mRNA. Genomic DNA was extracted after 72 hours. After extraction, each genomic DNA sample was subjected to hybrid capture according to protocol with a custom probe set (Twist). Biotinylated probes were designed such that ~120 bp probes spanned both strands of the R2Tg coding sequence and UTRs. First, a next-generation library was created by fragmentation of the genomic DNA and ligation of sequencing adapters according to a protocol from Twist (available on the world wide web at: twistbioscience.com/ngs_protocol_custompanel_hybridcap). Next, probes were hybridized to genomic DNA libraries and the enriched samples were amplified. Final libraries were sequenced on the MISEQ™ using 300 bp paired-end reads. Custom MATLAB™ scripts were used to analyze reads. The resulting analysis is shown in FIGS. 15A and 15B for RNA delivery. Hybrid capture indicated on-target integration of R2Tg to the expected locus. With RNA delivery, 1 possible off-target with a single read was identified at an unexpected 3' junction in the data, compared to more than 100 reads at the expected locus, indicating a specificity of greater than 100:1. At the 5' junction, all 50 reads were at the expected locus, indicating a specificity of greater than 50:1. This experiment indicates a high specificity of integration.

Example 11: Long-Read PacBio Analysis

Long-range PCR amplification can be performed to measure integration of the desired full-length sequence into the target site in the human genome and to measure whether mutations are introduced during insertion. Retrotransposon integration experiments are performed as described in previous examples. In one example, PCR amplification is used to generate amplicons by designing one primer targeting the genomic integration site and one primer targeting the integrant sequence. In this example, these primers are designed to maximize the length of the amplified genomic locus fused with the integrant sequence. By pooling amplicons spanning both ends of the integrant and performing long-read next-generation sequencing, the fidelity of each integration is be evaluated.

In another example, hybrid capture is performed as described in a previous example but with a larger target library length during initial library generation. The resulting library is then subjected to long-read next-generation sequencing.

In some embodiments, long-read next generation sequencing will show that there are less than 10%, 5%, 2%, 1%, 0.5%, 0.2%, or 0.1% SNPs in the integrated DNA across samples. In some embodiments, long-read next generation sequencing will show that less than 10%, 5%, 2%, or 1% of integrated DNA has a SNP. In some embodiments, long-read next generation sequencing will show that less than 10%, 5%, 2%, or 1% of integrated DNA has an internal deletion. In some embodiments, long-read next generation sequencing will show that less than 10%, 5%, 2%, 1%, 0.5%, 0.2%, or 0.1% of total integrated DNA across the population is deleted. In some embodiments, long-read next generation sequencing will show that less than 10%, 5%, 2%, or 1% of integrated DNA is truncated.

Example 12: Experiment with Different Homology Lengths and Point Mutations in Homology In this example, experiments are designed to characterize suitable lengths and starting positions of homology to the target site for efficient retrotransposon integration. Also, the homology is used to support the mechanism of integration being reverse transcription-driven.

Figure 16:
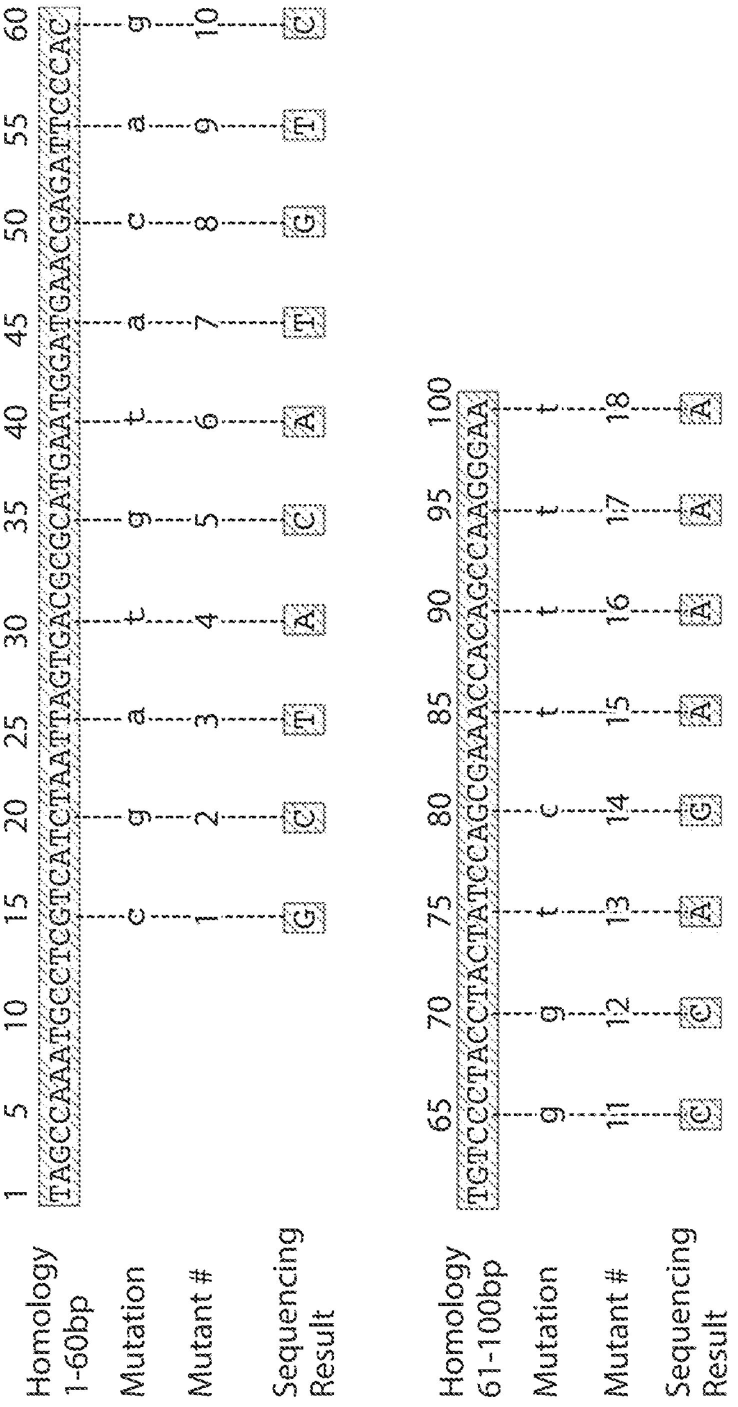
FIG. 16. Sanger sequencing result of the 3' junction nested PCR. Lowercase nucleotides represent the designed SNP. Shaded uppercase nucleotides represent WT sequence.

A series of SNPs were introduced within the 100 bp downstream homology of R2Tg plasmids by modifying plasmid PLV014. The design of the SNPs is listed in FIG. 16. After the transfection, nested PCR was applied to recover the 3' integration junction site, producing a PCR product with an expected amplicon size of about 738 bp, and the PCR product was Sanger sequenced to check whether any SNPs were incorporated. In this experiment, a lack of SNP genetic markers being incorporated into the junction sequences indicates that the integration was driven by reverse transcription. The SNP design and the sequencing result are illustrated in FIG. 16. No SNP introduction was observed for the 18 genetic markers designed, consistent with the integration of R2Tg being directed by reverse transcription.

This example also describes the evaluation different homology regions to the target site to identify shorter regions that promote efficient integration into the genome. This example describes two approaches. First, different windows of 100 bp of homology to the target site are tested, starting from bp 1-100 3' of the target site, then testing 2-101 3' of the target site, 3-103 3' of the target site, and so on, through bp 30-131 3' of the target site. Second, shorter lengths of homology to the target site sufficient for DNA integration are tested, starting with bp 0-100 3' of the target site, then testing 0-95 3' of the target site, 0-90 3' of the target site, etc. through bp 0-10 3' of the target site. After the transfection of each plasmid into 293T cells, ddPCR is used to measure the retrotransposition efficiency.

In this example, different UTR regions with different lengths are evaluated to identify shorter sequences for efficient integration into the genome. The 3'UTR is tested by dividing this 325 bp sequence into 3 regions, 1-100 bp, 101-200 bp, and 201-325 bp. Constructs of R2Tg containing each truncated 3'UTR are generated to test the integration efficiency respectively.

Example 13: Assess Whether p53 or Other Repair Pathways are Upregulated

This example describes an evaluation of the effect of exogenous R2Tg retrotranspositon on gene expression, especially tumor suppressor and DNA repair genes. An R2Tg expressing plasmid is delivered to multiple cancer cell lines, including 293T, MCF-7, and T47D. After confirmation of integration in each cell line, RNA-seq is conducted to assess the effect on gene expression profile. Gene set enrichment analysis is then applied to evaluate whether any DNA repair pathways are upregulated after retrotransposition. MCF-7 and T47D are breast cancer cell lines with wild type and mutant p53 respectively, which are be used to evaluate the relationship between p53 and retrotranspositon specifically. In some embodiments, p53 is not upregulated when a retrotransposon GENE WRITER™ integrates into the genome. In some embodiments, no DNA repair genes are upregulated when a retrotransposon GENE WRITER™ integrates into the genome. In some embodiments, no tumor suppressor genes are upregulated when a retrotransposon GENE WRITER™ integrates into the genome.

Example 14: Retrotransposition in Presence of DNA Repair Inhibitors

In this example, experiments will test the effect of different DNA repair pathways on R2Tg retrotransposition via the application of DNA repair pathway inhibitors or DNA repair pathway deficient cell lines. When applying DNA repair pathway inhibitors, PrestoBlue cell viability assay is performed first to determine the toxicity of the inhibitors and whether any normalization should be applied for following assays. SCR7 is an inhibitor for NHEJ, which is applied at a series of dilutions during R2Tg delivery. PARP protein is a nuclear enzyme that binds as homodimers to both single- and double-strand breaks. Thus, its inhibitors are be used in the test of relevant DNA repair pathways, including homologous recombination repair pathway and base excision repair pathway. The experiment procedure is the same with that of SCR7. Cell lines with deficient core proteins of nucleotide excision repair (NER) pathway are used to test the effect of NER on R2Tg retrotransposition. After the delivery of R2Tg element into the cell, ddPCR is be used to evaluate the retrotransposition in the context of inhibition of DNA repair pathways. Sequencing analysis is also be performed to evaluate whether certain DNA repair pathway plays a role in the alteration of integration junction. In some embodiments, R2Tg integration into the genome will not be decreased by the knockdown of any DNA repair pathways, suggesting that R2Tg does not rely on the host cell pathways for DNA integration.

Example 15: Retrotransposition in Fibroblasts and in T Cells

In this example, the previously performed R2Tg retrotransposition analysis of 293T cells is repeated in non-dividing cells, including fibroblast and T cells. Compared to 293T cells, non-dividing cells are sometimes more difficult to transfect with lipid reagent. Thus, nucleofection is used for the delivery of R2Tg element. The subsequent retrotransposition assay for integrating efficiency and sequencing analysis will be performed as described herein for 293T cells. In some embodiments, R2Tg integrates into the genome of fibroblasts and T cells.

Example 16: Single Cell ddPCR

In this example, a quantitative assay is used to determine the frequency of targeted genome integration at single cell level, and that information can be compared to the copy number of targeted genome integration per genome quantified from genomic DNA.

Approximately 5000 transfected cells will be collected and mixed with ddPCR reaction mixture before distributing into about 20,000 droplets, with the aim of each droplet containing one cell or no cells. ddPCR assays including 5'UTR and 3'UTR assays will be performed as described above to determine the frequency of R2 or transgene integration at single cell level. A control experiment will be performed in parallel using genomic DNA harvested from the same number of cells to determine the targeted genome integration efficiency per genome. In some embodiments, the frequency of targeted genome integration at the single cell level is calculated to be 1-80%, e.g., 25%, wherein the indicated percentage of cells have one or more copies of the transgene integrated into the desired locus.

Example 17: Single Cell Analysis Via Colony Isolation

In this example, a quantitative assay is used to determine genome integration copy number in cell colonies derived from single cell.

Single cell colonies will be isolated by colony picking up or by limited dilution and cultured in a 96 well format. When the cells reach >80% confluency, half of the cells will be frozen for backup and genomic DNA from the other half of the cells will be harvested for ddPCR. Optimized ddPCR assays including 5'UTR and 3'UTR assays will be performed as described previously to determine the frequency of R2 or transgene integration. At least 96 colonies will be screened for each R2 element with appropriate controls. The total number of colonies to be screened will be determined by single cell ddPCR data if applicable or the first set of single cell colony screen data. In some embodiments, the frequency of targeted genome integration at the single cell level will be calculated to be 1-80%, e.g., 25%, wherein the indicated percentage of cells have a single copy of the transgene integrated into the desired locus. The assay can also be used to determine the percentage of colonies that have more than one copy of the transgene integrated into the desired locus.

Example 18: DNA Binding Affinity and/or Re-Targeting

The DNA targeting module of wild-type R2 is made of a cysteine-histidine zinc finger and c-Myb transcription factor binding motifs. This N-terminal module can be substituted with different DNA binding modules such as DNA binding protein(s) (e.g., transcription factors), zinc finger(s) (e.g., natural or designed motifs), and/or nucleic acid guided, catalytically inactive endonucleases (e.g., Cas9 bound with a guide RNA (e.g., sgRNA) to form a Cas9-RNP). This DNA binding module is swapped for the naturally occurring module and, in some cases placed with a flexible linker attaching it to the RNA binding/RT module. Additionally, in some constructions, this new DNA binding module is placed in tandem with the same and/or different DNA binding modules. Furthermore, some constructions may split the GENE WRITER™ protein where one protein molecule contains the RNA binding module and the other protein contains the RT and endonuclease modules. In some embodiments, swapping of the DNA module increases specificity and/or affinity to a genomic location and in some cases allows for the specific targeting of new genomic locations.

Example 19: Assays to Measure DNA Binding Affinity

DNA binding activity of GENE WRITER™ genome editor polypeptides described herein (and DNA binding domains for the same) can be tested, e.g., as described in this example. DNA binding modules are purified by recombinantly expressing them in cells (e.g., *E. coli*) or they are expressed in a cell-free reactions of transcription and translation (e.g., T7 RNA polymerase+wheat germ extract). The purified DNA binding module(s) is tested for binding affinity by measuring the Kd in a binding assay (e.g., EMSA, Fluorescence anisotropy, dual-filter binding, FRET, SPR, or thermophoresis (temperature related intensity change). The protein (DNA binding module) is labeled and/or the DNA molecule is labeled with a molecule that is compatible with the above binding assays (e.g., dye, radioisotope (for example, Protein: $^{35}$S-methionine, maleimide dye, DNA: $^{32}$P end or internal label, DNA with a linked amine reacted with NHS-ester dye). The molecules are measured by changing their concentrations and fitting to a binding curve which calculates the binding affinity. In some assays, the nucleic acid sequence specificity is tested by mutational analysis of the DNA sequence or mutation to the DNA binding module by amino acid changes or alterations to protein-nucleic acid complex (e.g., Cas9-RNP DNA binding module). In some embodiments, increasing the Kd of the DNA binding module will decrease off-target insertions and, in some cases, will increase the activity of on-target sites by increasing the dwell time of the R2-RNA complex at the specific genomic location.

Example 20: Assays to Determine Global Specificity De Novo

The DNA binding module is expressed in cells (e.g., animal cells, e.g., human cells) as the DNA binding module alone, in the context of the full-length retrotransposon R2, or a control without retrotransposase. The expression of the module or retrotransposon is delivered to cells using conventional methods of delivering DNA, RNA, or protein. The complex is crosslinked (e.g., using chemical or UV light) or is not crosslinked. The cells are lysed and treated with DNase I so that only the bound DNA is protected from degradation. DNA is extracted, NGS library preparation of DNA fragments and de novo binding sites are identified, analogous to ChIP-seq or DIG-seq. In some embodiments, potential off-target sites are identified that can be followed-up to remove false-positives. In other embodiments this assay confirms the in vitro assay on the specificity of the DNA binding module to bind at its intended site and not at others.

An orthogonal assay to identify DNA binding sites in high-throughput uses the method described by Boyle et al, PNAS 2017 where the DNA binding domain is tested in a cell-free setting to determine specificity along with systematic analysis of sequence mutants related to the new DNA binding module.

Example 21: Modularity of RNA Molecule

The RNA molecule binds to the R2 protein via interactions found in the reverse transcriptase module, designated as a sub-module "RNA binding". The protein recognizes specific structures in the 5' and/or 3' UTRs to interact with the RNA. In some embodiments, swapping of the UTR modules increases protein interactions, changes the protein specificity to bind the UTR, stabilizes against nucleases, and/or improves cellular tolerance (e.g., leads to a reduced innate immune response). In other embodiments, addition and/or swapping of the RNA binding module of the R2 protein is compatible with the use of different sequence or ligands that are linked to the transgene and/or element module of the RNA. In some embodiments, combinations of new ligands in place of the UTRs will have better affinity to the RNA binding domain of R2 and lead to better insertion efficiency. In some embodiments, the changes to the sequence of the UTRs or changes to the base modifications of the UTRs will increase the secondary structure stability that leads to better interaction with the RNA binding module.

Example 22: Assays to Measure RNA Binding Affinity to New Sequences

New UTR modules are tested in a binding assay. In the case of new RNAs, they are synthesized either by cell-free in vitro transcription using a synthetic DNA template or by chemical synthesis of the RNA in full-length or chemical synthesis of pieces that are ligated together to form a single RNA molecule. The binding affinity of the purified UTRs are measured in a binding assay (e.g., EMSA, Fluorescence anisotropy, dual-filter binding, FRET, SPR, or thermophoresis (temperature related intensity change)). The UTR module and/or RNA binding module/RT module is detected with or without a label which is described above for labeling RNAs. Measurement of the molecules at different concentrations is performed to determine a binding affinity. In some embodiments, alterations to/swapping of the 5' and/or 3' UTR binding module and/or changes to the RNA binding/RT module will lead to better interactions than the wild-type R2 protein or UTR. In some embodiments, the increased interaction will lead to an increase in the efficiency of retro-transposition and in some cases increases specificity of the R2 protein to interact with the RNA.

Example 23: Alternative UTRs

While not wishing to be bound by theory, in some embodiments the UTRs act as a handle for the R2 protein to interact with the RNA which it uses as a template for RT in concert with it binding a genomic location, nicking the DNA with its endonuclease module, and then using the bound RNA as a template for RT insertion at the cleavage site in the DNA. For the UTR to keep the template in close proximity to the RT module, then the UTR modules can be substituted with different ligands that would bind to a specific RNA binding module engineered into the R2 protein. Thus, in some embodiments, the alternative non-RNA UTR is either a protein, small molecule, or other chemical entity that is attached covalently, through protein-protein interaction, small molecule-protein interaction, or through hybridization. In some embodiments the RNA binding module binds specifically to a ligand that is not RNA that is attached to the transgene module RNA that increases the efficiency, stability, and/or rate of retro-transposition.

Example 24: Assays to Measure the Activity of UTR Constructs

Binding assays to measure affinity of R2 protein with engineered UTRs are performed as described above, e.g., for a protein-nucleic acid interaction. In cases of protein-protein or protein-small molecule interactions the assay uses a label on the RNA transgene module where the UTR module is attached.

Example 25: Targeted Genomic Integration

In this example, GENE WRITING™ technology is delivered to target cells and to non-target cells, and new DNA is integrated into the genome in target cells at a higher frequency than in non-target cells. As described in more detail below, this approach takes advantage of the non-target cell having an endogenous miRNA that the target cell does not have (or has at a lower level). The endogenous miRNA is used to reduce DNA integration in the non-target cell.

The polypeptide used is the R2Tg protein and the template RNA component is RNA coding for the GFP protein and flanked at the 5' end by the 5' UTR and at the 3' end by the 3' UTR of the R2Tg retrotransposase. The 5' UTR is flanked by 100 bp of homology to the 5' of R2Tg 28s rDNA target site and the 3' UTR is flanked by 100 bp of homology to the 3' of R2Tg 28s rDNA target site. The GFP gene is facing in the antisense direction with regard to the 5' and 3' UTRs and has its own promoter and polyadenylation signal.

The template RNA further comprises a microRNA recognition sequence. This microRNA recognition sequence is bound by microRNAs in the non-target cells, leading to the inhibition (e.g., degradation) of the template RNA prior to genomic integration.

In this example the target cells are hepatocytes and the non-target cells are macrophages from the hematopoietic lineage. The target cells and non-target cells are cultured separately. The template RNA and retrotransposase protein can be delivered to cells as described herein, e.g., as RNA or using viral vectors (e.g. adeno-associated viral vectors), wherein the template RNA is transcribed from viral vector DNA.

Three days after treating the cells, GFP expression and genomic integration are assayed.

GFP expression is assayed via flow cytometry. In some embodiments, GFP expression will be higher in the hepatocyte population than in the macrophage population.

Genomic integration (in terms of copy number per cell normalized to a reference gene) is assayed via droplet digital PCR using methods described herein. In some embodiments, genomic integration will be higher in the hepatocyte population than in the macrophage population.

Example 26: Testing Modularity of the DNA Binding Domain

In this example, a series of experiments were performed to test the activity of various mutant retrotransposases, as well as gaining structural knowledge about these proteins. This experiments tested flexible linkers in different locations and lengths, in order to determine if the DNA binding domain (DBD) was modular. These experiments also provide support for being able to separate the DBD from the rest of R2Tg and replacing it with any DNA targeting protein sequence. This example thus supports an understanding that the transposases described herein can withstand the tested levels of sequence divergence at a plurality of locations (e.g., in the predicted −1 RNA binding motif, in an alpha helix, and in a coil region located C-terminal to the predicted c-myb DNA binding motif, e.g., as described below) identified by structural modeling, while maintaining function.

Briefly, the two linkers (Linker A: SGSETPGTSESATPES (SEQ ID NO: 1023), and Linker B: GGGS (SEQ ID NO: 1024)) were inserted into 3 locations, noted herein as versions v1, v2, and v3. v1 was located at the N-terminal side of an alpha helical region of R2Tg that preceded the predicted −1 RNA binding motif, v2 was located at the C-terminal side of an alpha helical region of R2Tg that preceded the predicted −1 RNA binding motif, and v3 was located C-terminal to a random coil region that came after the predicted c-myb DNA binding motif of R2Tg. For each of v1, v2, and v3, one of linkers A or B were added by PCR to a DNA plasmid that expressed R2Tg, thereby yielding sequences v1A (v1+ linker A), v1B (v1+ linker B), v1C (v1+ linker C), v2A (v2+ linker A), v2B (v2+ linker B), and v2C (v2+ linker C), as shown in Table 5 below. The insertion of the linkers was verified by Sanger sequencing and the DNA plasmids were purified for transfection.

TABLE 5

Amino acid sequences of R2Tg mutants with linkers in the DNA binding domain (DBD)

| R2Tg Mutant + Linker | Amino Acid Sequence | SEQ ID NO |
|---|---|---|
| R2Tg with DBD Linker v1A | MASCPKPGPPVSAGAMSLESGLTTHSVLAIERGPNS LANSGSDFGGGGLGLPLRLLRVSVGTQTSRSDWVDL VSWSHPGPTSKSQQVDLVSLFPKHRVDLLSKNDQVD LVAQFLPSKFPPNLAENDLALLVNLEFYRSDLHVYE CVHFAAHWEGLSGLPEVYEQLAPQPCVGETLHSSLP RDSELFVPEEGSSEKESEDAPKTSPPTPGKHGLEQT GEEKVMVTVPDKNPPCPCCGTRVNSVLNLIEHLKVS HGKRGVCFRCAKCGKENSNYHSVVCHFPKCRGPETE KAPAGEWICEVCNRDFTTKIGLGQHKRLAHPAVRNQ ERIVASQPKETSNRGAHKRCWTKEEEELLIRLEAQF EGNKNINKLIAEHITTKTAKQISDKRRLLSRKPAEE PREEPGTCHHTRRAAASLRTEPEMSHHAQAEDRDNG PGRRPLPGRAAAGGRTMDEIRRHPDKGNGQQRPTKQ KSEEQLQAYYKKTLEERLSAGALNTFPRAFKQVMEG RDIKLVINQTAQDSGSETPGTSESATPESCFGCLES ISQIRTATRDKKDTVTREKHPKKPFQKWMKDRAIKK GNYLRFQRLFYLDRGKLAKIILDDIECLSCDIPLSE IYSVFKTRWETTGSFKSLGDFKTYGKADNTAFRELI TAKEIEKNVQEMSKGSAPGPDGITLGDVVKMDPEFS RTMEIFNLWLTTGKIPDMVRGCRTVLIPKSSKPDRL KDINNWRPITIGSILLRLFSRIVTARLSKACPLNPR QRGFIRAAGCSENLKLLQTIIWSAKREHRPLGVVFV DIAKAFDTVSHQHIIHALQQREVDPHIVGLVSNMYE NISTYITTKRNTHTDKIQIRVGVKQGDPMSPLLFNL AMDPLLCKLEESGKGYHRGQSSITAMAFADDLVLLS DSWENMNTNISILETFCNLTGLKTQGQKCHGFYIKP TKDSYTINDCAAWTINGTPLNMIDPGESEKYLGLQF DPWIGIARSGLSTKLDFWLQRIDQAPLKPLQKTDIL KTYTIPRLIYIADHSEVKTALLETLDQKIRTAVKEW LHLPPCTCDAILYSSTRDGGLGITKLAGLIPSVQAR RLHRIAQSSDDTMKCFMEKEKMEQLHKKLWIQAGGD RENIPSIWEAPPSSEPPNNVSTNSEWEAPTQKDKFP KPCNWRKNEFKKWTKLASQGRGIVNFERDKISNHWI QYYRRIPHRKLLTALQLRANVYPTREFLARGRQDQY IKACRHCDADIESCAHIIGNCPVTQDARIKRHNYIC ELLLEEAKKKDWVVFKEPHIRDSNKELYKPDLIFVK | 1017 |

TABLE 5-continued

Amino acid sequences of R2Tg mutants with linkers in the DNA binding domain (DBD)

| R2Tg Mutant + Linker | Amino Acid Sequence | SEQ ID NO |
|---|---|---|
| | DARALVVDVTVRYEAAKSSLEEAAAEKVRKYKHLET<br>EVRHLTNAKDVTFVGFPLGARGKWHQDNFKLLTELG<br>LSKSRQVKMAETFSTVALFSSVDIVHMFASRARKSM<br>VM | |
| R2Tg with DBD Linker v1B | MASCPKPGPPVSAGAMSLESGLTTHSVLAIERGPNS<br>LANSGSDFGGGGLGLPLRLLRVSVGTQTSRSDWVDL<br>VSWSHPGPTSKSQQVDLVSLFPKHRVDLLSKNDQVD<br>LVAQFLPSKFPPNLAENDLALLVNLEFYRSDLHVYE<br>CVHFAAHWEGLSGLPEVYEQLAPQPCVGETLHSSLP<br>RDSELFVPEEGSSEKESEDAPKTSPPTPGKHGLEQT<br>GEEKVMVTVPDKNPPCPCCGTRVNSVLNLIEHLKVS<br>HGKRGVCFRCAKCGKENSNYHSVVCHFPKCRGPETE<br>KAPAGEWICEVCNRDFTTKIGLGQHKRLAHPAVRNQ<br>ERIVASQPKETSNRGAHKRCWTKEEEELLIRLEAQF<br>EGNKNINKLIAEHITTKTAKQISDKRRLLSRKPAEE<br>PREEPGTCHHTRRAAASLRTEPEMSHHAQAEDRDNG<br>PGRRPLPGRAAAGGRTMDEIRRHPDKGNGQQRPTKQ<br>KSEEQLQAYYKKTLEERLSAGALNTFPRAFKQVMEG<br>RDIKLVINQTAQDGGGSCFGCLESISQIRTATRDKK<br>DTVTREKHPKKPFQKWMKDRAIKKGNYLRFQRLFYL<br>DRGKLAKIILDDIECLSCDIPLSEIYSVFKTRWETT<br>GSFKSLGDFKTYGKADNTAFRELITAKEIEKNVQEM<br>SKGSAPGPDGITLGDVVKMDPEFSRTMEIFNLWLTT<br>GKIPDMVRGCRTVLIPKSSKPDRLKDINNWRPITIG<br>SILLRLFSRIVTARLSKACPLNPRQRGFIRAAGCSE<br>NLKLLQTIIWSAKREHRPLGVVFVDIAKAFDTVSHQ<br>HIIHALQQREVDPHIVGLVSNMYENISTYITTKRNT<br>HTDKIQIRVGVKQGDPMSPLLFNLAMDPLLCKLEES<br>GKGYHRGQSSITAMAFADDLVLLSDSWENMNTNISI<br>LETFCNLTGLKTQGQKCHGFYIKPTKDSYTINDCAA<br>WTINGTPLNMIDPGESEKYLGLQFDPWIGIARSGLS<br>TKLDFWLQRIDQAPLKPLQKTDILKTYTIPRLIYIA<br>DHSEVKTALLETLDQKIRTAVKEWLHLPPCTCDAIL<br>YSSTRDGGLGITKLAGLIPSVQARRLHRIAQSSDDT<br>MKCFMEKEKMEQLHKKLWIQAGGDRENIPSIWEAPP<br>SSEPPNNVSTNSEWEAPTQKDKFPKPCNWRKNEFKK<br>WTKLASQGRGIVNFERDKISNHWIQYYRRIPHRKLL<br>TALQLRANVYPTREFLARGRQDQYIKACRHCDADIE<br>SCAHIIGNCPVTQDARIKRHNYICELLLEEAKKKDW<br>VVFKEPHIRDSNKELYKPDLIFVKDARALVVDVTVR<br>YEAAKSSLEEAAAEKVRKYKHLETEVRHLTNAKDVT<br>FVGFPLGARGKWHQDNFKLLTELGLSKSRQVKMAET<br>FSTVALFSSVDIVHMFASRARKSMVM | 1018 |
| R2Tg with DBD Linker v2A | MASCPKPGPPVSAGAMSLESGLTTHSVLAIERGPNS<br>LANSGSDFGGGGLGLPLRLLRVSVGTQTSRSDWVDL<br>VSWSHPGPTSKSQQVDLVSLFPKHRVDLLSKNDQVD<br>LVAQFLPSKFPPNLAENDLALLVNLEFYRSDLHVYE<br>CVHFAAHWEGLSGLPEVYEQLAPQPCVGETLHSSLP<br>RDSELFVPEEGSSEKESEDAPKTSPPTPGKHGLEQT<br>GEEKVMVTVPDKNPPCPCCGTRVNSVLNLIEHLKVS<br>HGKRGVCFRCAKCGKENSNYHSVVCHFPKCRGPETE<br>KAPAGEWICEVCNRDFTTKIGLGQHKRLAHPAVRNQ<br>ERIVASQPKETSNRGAHKRCWTKEEEELLIRLEAQF<br>EGNKNINKLIAEHITTKTAKQISDKRRLLSRKPAEE<br>PREEPGTCHHTRRAAASLRTEPEMSHHAQAEDRDNG<br>PGRRPLPGRAAAGGRTMDEIRRHPDKGNGQQRPTKQ<br>KSEEQLQAYYKKTLEERLSAGALNTFPRAFKQVMEG<br>RDIKLVINQTAQDCFGCLESISQIRSGSETPGTSES<br>ATPESTATRDKKDTVTREKHPKKPFQKWMKDRAIKK<br>GNYLRFQRLFYLDRGKLAKIILDDIECLSCDIPLSE<br>IYSVFKTRWETTGSFKSLGDFKTYGKADNTAFRELI<br>TAKEIEKNVQEMSKGSAPGPDGITLGDVVKMDPEFS<br>RTMEIFNLWLTTGKIPDMVRGCRTVLIPKSSKPDRL<br>KDINNWRPITIGSILLRLFSRIVTARLSKACPLNPR<br>QRGFIRAAGCSENLKLLQTIIWSAKREHRPLGVVFV<br>DIAKAFDTVSHQHIIHALQQREVDPHIVGLVSNMYE<br>NISTYITTKRNTHTDKIQIRVGVKQGDPMSPLLFNL<br>AMDPLLCKLEESGKGYHRGQSSITAMAFADDLVLLS<br>DSWENMNTNISILETFCNLTGLKTQGQKCHGFYIKP<br>TKDSYTINDCAAWTINGTPLNMIDPGESEKYLGLQF<br>DPWIGIARSGLSTKLDFWLQRIDQAPLKPLQKTDIL<br>KTYTIPRLIYIADHSEVKTALLETLDQKIRTAVKEW<br>LHLPPCTCDAILYSSTRDGGLGITKLAGLIPSVQAR<br>RLHRIAQSSDDTMKCFMEKEKMEQLHKKLWIQAGGD<br>RENIPSIWEAPPSSEPPNNVSTNSEWEAPTQKDKFP<br>KPCNWRKNEFKKWTKLASQGRGIVNFERDKISNHWI<br>QYYRRIPHRKLLTALQLRANVYPTREFLARGRQDQY<br>IKACRHCDADIESCAHIIGNCPVTQDARIKRHNYIC<br>ELLLEEAKKKDWVVFKEPHIRDSNKELYKPDLIFVK<br>DARALVVDVTVRYEAAKSSLEEAAAEKVRKYKHLET<br>EVRHLTNAKDVTFVGFPLGARGKWHQDNFKLLTELG<br>LSKSRQVKMAETFSTVALFSSVDIVHMFASRARKSM<br>VM | 1019 |
| R2Tg with DBD Linker v2B | MASCPKPGPPVSAGAMSLESGLTTHSVLAIERGPNS<br>LANSGSDFGGGGLGLPLRLLRVSVGTQTSRSDWVDL<br>VSWSHPGPTSKSQQVDLVSLFPKHRVDLLSKNDQVD<br>LVAQFLPSKFPPNLAENDLALLVNLEFYRSDLHVYE<br>CVHFAAHWEGLSGLPEVYEQLAPQPCVGETLHSSLP<br>RDSELFVPEEGSSEKESEDAPKTSPPTPGKHGLEQT<br>GEEKVMVTVPDKNPPCPCCGTRVNSVLNLIEHLKVS<br>HGKRGVCFRCAKCGKENSNYHSVVCHFPKCRGPETE<br>KAPAGEWICEVCNRDFTTKIGLGQHKRLAHPAVRNQ<br>ERIVASQPKETSNRGAHKRCWTKEEEELLIRLEAQF<br>EGNKNINKLIAEHITTKTAKQISDKRRLLSRKPAEE<br>PREEPGTCHHTRRAAASLRTEPEMSHHAQAEDRDNG<br>PGRRPLPGRAAAGGRTMDEIRRHPDKGNGQQRPTKQ<br>KSEEQLQAYYKKTLEERLSAGALNTFPRAFKQVMEG<br>RDIKLVINQTAQDCFGCLESISQIRGGGSTATRDKK<br>DTVTREKHPKKPFQKWMKDRAIKKGNYLRFQRLFYL<br>DRGKLAKIILDDIECLSCDIPLSEIYSVFKTRWETT<br>GSFKSLGDFKTYGKADNTAFRELITAKEIEKNVQEM<br>SKGSAPGPDGITLGDVVKMDPEFSRTMEIFNLWLTT<br>GKIPDMVRGCRTVLIPKSSKPDRLKDINNWRPITIG<br>SILLRLFSRIVTARLSKACPLNPRQRGFIRAAGCSE<br>NLKLLQTIIWSAKREHRPLGVVFVDIAKAFDTVSHQ<br>HIIHALQQREVDPHIVGLVSNMYENISTYITTKRNT<br>HTDKIQIRVGVKQGDPMSPLLFNLAMDPLLCKLEES<br>GKGYHRGQSSITAMAFADDLVLLSDSWENMNTNISI<br>LETFCNLTGLKTQGQKCHGFYIKPTKDSYTINDCAA<br>WTINGTPLNMIDPGESEKYLGLQFDPWIGIARSGLS<br>TKLDFWLQRIDQAPLKPLQKTDILKTYTIPRLIYIA<br>DHSEVKTALLETLDQKIRTAVKEWLHLPPCTCDAIL<br>YSSTRDGGLGITKLAGLIPSVQARRLHRIAQSSDDT<br>MKCFMEKEKMEQLHKKLWIQAGGDRENIPSIWEAPP<br>SSEPPNNVSTNSEWEAPTQKDKFPKPCNWRKNEFKK<br>WTKLASQGRGIVNFERDKISNHWIQYYRRIPHRKLL<br>TALQLRANVYPTREFLARGRQDQYIKACRHCDADIE<br>SCAHIIGNCPVTQDARIKRHNYICELLLEEAKKKDW<br>VVFKEPHIRDSNKELYKPDLIFVKDARALVVDVTVR<br>YEAAKSSLEEAAAEKVRKYKHLETEVRHLTNAKDVT<br>FVGFPLGARGKWHQDNFKLLTELGLSKSRQVKMAET<br>FSTVALFSSVDIVHMFASRARKSMVM | 1020 |
| R2Tg with DBD Linker v3A | MASCPKPGPPVSAGAMSLESGLTTHSVLAIERGPNS<br>LANSGSDFGGGGLGLPLRLLRVSVGTQTSRSDWVDL<br>VSWSHPGPTSKSQQVDLVSLFPKHRVDLLSKNDQVD<br>LVAQFLPSKFPPNLAENDLALLVNLEFYRSDLHVYE<br>CVHFAAHWEGLSGLPEVYEQLAPQPCVGETLHSSLP<br>RDSELFVPEEGSSEKESEDAPKTSPPTPGKHGLEQT<br>GEEKVMVTVPDKNPPCPCCGTRVNSVLNLIEHLKVS<br>HGKRGVCFRCAKCGKENSNYHSVVCHFPKCRGPETE<br>KAPAGEWICEVCNRDFTTKIGLGQHKRLAHPAVRNQ<br>ERIVASQPKETSNRGAHKRCWTKEEEELLIRLEAQF<br>EGNKNINKLIAEHITTKTAKQISDKRRLLSRKPAEE<br>PREEPGTCHHTRRAASGSETPGTSESATPESASLRT<br>EPEMSHHAQAEDRDNGPGRRPLPGRAAAGGRTMDEI<br>RRHPDKGNGQQRPTKQKSEEQLQAYYKKTLEERLSA<br>GALNTFPRAFKQVMEGRDIKLVINQTAQDCFGCLES<br>ISQIRTATRDKKDTVTREKHPKKPFQKWMKDRAIKK<br>GNYLRFQRLFYLDRGKLAKIILDDIECLSCDIPLSE<br>IYSVFKTRWETTGSFKSLGDFKTYGKADNTAFRELI | 1021 |

TABLE 5-continued

Amino acid sequences of R2Tg mutants with linkers in the DNA binding domain (DBD)

| R2Tg Mutant + Linker | Amino Acid Sequence | SEQ ID NO |
|---|---|---|
| | TAKEIEKNVQEMSKGSAPGPDGITLGDVVKMDPEFS<br>RTMEIFNLWLTTGKIPDMVRGCRTVLIPKSSKPDRL<br>KDINNWRPITIGSILLRLFSRIVTARLSKACPLNPR<br>QRGFIRAAGCSENLKLLQTIIWSAKREHRPLGVVFV<br>DIAKAFDTVSHQHIIHALQQREVDPHIVGLVSNMYE<br>NISTYITTKRNTHTDKIQIRVGVKQGDPMSPLLFNL<br>AMDPLLCKLEESGKGYHRGQSSITAMAFADDLVLLS<br>DSWENMNTNISILETFCNLTGLKTQGQKCHGFYIKP<br>TKDSYTINDCAAWTINGTPLNMIDPGESEKYLGLQF<br>DPWIGIARSGLSTKLDFWLQRIDQAPLKPLQKTDIL<br>KTYTIPRLIYIADHSEVKTALLETLDQKIRTAVKEW<br>LHLPPCTCDAILYSSTRDGGLGITKLAGLIPSVQAR<br>RLHRIAQSSDDTMKCFMEKEKMEQLHKKLWIQAGGD<br>RENIPSIWEAPPSSEPPNNVSTNSEWEAPTQKDKFP<br>KPCNWRKNEFKKWTKLASQGRGIVNFERDKISNHWI<br>QYYRRIPHRKLLTALQLRANVYPTREFLARGRQDQY<br>IKACRHCDADIESCAHIIGNCPVTQDARIKRHNYIC<br>ELLLEEAKKKDWVVFKEPHIRDSNKELYKPDLIFVK<br>DARALVVDVTVRYEAAKSSLEEAAAEKVRKYKHLET<br>EVRHLTNAKDVTFVGFPLGARGKWHQDNFKLLTELG<br>LSKSRQVKMAETFSTVALFSSVDIVHMFASRARKSM<br>VM | |
| R2Tg with DBD Linker v3B | MASCPKPGPPVSAGAMSLESGLTTHSVLAIERGPNS<br>LANSGSDFGGGGLGLPLRLLRVSVGTQTSRSDWVDL<br>VSWSHPGPTSKSQQVDLVSLFPKHRVDLLSKNDQVD<br>LVAQFLPSKFPPNLAENDLALLVNLEFYRSDLHVYE<br>CVHFAAHWEGLSGLPEVYEQLAPQPCVGETLHSSLP<br>RDSELFVPEEGSSEKESEDAPKTSPPTPGKHGLEQT<br>GEEKVMVTVPDKNPPCPCCGTRVNSVLNLIEHLKVS<br>HGKRGVCFRCAKCGKENSNYHSVVCHFPKCRGPETE<br>KAPAGEWICEVCNRDFTTKIGLGQHKRLAHPAVRNQ<br>ERIVASQPKETSNRGAHKRCWTKEEEELLIRLEAQF<br>EGNKNINKLIAEHITTKTAKQISDKRRLLSRKPAEE<br>PREEPGTCHHTRRAAGGGSASLRTEPEMSHHAQAED<br>RDNGPGRRPLPGRAAAGGRTMDEIRRHPDKGNGQQR<br>PTKQKSEEQLQAYYKKTLEERLSAGALNTFPRAFKQ<br>VMEGRDIKLVINQTAQDCFGCLESISQIRTATRDKK<br>DTVTREKHPKKPFQKWMKDRAIKKGNYLRFQRLFYL<br>DRGKLAKIILDDIECLSCDIPLSEIYSVFKTRWETT<br>GSFKSLGDFKTYGKADNTAFRELITAKEIEKNVQEM<br>SKGSAPGPDGITLGDVVKMDPEFSRTMEIFNLWLTT<br>GKIPDMVRGCRTVLIPKSSKPDRLKDINNWRPITIG<br>SILLRLFSRIVTARLSKACPLNPRQRGFIRAAGCSE<br>NLKLLQTIIWSAKREHRPLGVVFVDIAKAFDTVSHQ<br>HIIHALQQREVDPHIVGLVSNMYENISTYITTKRNT<br>HTDKIQIRVGVKQGDPMSPLLFNLAMDPLLCKLEES<br>GKGYHRGQSSITAMAFADDLVLLSDSWENMNTNISI<br>LETFCNLTGLKTQGQKCHGFYIKPTKDSYTINDCAA<br>WTINGTPLNMIDPGESEKYLGLQFDPWIGIARSGLS<br>TKLDFWLQRIDQAPLKPLQKTDILKTYTIPRLIYIA<br>DHSEVKTALLETLDQKIRTAVKEWLHLPPCTCDAIL<br>YSSTRDGGLGITKLAGLIPSVQARRLHRIAQSSDDT<br>MKCFMEKEKMEQLHKKLWIQAGGDRENIPSIWEAPP<br>SSEPPNNVSTNSEWEAPTQKDKFPKPCNWRKNEFKK<br>WTKLASQGRGIVNFERDKISNHWIQYYRRIPHRKLL<br>TALQLRANVYPTREFLARGRQDQYIKACRHCDADIE<br>SCAHIIGNCPVTQDARIKRHNYICELLLEEAKKKDW<br>VVFKEPHIRDSNKELYKPDLIFVKDARALVVDVTVR<br>YEAAKSSLEEAAAEKVRKYKHLETEVRHLTNAKDVT<br>FVGFPLGARGKWHQDNFKLLTELGLSKSRQVKMAET<br>FSTVALFSSVDIVHMFASRARKSMVM | 1022 |

HEK293T cells were plated in 96-well plates and grown overnight at 37° C., 5% CO2. The HEK293T cells were transfected with plasmids that expressed R2Tg (wild-type), R2 endonuclease mutant, and linker mutants. The transfection was carried out using the Fugene HD transfection reagent according to the manufacturer recommendations, where each well received 80 ng of plasmid DNA and 0.5 μL of transfection reagent. All transfections were performed in duplicate and the cells were incubated for 72 h prior to genomic DNA extraction.

Activity of the mutants was measured by a ddPCR assay that quantified the copy number of R2Tg integration per genome. The 5' and 3' junctions were quantified by generating two different amplicons at each end.

v3 (near the c-myb binding motif in the DBD) decreased integration activity with either linker A or B. v1 (N-terminal to the alpha helix preceding the −1 RNA binding motif) had comparable activity to the wild-type when used with linker A (16 AA) versus the shorter linker B (4 AA). This could be related to amino acid selection, length, or three-dimensional structure. v2 (C-terminal to the alpha helix preceding the −1 RNA binding motif) did not tolerate linker A; however, linker B had activity that was comparable and slightly better than the wild-type. v1 and v2 may therefore be considered preferred locations to add a linker that can separate R2Tg's DNA binding domain and the rest of the protein.

Example 27: Long-Read Sequencing to Determine Integration Fidelity

Retrotransposon integration experiments were performed as described in previous examples. In one example, PCR amplification was used to generate amplicons by designing one primer targeting the genomic integration site and one primer targeting the integrant sequence. In this example, these primers were designed to maximize the length of the amplified genomic locus fused with the integrant sequence. By pooling amplicons spanning both ends of the integrant and performing long-read next-generation sequencing, the fidelity of each integration was evaluated.

Figure 20A:
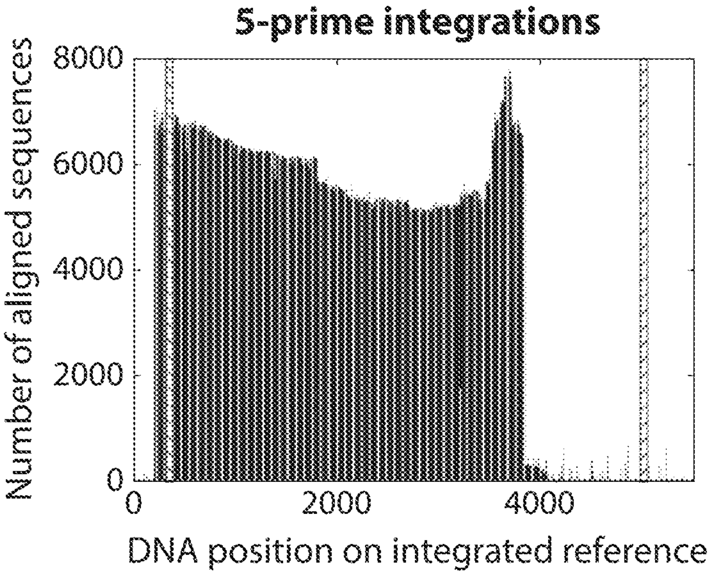
FIGS. 20A-20B are a series of graphs showing long-read sequencing confirming fidelity of R2Tg cis integration. Unique sequence coverage, as determined by UMI, is graphed across the expected reference sequence. The left vertical bar indicates expected 5' junction of the rDNA and R2Tg, while the right vertical bar indicates the 3' junction. Two separate amplicons spanning the 5' junction and 3' junction are shown.
Figure 20B:
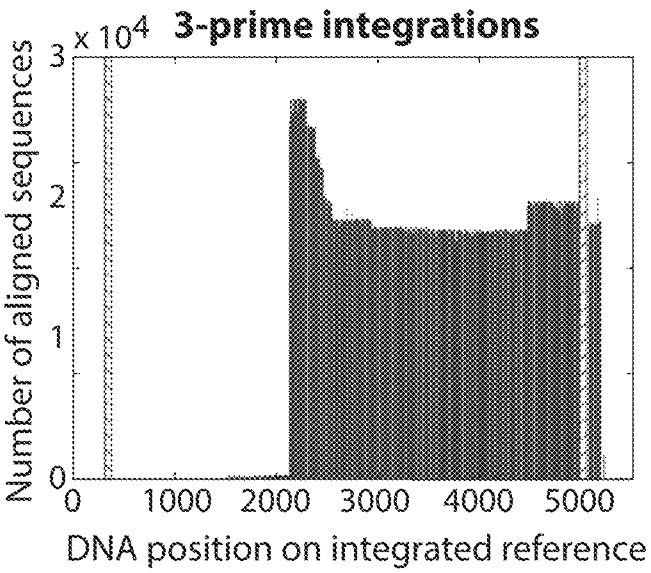
Figure 21A:
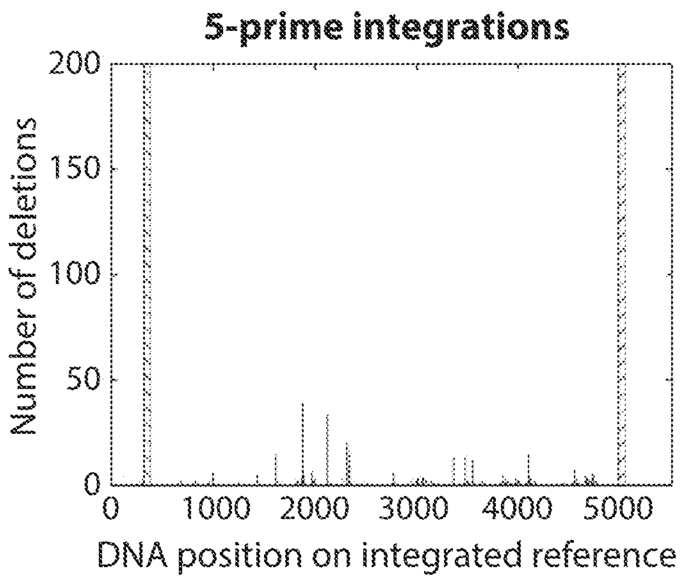
FIGS. 21A-21B are a series of graphs showing long-read sequencing confirming fidelity of R2Tg cis integration. Unique sequence deletions (>3 bp) as determined by UMI is graphed across the expected reference sequence. The left vertical bar indicates expected 5' junction of the rDNA and R2Tg, while the right vertical bar indicates the 3' junction. Two separate amplicons spanning the 5' junction and 3' junction are shown.
Figure 21B:
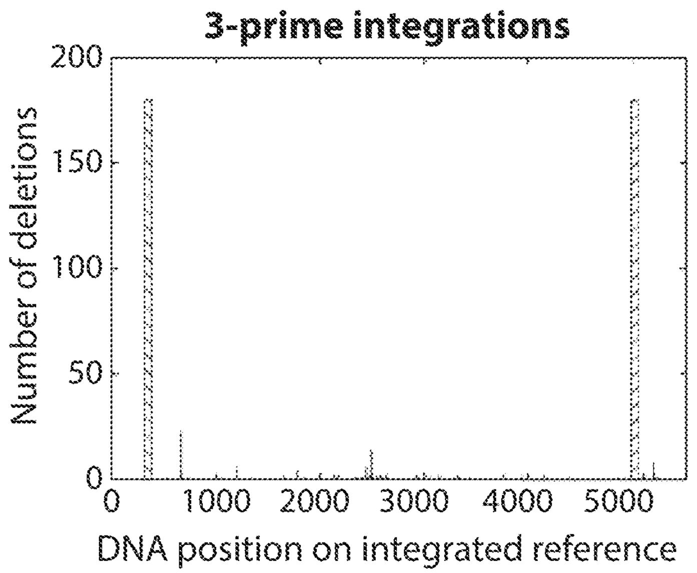

A cis construct of R2Tg was integrated into 293T cells via plasmid transfection as described herein. Amplicons spanning each end of the integrations were generated with flanking randomized UMIs to control for PCR bias. These amplicons were sequenced with PacBio next-generation sequencing. The resulting sequences were collapsed to remove reads with identical UMIs. By aligning unique reads, a coverage plot was constructed as shown in FIGS. 20A-20B. Sequence coverage largely shows uniform coverage across amplicons, indicating significant fidelity of integration. An associated reverse-transcriptase deficient mutant control produced no signal. Internal deletions were also analyzed in FIGS. 21A-21B. Internal deletions were generally low relative to overall unique read counts, with some clustering at the 5' junction of rDNA-R2Tg.

In another example, hybrid capture may be performed as described in a previous example but with a larger target library length during initial library generation. The resulting library can then be subjected to long-read next-generation sequencing.

Example 28: Targeted Delivery of R2Gfo and R4Al Retrotransposon to Mammalian Cells This example describes targeted integration of the R2Gfo and R4Al retrotransposon elements to mammalian cells via DNA delivery.

In one example, we assayed the full R2 element R2-1_GFo (Repbase; Kojima et al *PLOS One* 11, e0163496 (2015)) from the medium ground finch, *Geospiza fortis* ("R2GFo"). In another example, we assayed the full R4 element R4_AL (Repbase; Burke et al *Nucleic Acids Res.* 23, 4628-34 (1995)) from the large roundworm, *Ascaris lumbricoides* ("R4Al"). Because non-LTR R2 and R4 elements are not present in the human genome and are thought to be highly site-specific, the ability of retrotransposons to accurately and efficiently integrate itself into the human genome would demonstrate the capability to perform genomic targeted integration.

Figure 22:
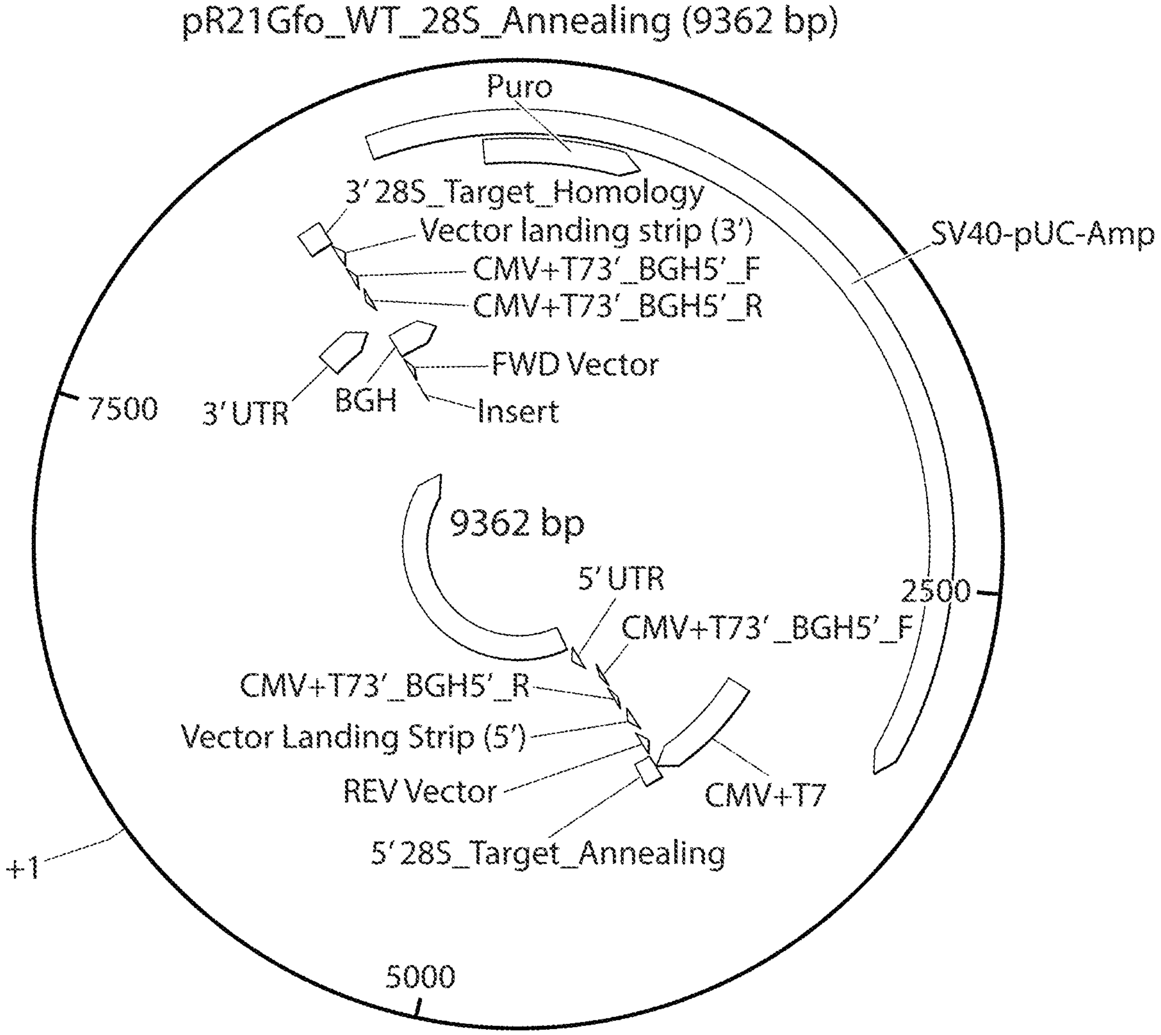
FIG. 22 is a diagram showing exemplary plasmid map PLV033 for cis integration of R2Gfo.
Figure 23:
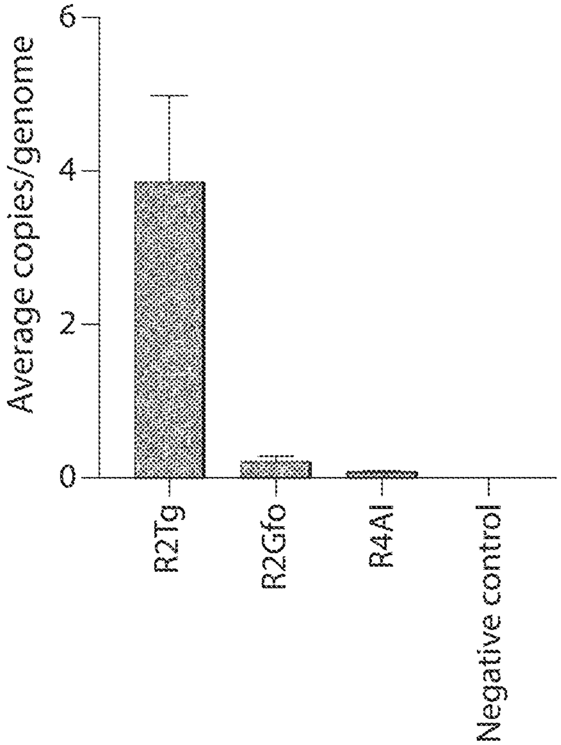
FIG. 23 is a graph showing integration of R2Gfo, R4Al, and R2Tg in cis in HEK293T cells. The mean of four replicates is shown; error bars indicate standard deviation.

Plasmids harboring R2Gfo (PLV033) or R4Al (PLV462) were designed for cis integration of the R2Gfo or R4Al elements as in previous examples. Plasmids were synthesized such that the wildtype element was flanked by its native un-translated regions (UTRs) and 100 bp of homology to its rDNA target (FIG. 22). The element expression was driven by the mammalian CMV promoter. We introduced each plasmid into HEK393T cells using the FuGENE® HD transfection reagent. HEK293T cells were seeded in 96-well plates at 10,000 cells/well 24 hours before transfection. On the transfection day, 0.5 µl transfection reagent and 80 ng DNA was mixed in 10 µl Opti-MEM and incubated for 15 minutes at room temperature. The transfection mixture was then added to the medium of the seeded cells. Three days after transfection, genomic DNA was extracted for retrotransposition assays. R2Tg was also delivered in parallel in the same format to serve as a comparison.

ddPCR was performed to confirm integration and assess integration efficiency. A Taqman probe was designed to the 3'UTR portion of each element. A forward primer was synthesized to bind directly upstream of the probe, and a reverse primer was synthesized to bind the rDNA. Thus, amplification of the expected product across the integration junction would degrade the probe and create a fluorescent signal. The results of the ddPCR copy number analysis (in comparison to reference gene RPP30) are shown in FIG. 23. R2Gfo integration achieved a mean copy number of 0.21 integrants/genome in this experiment. R4Al achieved a mean copy number of 0.085 integrants/genome.

Example 29: Integration of Retrotransposons into Human Fibroblasts

Figure 24:
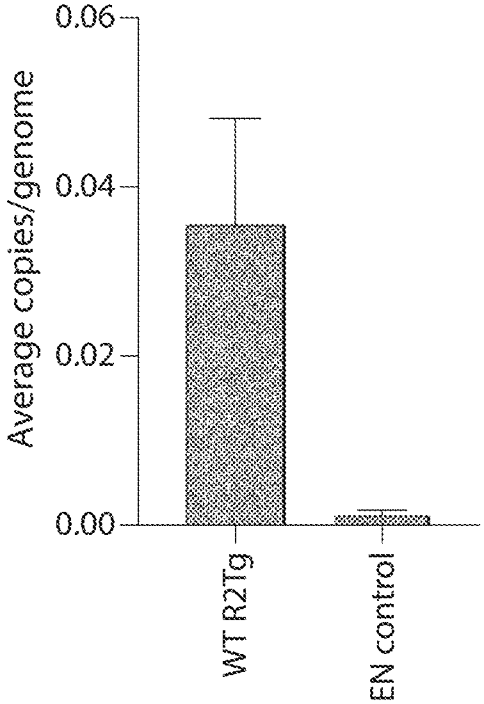
FIG. 24 is a graph showing that R2Tg integrates into human fibroblasts in cis. Integration efficiency of the wild-type (WT) and endonuclease (EN) control R2Tg were plotted over four replicate experiments as measured via ddPCR at the 3' junction of R2Tg and the rDNA target.

This example describes the cis integration of R2Tg into human fibroblasts. Briefly, a plasmid designed to integrate R2Tg in cis was synthesized such that R2Tg was flanked by its native UTRs and homologous sequence to its rDNA target as in previous examples. 0.5 µg PLV014 (wild-type) and PLV072 (EN mutant) plasmids were transfected into 100,000 human dermal fibroblasts isolated from neonatal foreskin (HDFn, C0045C, ThermoFisher Scientific) respectively using the Neon transfection system. Two programs were performed, each in duplicate. The setting for Program 1 was 1700V pulse voltage, 20 ms pulse width, and 1 pulse number. The setting for Program 2 was 1400V pulse voltage, 20 ms pulse width, and 2 pulse number. Both programs achieved 95% transfection efficiency measured using plasmid encoding the EGFP. Three days post transfection, genomic DNA was extracted for the ddPCR assay. ddPCR was performed to confirm integration and assess integration efficiency. A Taqman probe was designed to the 3' UTR portion of the R2Tg element. A forward primer was synthesized to bind directly upstream of the probe, and a reverse primer was synthesized to bind the rDNA. Thus, amplification of the expected product across the integration junction would degrade the probe and create a fluorescent signal. The results of ddPCR copy number analysis (in comparison to reference gene RPP30) are shown in FIG. 24. Wild-type (WT) R2Tg integration achieved a mean copy number of 0.036 integrants/genome in this experiment, significantly higher than a control R2Tg plasmid with a point mutation abolishing endonuclease activity (EN).

Figure 25:
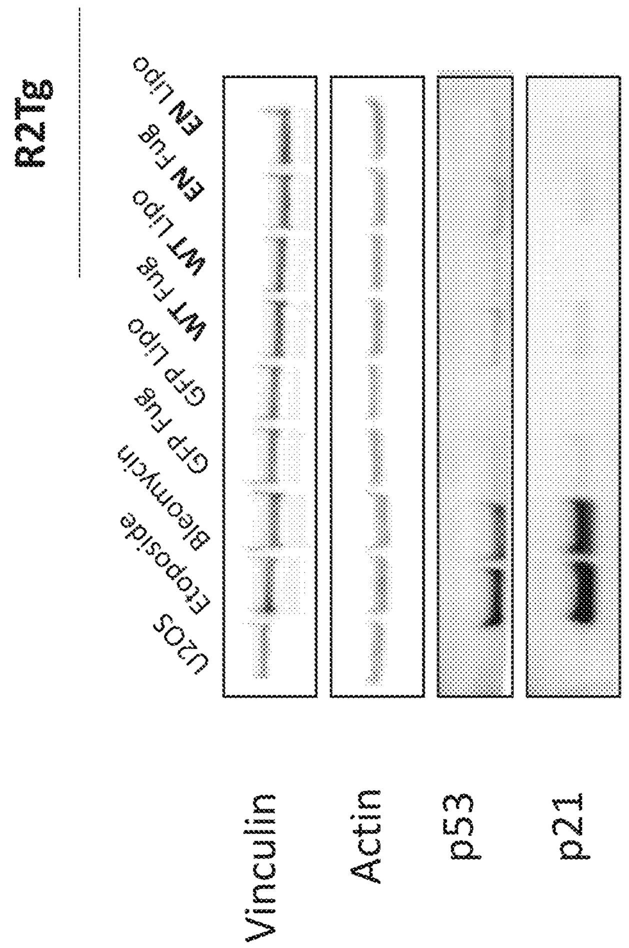
FIG. 25 is a diagram showing Western Blot analysis for p53, p21, Actin, and Vinculin. U2OS cells were trested with the indicated compound or plasmid: GFP, R2Tg-WT (wild-type), or R2Tg-EN (endonuclease domain mutant). Plasmid transfections were performed with either lipofectamine 3000 (Lipo) or Fugene HD (Fug). Cells were analyzed 24 hours after treatment or transfection.

Example 30: Evaluation of DNA Damage Response Upon Retrotransposon Transfection DNA damage (e.g., resulting from DSB formation or replication fork collapse) leads to the activation of p53, which among many other transcriptional responses, leads to the upregulation of p21, resulting in cell cycle arrest or apoptosis. Genome editing using CRISRP/Cas9 has been shown to activate p53 and p21, which is a potential safety and efficacy problem for CRISPR/based therapeutics. To establish whether R2Tg delivery to the cell leads to activation of p53 and p21, U2OS cells were seeded at a density of $4\times10^4$ cells/well and transfected 24 hours later using the Fugene HD and Lipofectamine reagents with either 500 ng of R2Tg-WT plasmid or 500 ng of R2Tg-EN (a variant of R2Tg with a mutation in the endonuclease (EN) domain, rendering R2Tg inactive). To control for transfection efficiency, U2OS cells were also transfected with a plasmid expressing GFP. Lastly, as a positive control for p53 and p21 activation, U2OS cells were treated with one of the DNA damage-inducing agents etoposide (20 µM) or bleomycin (10 µg/ml). The U2OS cells were collected 24 hours after transfection/treatment. Protein lysates were prepared in RIPA buffer and run on an SDS-PAGE gel, followed by transfer to nitrocellulose, followed by probing with antibodies against p53 and p21, as well as Actin and Vinculin. As shown in FIG. 25, no R2Tg-induced upregulation of p53 or p21 above the GFP plasmid control was detected in either transfection condition.

---

SEQUENCE LISTING (1546 sequences)

SEQ ID NO: 1 - DNA, 5568 bp, Danio rerio
ccttgagtttgactgagtcattgctttcaaggaagtgtgaggtggcagtagggagagaaaggctctcccattttgatttgctttattgttttttttcttgattttgcttaaattaaattgtattaattttgtttagttttagttaaaccccagacagtgttatctgtttggggttaaaacgttttgaaaggatggacactttggtaaaggaactggaactaaaaatggactatggcagcatggacaaagctactcctgaaaacaacaattcaagagattcaaacaacggcatcgacgataatgacacatgggcaactgttgtggcaagaaggaggaaaactaaatcagacacaagtagagaaggaagtggagaaatgcaacaaactaaaggtaaagcaaatgctgaacacttggaaaacagccaacaatcaagtcatagaaatgagatgataaacaaactgaaaagtcaagctagatttcagcgacaatataaaaaagaaacaactctgacaatgactgtgaaagatcctgaaaatatcactgtaacgatgattataaaggctgtggaagataagactggaattggaaaattgtttggactgaggaaaaaatccaattttgactatgaacttactatggaaaatgaaacggactgtgatcacttaatggatggactaatgattaaccaacaattttgtgaagtatcaaaactctgcgcaactgagagaatggtttcttttttgaacttacccaactatattcaagatagtgaaatcatccaaaagctggtggactggggagtttctccaattctcccactgagaagaagatatcatccaggaacaactgtggctgatggaacaaggtttatcagagtgaaatttccaaaagaagttatgagtcttccttacaatgtaaagtttgatacagaggaaggaccaaaatattttagagtgatacatgatcagcagataaaaacatgcagattatgtggaagtgctgaacatgaaaaaaaagactgcccacaatttgtgtgtagagaatgtctggagcaggggcattttacgcgggactgtaaagccccacggtgccaaggctgcaaaaagacaatattgtggtgcagatgtgaatcggatgaggaagagactggagttatggaaacaaataaacaaatggagaaatcaagcaatgaagaacgggaagaggaagtacaggaattaccaccggatgatttgaatgaacaagaagaggagcaggccatgagtgaagaggatgaaggagatacagcagacactgaggcacaagatctaatgaaagacgatggacacgacatggaagaagaacaaggagcagcaggtgaaaatacagaaagcagaattgaggaagaggtaagcgatgatgatgataatgaagaaataaatattgggactaaagacagaacaatagacagcataaacagaagacgcagaaaaactgtacaattaaatattcagcaagtgcttaagaaacaaaaattacgaaaggaagcaaaagcaaaactaaaaactgaaagaactgatctaagattttagatcataaaaaagactacaaatgattgatggattgtttcatttggattttcttttgtttggatggcttgttttcttttatatttctaatgaacaacttatgtttggtttcaattaatgtaagagggctgtcatccaaagtgaagtttgaaaatgtaattgctttaacaaaaaaatgtgatgttatatgtatacaagagactggatggaatgaaaacattgttaatgatttaaaaaaatgttgggatggggaaatattgtataataatgacccaaataagaaaaaaggcatggcaatattaattagaaggggaataggatatacatttgatgttttatttaaagataattatggaaggattttaactattaaaattatgaataaggatgaagaaataagaatatgtaatatacatgctccaaatgaagacttggaaagagttactttttttaaagatctaagtgttttaatgagtggatggaataatgttattgttttaggagattttaatactgttttagaaagaatagatgtagatgatcatatggtgtttagagcagatgttggaagaagagaactgaaacacatgattgaaaaacataaatatgtagatgtatggagagagagaaatagagccaaaagagaatactcaagaaggcagtgggtgaatacagttttaaaacaaagcagattagactatgttttatgtacaagaaatgtagaatcttttatttcaaatattttttacaagatttttagctgtagtgaccatgattttctgtatgtaatgatggatttcagtggagttgaaagaggaccaggtgtatgggtgtttaatacagagcttttaaagaatgatttttataaaattgaaatggaaaacattattattaatagtgtgaatgatgagttatatgatgaagaaataagtgtgtggtgggacaatgtaaaattagaggccaaaagattttcaatagaatgttcaaagaaaatgcagaaagccaaaagagctaaagaaagacaattaaacaaagaatgggagaatgaaatggaaaagataacagaaggaaatatggatattaggagaatagtgatattagaagagaaactgaaaaaactagaagaggaaaaatgtatgggagctagaataagaagcaagataaaaaatacagtggaaggagaaagaagtacaaagttcttttatgatctagaaaaaacacgacaaaaagcagatttgataaagaatgtctcaacaaaagagaaaactgtcaaagataaagaaagtattttaagaacagttaaagatttctatgaaactttgtttaaagcaaaaggagttcatgaagaagataaggattttttattgaatcaaataaaggttaaagtaagcgaagaggataaaaaactgtgtgatagtgatataactgaagaggagatcaatgaagctataacacaattaagtaatgggaaaagccctggtttagatggtttgtcatctgaattttataagacttttaaagatgttttaattccaattttaaaagatctttttattgctatttttaaaaaaggacagttgagtgagagtatgaagaaaggaatgattaaaattatttataaaaataaaggtgataaagattatttgcaaaattatagacctttaagtatgcttaatacagattataaaatattagcaaagattttagcaaacagacttaaaaaggtagttcccactcttattactactaaccaggcttatggtgttataggtagagatatagcagacacagtaacaagcatcagagatttaatctggtacataaaagaaaaaaaagatgaaggatttttattcagcatagatctagaaaaggcttttgatagagttgagcatagctatttatttgacataatacagaaatttggctttggtgagaattttattaagtggataaaatgtttttatacagatatttttagttgttttaaaataaatggatttttaaccgactacatggagatttctagatctataagacaaggatgtcctttatcagcgttattatacacattagttgctgaaccattaggcttagctataaatggagaaaagaaaattaaagggtttaaaatagaaatcaatagaacagagcagaaaatttaccagtatgctgatgataccactctatttttaaaagattttaaaagtgttggaaaagctatggaaatatttgataaatattgtcgaggatcggtagcaaaagtaaataaagaaaaaactgaatatatgaagatgggaaaagtagacgttcaacaaggaaattgggaatataaagaacaaaaaaaatacataaatatcttaggcattacactgggatatgatgaaaataaaactagagaaataatttgggatgaacttataaataaaatggaaaaaagattatgtttttggaaacagagagtattgtttttaaaaggaaaagtactggtattaaattctctttttctatctaagatgtggtatgttttaagtgttgttagtctacctacgtgggtgtataagaaattaaaaactatgattttaaactttttatgggatgataaaccatctaaaattgcatataacactatcattggaaaggtggatgagggaggactaagacttatagatccatggataagaataaaaagcatgagaattaaaacattaaaaaagtttttaaatgaagacaatattctatggaaaagcataatgagttattttattaataaatgtggacaaataagagatgatttcttatggatggcatttaaagaccgcatgatagaaaatattcctgagttttatgaagagttgttgagaacatggaaatgcttttataataatatacaaactgagattgaagggagaaaactttatttacagcaacccctatttttaaatcagaacaataaaagcaaaaagcaaatgttttatgagaactggtatgcagtgggttttagacaagtaaaagacattttatatgaaataaaacctgggtttttaccgactcaagcaataatagatacactggaggaaatagaagatgtagatgataaagaaaaaattgaagatcaatacaagaagttaagattagcattaccagatcactggatcaaaactattgaagagaatgaaaaagaaactgaaaatagaaaaataaaagttttttttaaaaaatggatgaagataagattagtatcaatgattgtcctatcaagatgttttatacatgtttgtgtaacactgtgtttaaaaaaacctaaatcaagagaattttgggaaaagttatttgaaaactttgatacttcaaatatatggaaaaatgtaagatcaattttaaaaagtccagcattggaaaacttagattttatgttaagacacaactgcataatgacagagattatctttaaaaagattggggtatcacaagatgatttgtgtaaagtgtgtttggaaaaaaaggaaggcgtgttacacctatttttaaattgtaaaaagttgagtgattttatgaagatgttgaaaacaatggtatgcaattttctgtatgatgaaaacattattttagaagaatgggatacactgttttatttggttttaatgggaaaacaaaaaataagtttgctcttaattatatgttgactcttgcaagatatacaatatggaaaagaagaaatattatgaaacaaaagaaaaaagaaattccattggttttgttgtataaacagattgtgactgaggaaataatggttatatatgactattgcaaaatgtatgaaaagatggacatttttgaaaaatgtattagaaaaaataatccatatattgtacaaacttggactggttttaaagttttcttacctggagatttttaaatattttatcttttaaatatttgtatgtataaatgtcatgattgttgatgatgtattttttaagaaagaaaaaaaaaaaaaaaa

SEQ ID NO: 2 - DNA, 862 bp, Drosophila melanogaster
acacttacctccaatttcccatctaacgcacttgataaaacaaaaatcaatacaattattaaaacaattacaatgtaacactcaccagattttaattttaaatccttttccatggcctcaattgtgacgacgggcctcggcaaaaaatcctgttccggcggcctcaagctgccaatcccgacgctatggccataagacgcggcgctcctggcaactcttgatgaacgactcctctgccacaagaagacagattcctccaccataatgccaacagctccaaatcaatgtagacggctgcgcgggacccttcttcaaaacttcctcttcctgacgactggcgaagtttccctagggtgaaagagatacccaccaaatgacagcggcgcgggattcaaccatcacgaataaactacctgcaatgctggctgcatatacatgctgcaagtggcgcgcatccagcgcccgcaacatgctccagccaaagtacaacacttacttacctgcaacgttacctgaggcctccaaagactcggtgcttccgtccttctggcgggtgtacctgaaagtaaatcaattaaacaatgttagttttaaatctcaatgttttttgtaaaaattttcaattgttaaaacgtaaacaaaccgtgcaatatgattatgttaccagaccatatatctgtcaaaagcctaaattacaaaaatactaactactttaacattaacgttaacattaactatgtccaactcccaaactcaccacatgcaatgttaaactctaaaactcaaattattgtacctatatattacaaaaattgtaatcaaaggcaaaataaattgcggatgcggaacagaattcactctg

SEQ ID NO: 3 - DNA, 4727 bp, Tetraodon nigroviridis
  modified_base (58)..(58): a, c, g, or t
  modified_base (3277)..(3277): a, c, g, or t
ccaaggacatccaaagctctgcggcagatgtggagagcatggccacctggatgaggcntgtgaaaaaattgtgtgcggaaaatgcagagctgttggtcattcctttgacggaggtatgaatggaaggaaatgcaacctttgcggggcaggagatcatcttttccgagactgtcctttgtcctttgcaaatgaactaagggctcagaaaagacaggaggaaaatggtccaaaagtaacagaaatggtgctaattgatttggaagagaattcaaatctcccgccaaaatctgtgattggaggagaggaggccaatgaggtgaagctgggggaggagcctaaagctggcgcggacccagtagagggcagcagtgaggtggctgagggagaccaggcaggaggtgagactccaccctcctcaacgggggagggctccattaggagcctccatattgtggagggggagcatgctacctcttcctccccctcctcctcctccatcacggatgtccaacctggccaaaagagaacagcgtcggaactgtctacctctggaggtgacacagcctcagagaagagggggagagctgaacctggtccccacagttcacctgtggatcaggacagcaactcctcctccagttcatctaacctgtgctctttcctgaatatagcactacaatcaactcccttagagagcagagcaaactttgctttcaggaggtcagatcctcaggattcccccccctggttgtagagggattttccgatgaggaactgttacattactgaaaatggaaaaaatgtttgcattggtttaattgtattgttttaacttttctattgtttttaaatgtcatacctgtatattttttttaaccactatactcatgactctcaccatttccaccataaatgtgagaagtgtgaagtcgagagttagagcccagagtgttttatcctttttaaattcctttaagtcagatgtgtttttaatacaggaatgtggcctaccctttttaaaacaataccgccactgggaggaaatgtggccacagacgtctatatggagtggatccaacaataatcgaaatgacggagtggccattttaatcaaaaaccctcaggtcctggtgaagggtagcactgtggtgagagatgggcgggcacttttagcacaactgacttttatgggacaggattttaacctcttaaatatttatggctttaatgaaaaaaatgacaggtatgaccttttagaagatctgcagtcccacatgttagggaaggtacctttagttgtagggggggatttcaattgtattttaagtaggaaggacagaagaggagcaggggaagattttaaggtagataaaacgtcggttttattacagggcatttgtagagattttaagctacaagactgttttaagaccatgcatccaagagaggagggcttcacctggttcagtggtgatggcaccagagcctctcgcattgattacacttttacccgtgattgcccgataagtgatgctagattaacccctgtgtttttctctgatcacctcatgctctcctgcaccctttcactctcttcaggtgtgacttcaggaagaggtctgtggaaactcaactgctcccttttagaggatagggagttagctgaacagtatagggagcagtacaaagagtggcagacccttcaagacatgtacgacacaagagcacattggtgggaaatggtgaagggaaggactcagactttttttaggcaggcaggaaagattaaaaagaaaaaagagactgggcacatgttgggactgcaaaaaagattacagagatattttaaattgaatcaaaatggcattgattttattgaagaaattaaacaggtgaaaaatgaaatgtcggttttagcaaaaactaaaagcaaaggtgtcatcattaggagcagggagcgtgaaattgaggaaggggaaaagtgcacaagatacttttttaggaaaattatgagcaagggggggactataacaaaactcaaaaaacaaaatgggtgcacagctgaaacaatgaatgaaataaaagaaaagattgagaccttctatacaaagctttatgaagaaaaacctgtcaatactgccaccatagatgaccttttaaaatccatcagtaaaacagtgaatgacaatgtgcttttatcccaagattttactatttcagagttaaataaatgcatcactagttttaagaaagggaagtccccaggagaggacgggctccctgtggagttttatttaaccttctgggatattttagcacaagacttgatgactgtttttaaggattttgaacaacttgaccgacttcctgacagttttagagtagggatagtgactctcctttacaaacacaaggacaagacggacctgaagaactggagacctatcacacttttaaatcttgactgtaagctttttagcaagcttttagcaacacgtatgtccatgtttttagaggaagtgattcacccggatcaagcctgcgctatccccggtaggaagatcacggacagcctggtactgatcagagacaccatctgttatgcgagagacaggaacatgcggcttgtagtcctaaatctagatttcgagaaagcatttgatcgagtctcgcaccagtacctcttccgggtactggaaaaaatgggattcccagcacggtttatagcttgggtgggattgctgtacaaggatatcaccagcaaaattctagttaatgggcacttgacaaaagcagtagacatcaactgcggtgtccgtcaggggtgtccgttatcggcccttctctacgttgcctgcatagaaccgctggcacaggttttgagaagggaccaacgaatcaccggggtacgactgccagggagcgggggactagagacgaggtgtgttttatacatggacgacgtgaacattttatgcactgaccttttatctgttaacagagcgttggacttgactgactggtttggacgggcctctgggtcgaaactcaacagagagaagacacaagcccagtttcatggagcatggacaacgactgagttgacaagactccccctgactgtgaccaggactgaccttaaaatactgggagtgaaattcgacacggaggggggaggggaaacaaattggccagacttggtagggaaagttagacagaaactagggtactggggactccgggaactgacaatggaaggcaaggttttaatcattanatcagtgattttacctttgcttttattgatcagttctgtttttatcccccctagactggtgcttttaaacttggagagagcagttttttacttcctgtggggatccaaatgggaaaaactaaagagagccgtgatgaaaaagcccagggaaaaaggagggaagggagtgcctgacctccaccttttcctgggaagcagatacacagcactgcacatcgcggctgtcacgaccccttccagaaacccaaagacagcagccgtggcacgcttctggatggggtcgtacctcagaagactcggggtcctaaagggagacctcagagcaccagtttcttttaacctaccaaaggcctatgtttttattcagaactttttaaagcattttaatcttgaaaaagaggagctgcatgttttaactcaccaccgtcttttgatttctgttgtacaggagcacgagccagtgagtccggtgccagggcttgcagtaggcgacccttcgattgtctggcaaaacgtgaaccatcctgcactcccaaacagacttcgagacctgtcatggatggcggcgcacgagattctcccggtcaggtccgtcatgcactcccggggaatggcggcacactctacctgcccccgacctggttgtggcgcgcctgagtcggtgaggcacctcctctgggagtgcagtgctgccgtagaccagtgggcaatggccggctccttacaattcccgtacttaccggcaagggaggtcctcactgcacagctagtgcttttcggggtgagtccacagaacatacaagcaaaagactttgcaaagcagtggctcaccctcgccgccatcaaagacgccatatggacctccagaaacttgctggtaagaaagcacatgcagatcccccccgcggcggtgatccggatggccgcagcgactgtcaaagagaacagagctgcaggcggcaggccctaggacaccgccgcaaagaagaatcgcctctgtgcccattcggacgaaggagccggagctacacagaaaaaggtcaaagcagcagcggcctggctctccgggtgaggcaggtgggaaggagcaaaaaggggaggatctcctctggccaccgtactagtcttgtttgggggagcagaatgagttatacttggtaaggactcaccgtgctcctgtacaaagatgaactgaaaagttgtttttattttgattttcttttcactgatgcactccttttaatagacactaaaacactggacagactggacttattttactaatcttaaacaaacattttatttgtactacctacgtaaaacaatgttttatttgttttaaacacaaccagtagaaaaagtatttattgttttattggtaaaattttgagtctgtcttaaatgaaaaaagtgtctgaaattgtgtcaataaatcttttcaaaagaaaaa

SEQ ID NO: 4 - DNA, 5793 bp, Danio rerio
  modified_base (218)..(218): a, c, g, or t
attatacttgggcttgcctcgcgggcagtgacagcgatcgcctcttggaggtttcctggctcacaattactcctgtgttgtgagctctcaacccttgagaggtaaaggaattgcactttttaaggtaagacgttttaagtatttattggctatttattgtggttttagtgttttagtgtgtttagctgtgttggtgcctccaccatgtcggctgctcntgccggcgtgaggaggcaccacaggcgacgctttttattaaaagcaccaaatggtaagctcctggagatgtccagaatggacttctccaggaaggtgagacaaaaccctttaaattttagacttgaagacttgaattgtatagtgactctgcctctaggaaaaggatttgatgttagttttagagctgcttccctattaaatgacttctggcaaaggtttgatgcggttaagatccagttttccatgtttactgtggaaaaactttctgacaacacacttaaaactgttattgtcagaatgtttaatcacacagtccctggagatgacatttgtgtgtggctgggcagatattgcactgtccgcccccagccagtcaaggtgttagatgaggatggcatctggaattgctcctggcgaattcccattaaacaatgggaagatgccgggggctaccagggcttgagacatctgccctcaatgattgtgcttggagagaacaggggctacattcattatcaggggatgcccaaattgtgcagaaagtgtgggaagaatgggcatctcgctgaagcatgccaggagttaatttgtgggaagtgcagagaagttggtcacagttttgagcagtgcaccaatggcaggcggtgcaatctgtgtggagaagaaaaccatctcttcagagattgcccaaaaagctttgccaacaagttgaaaaacaacaaaatggccgccccacaagcaagcatggttgaacaaagggaggaggcggtccctgtggttttggcgggccattccctgccagccacaggaaccggccaggaagaagaaaatggggcggccataggggcggagtcacccattttatttgaacagagggaggaagcccctccccaacaaagtgtgacacaaaatgtaacagccaatgaggaggaggaaacggcttcctctctcctcaccgtctctgaggcaagtgttgacgctagtcaaagtgaaactcagtgttcacttccttatgctcagatgcagaaacgggctgcgagatctcctctggaaatggaggagaaaagactaagggcttcagagcggctagatagttccaaatcggaagatctagaccgctcatggcccttaggttctccaaatggagtttcatttctgcatgtaaagctaagatcatcatcaccgaaggagctacaagaggtcttctctgtggcttctgaagtggttagcatctcctcccctgacccaacacctgttgggataggtaaagagcagatgcaacaagacataacctgatttttatcttgtttttaaaaccattgatatctttgtaaactaactgtaactcttttaaatgttcatatccctttttcatctgctcatggcccttactatttccactattaatgtgagaagtgtgaggagccccattcgagcacaaagcgttttatcttttttaaaactcttaaagtctgatgtgtttttattacaagaatgtgccttaccttttatctctaattacagaaagtgggaagacgtgtggaccccaggtccctccctatggagcggatcgaaccaaaacaaaaatgatggggtcgcaattttaataaaaaatcccaacattctggtgaagggtaccactgtggtgagagatgggcgggcttttttagtaacactgacttttttaggaagagattttaatgttttaaatatatacggacacactgataaaaacgagagatatgaacttttagaagacttgcagccccacatgcttggtaaacctcccctagtggtggcaggggattttaattgtattctaacacagaaagacaggaaaaaggcagattttaaattggacaaaacatcaactcttttaaacaatttagttaaagattttaaattagttgactgttttagacaagtgcatccaagagaggaaggcttcacttggttcagtagtgacagcaccagtgcctctcgaatagactatatttttacaagagatttcccgcccgtggatgctacattgacccccacctttttttctgatcacacaatactatcctgcactctttcacttccccctggtgtgacgataggcgagggttggtggaagctgaactgctccctgttggaagaggaggaagtggttaaaggatatagggagcagttcagccaatggcagaccctccaggacttttatgatacacgagcacagtggtgggaaatggttaaagggaggacaaaaacatattttaaaaaaataggaaaacagaaaaaaaacaaaaggaaaaaacgcatgttggggctgcaaaaacgtttacaaagatattttaaccttttaaacatgggctttgattttaacaatgaaattaaagaagttaaaaaagagatgttggttttagcagaggaaaatagcaggggagtgattttaagagcaaaagagaaaaaaattgaagaaaatgaaaagtgtacaagatatttttttaaaaaaataatcacaaagggaggggggatatcaaagataaaaaacgacgaggggactattttaaataccacagaggggggtttaaaagaagtcgaaaagttttaccaaaacttatatggggaaaaaatagtacacgaggacgctttaaatgaggttttaaattttttagacaaaaaagtacaaaaagaaaaacattcagttttaacccaagattttaagaaagaagatttagataaagctcttaaaagttttaaaaaggggaagtctccaggaatggacggtcttcccctggagttttatcaatgcttctgggacattttagctggggttttactgactgtttttaatgaattcgaaaattttaacaaactacctgcggattttagattaggaatagtttctctgctttttaaaaaagatgacaagacaattttaaaaaattggcgaccaattactcttttaaacactgattataaattttttacaaagattttagcgacaaggatgtcgacagttttagaggatgtaatccacccggatcaagcctgtgctgtgcccgggaggaagatcacggacagcctattgctgatccgagatgccatctgttacgcgagagacagaaacattcgtctagccgtggtaaatttagattttgaaaaagcatttgacagagtctcgcaccagtacttgttacaagtactggaaaaaatggggttcccgggaagatttttagcatgggtgggactgctgtacaatgaccttgtcagcaaaatcattgtaaatgggcatttaacaaaagcagtaaatatctgcagtggcgtccgtcaagggtgtccgttatccccactcctgtatgtggtttgtattgaaccactggcacagctcttgagaagggataaatggattacaggttttaaaattccggggggtttaatagcatcttgtgttttatatatggacgacgttacccttttaacgacagacctcacctcggcccgaagagctatggatttgaccgatttctacggtcgggcctcgggagccagattaaaccgaaaaaagtccgaggcccagctcttcgggccgtggggtaacgtcgtcacagagggactagagctgacttttaaggaaaatgattttaaaattttaggggtaaaatttgacaaagagggtgggggagggcaaaattggaacgacattttaacaaaggtaaaccaaaagctgggattctgggggttacaaaaattaacaatggaaggtaaaattttgatttttaaatccgtaattttaccactcattttacttgtttcttctgtttttagtccaccaagacgttttatcaggaagttggaaagggcggtgttttatttcctgtggggatccaagtgggagcgcctaagaagaactgagttaaaaaaaaagcccgaacatggtggaaaaggcctcccggatccccacctgtttttaggcagccgcttcaccgccctgcattttagttacgcgttgaccccatccagagaaaacaagacggctgccatgactcgcttctggatggggtcctacctgagaaccctgaaagttttagcagtggaccttaagtacccagtgtcttttaatttacctagggagtatgattttataaagaaatttttaaagaagtatgttttagagactaacgatgtcaccattttaactaaccacaaggctctcatttctcttgtgcaggatcgagagacggtgagtcgggtcccgggcctcacattatgtgaggcccaacaagtgtggaggaacgcggcccacccagctctccagaacggacacaaggacctgttgtggatggtggcacatgagatcctcccggtcagggcggttatgcactccagaggcatggccagaaaccccgtctgcccacgggctgggtgtggatgcccagagaccgtgcggcacctgctctgggagtgcggcgctgcgcgggacctgtgggccaggaccggccccctgtatcatcagtacctgccggcggggagggcccagatggactaccaccttatcatccatggggtgggccagggcgtgaaagacatgacacaacaggactttacatcgctctggctcaccctgaccgccatcaaggatgccatctgggtcacaagaaacctgctggtggggaagcaggtcacggtacccctgcaagggacaaagggactgataacaaccacgctacaggggtaccggaccttgacaagaggccaaggggcccggggtcacacggaggaggtcccggccgccaccgtacctggccgcccgtagatgcaccctcaccactctggctacgggaacagcgggccagcaggccagaggagggggatctccgctatgcccttgaaacacaggggctgtgaccgtcctggagagttggtgtgaatggactttttttttggtatgactcaccctcgatcctggacaaagaaatgattttatcttcttattgttactattgcttttcatgcattttttaacggactgggttttatcaccttttttatcaacatctacgccaaggactttttttttcataacacacgcacacacaaaagactctcgcacaacatacacttttatttcctccacaaaccctgattttaaagtgcttttgttaaatgccatatgtcttttaatgtgtattgaaatgttttaaaatgtgtgttttatgtttcaattcatttttactaagtcctgcgttgttaaaatggtgactagaccgtgattcttttttagacccgttttaatttttattgaacagcttgttttttagtctttcatttgtttgccttttttaaaaaaaaaaacatgtcctctatacacttgacattttatgttcatttaaagtacttttgcaagtatttatttacttatttatttatttatttatttatttatttatgtatatatttattcattttttatttatttactgttaagtactcaaatgaaactaagtgaaaagatatgtttttaaatatgattgtgatgtaagaaacaaatgggaaacgctgtcaataaatttttttcgaaagaaaaaa

SEQ ID NO: 5 - DNA, 5443 bp, Takifugu rubripes
ctgagtgtttttcttaaccgtcttatttgtatttatcttttaagtagcacgtttccttttaacttacttttaaaattatcttttcttttacaagcttttatcctcgcttgtggtgcctccagccatgtcggctaattatgccggcctgcggaggcaccgcagtgtcaggttttattttaaagatgagcaagttaaaatatcacgtttagacttctcacgtaagtttgtccagaaccttttgaactttcagcccgacgatataaattgtattttgactctgccggcaaacaaaggatatgacgtaagtttttgctctgcagctctgctccgtgagttttggacccgttttgaaaatgttaaaagccaattttctgcatttgctgttgaaaaactgactgacaatgcccataaaacggttattgtcagaatgtttaatgaaacagtgaatgcagaagacatctgtatctggttggctagattctgcactgttaaaggccaggcaaccaaggtaagagacgaggatggcatctggaactgtgcttggagggtccccattcaacaatgggaggacccccaaggcttccagggcctgagacacttgccgcaaatgattgttctgggtaataacagaggctatatccactaccagggtcaaccaaaactctgccgcaaatgcggcgagcaggggcatctggcagaggcttgtccagttattgtgtgtgggaaatgcagagcagttggacattcctttgaggagtgtaccactggaaggaaatgtaacctttgtggagcaacagaccatcttttccgagactgtcctttgtctttcgccaacaaactgaaagctaggaaaaaacaggaggaaaaggggccaacagaaaatgaggtgcgaactgttttggagggaaattcaaatctccctccaaaacctgtgattggaggagaggagtccagtgaggttgggcagagggaggggcctggaccccacccagttgaagctgacatggagttggggaggagccatcaggcagacagtggggttcggcccgcctctaccgatgatgactccactaggagtctccatattgtggaggaggagcagagctccacttccctcccagatgcccaacctagttcaaaaagaacagcatctgaactgtccaactctggggctgaatcagcctcagagaagagggggagagctgaatctgaacatcacagtccccctgtggatcaggacagtggctcctcttccagttcatctaatgaatgttcctttctaaatgtagcactacagtcaactccactcagaaagcgcgcagactttgctttcaggaggacagattctcaaagcttaccccctggatgtagggggatctttcgatgagaacctgttacagcacaagcaacaaggcaataaaaatgtgcttgttacttattcttaagatacctgcttcttttaaaatgttgtacttgtcattttaaacatactcatgactctcaacatttccactatcaatgtgagaagtgtgaggtcaagagttagagcccaaagtgttttatcctttttaagttcctttaagtctgatgtgtttttattacaggaatgtggcttaccatttttaaaccactaccgccagtgggaggagatgtggccacagacatccctttggagtggatcaaatgaaaacagaaatgatggagtggccattttaattaaaaacccccaggttctggtaaaaggtagcactgtggtgaaaaatggtcgggcgcttttaacacatttgacttttatgggacaggattttaaaatcttaaatatttatggctttaatgaaaaaaatgacaggtatgaccttttagaagacttgcagtcccacatgctaggtagggtacctttagtagtagggggagattttaactgtattttaagtaggaaagataggagaagaacaggggaagattttaaagtagacaaaacatcagttttattacagggcatatgcagggattttaaacttcaagactgttttaaaaccatgcatcccagggaggagggcttcacctggttcagtggtgatggcaccagagcctcccgcatagattatgtctttacacgggactgcccagcaactgatgctagactaacacctgtcttcttctccgatcacctcatgctctcctgcaccctttcactgccttcaggtgtgacatcaggaagtggtctgtggaaactcaactgctccctcttggaagatagggagttagttagacagtacagggagcagtacaaagagtggcagacccttcaggacttctacgacacacgagcacactggtgggagatggtgaagggaaggacccggactttctttaggcaggcaggtaaggaaaaaaagaatagggaaaccagacgcatgatgggactgcagaagcgactacagcgctattttaaccttaaccaacaaggtattgattttaatgaagaaattaaacaagtaaaaaaagaaatgtcggttttatcagaaattcaaagcaaaggtgtcattttaagaagcaaggaacgggaaattgaggagggggaaaagtgcacaaggtatttcttcaagaaaatcataaacaaaggggggaccatcacaaaattgactaaagaaaatgggtgcacaaccgaaactatagatgaaattaaagagacaattgaaagcttttatgaaaaattgtataaagaaaaacacgttcaaattgacaccatgaatgaaattttaaaattcctaaataaaacagtgaacaacagcgtgcttttatcccaggattttacccttttagagttaaataattctctatgtagttttaaaactgggaagtcccctggacaagatggacttcctgtagaattttatttgactttttgggaccttttagcacctgacttaatcactgtttttatggaatttgaaggactcgaccgacttcctgacagttttagagtagggatagtgactctccttcacaaacaaaaagacaagacagaactaaagaactggagacctatcactcttttaaatgttgactgtaaactttttagtagacttttagcaacacgtatgtccacgtttttagaagaggtgattgacccggatcaagcctgtgccattccggggaggaagatcaccgacagcctcgtactgatccgagacaccatctgttatgcgagagacagaaacatgaggctagtagttttaaacttagattttgagaaagcctttgatcgggtctcgcaccagtaccttttccaggtactgcaaaaaatggggttcccagaaagatttgtagcttgggtgggtctgctgtaccgggacatcaccagcagaattctgtttaatgggcatctgacaaaagcagtggacattaactgcggtgtccgtcaggggtgtccgttatcggccctcctctacgttatctgcattgaaccactggcacagatcttgagaagggacaaacgaatcaatggggtgcaagtgccggggagcggaggactggaaacgagatgtattttatatatggacgacgtgaatgttttatgcactgaccttttatctgttaacaggacgctggacttgactgactggttcggacgggcctctgggtcaaaactaaacaaagaaaagacacgagcccagtttcacggaccatggacagcgacagacatgacaggactccccctgaccgtgacacagactgaccaaaaaatacttggtgttaaatttgatcgggaggggggagggaaaacaaattggccggacatggtagggaaagtcagacaaaaactaggattctggggacttagaggactgactatggaagggaaggttttaatcaccaaagcagtgattttacctttgcttttactgatcagttctgtttttttccctcccagaagtgtgattttagaactggagagagccatcttttacttcctgtgggggtccaaaatggaaaaactgaagagagcaatcatgaaaaaaacaaaagaaaaaggaggaaaagacgtcccggacctgcacctgttcttaggggccaggttcacagctatacatgtgggcatagtcacagccccatccaaaaacccaaagacggcggcaatggcacgcttttggatggggacgtacctcagaaaactaaaaattgaacctgtaaacctctcggtgcctgtgtcctttaacctaccgacggcatatagttttatccagaggtttttagtgcattttaatgtggaaaatgaggagttgcatattttaactaaccaccgctctttgatttctgttgtgcaggagcgcgagccagtgagtccagtgcgcggcctcgcattaggtgagccctcaactgtttggcgcaatgtgaaccaccctgctctcccaaacagactccgggacctgtcgtggatggtggctcatgagatcctcccggtcaggtccgtcatgcactcccgaggcatggcggcacacgcaacctgcccccggcctggttgtggcgcgcctgagtcggtgaggcatctcctctgggagtgcagtgctgccaaagaccagtgggcaatggccggctccttgaaattcccgtacttgccagcaagggaggtccttacagcacaactggtgctgtatggggtgagcccaactgtaataccaccgaaggactttgccaagcagtggctcaccctagccgccataaaagacgccacatggacctccagaaacttgctggtaaggaagcacatgcagatcccccccgtggcggtgatccggatggctgcagcaatggttcaaggggccggaactgcgggcggcaggcctaggacaccgccacaaagaagaatcgcctctgtgcccattcggacgaaggagccggagctccacagcaaaggtcaaggcagcagcggcctggctctccgggtgcggtaggcgggaaggagcagcagggcgaggatctccgctgaccaccaacagtatcccgagagatcaaatgtttggaggagcaggctgagtgagacttggtagggactcaccacgctcctgcacaaagatggatatgtttgaactgatgcactcccttgtacggacttttaaagaagctttcaaaggacacatgaacactaaatgtaacacctttaaccaatggaaatggctattttacctacaagactgttttaaaaaaattattctaaatgtatatatctttttcttaaaaatggttttatagtcctcacaatttggatattttattggtatatattgaggtgtatatgtgaaccttttactcaaagtttgaaaatgtctcaactatttaatattttattggcatatttgaggtgtatatgtgaaccttttactcaaagccagaaaatgtaaagatgattgagtgccaataaactaagaaaaagaaaaaa

SEQ ID NO: 6 - DNA, 5400 bp, Danio rerio
ggtgcatgctgggagtgtgaggtgtagctgagtgcgtgtttgagagcgttgagtgattgttttttctatctcttttccgatcattcttttcttctctttttcttttttcttttgtagtatagacagtgtagagaaagttttttcccgtacggaagacttaacaggcgccggtatggcgtctgttcaagtacaaggagcgtcagctctgtcatttcggaatgggtgcaggtgtgtggcagaccctgaagtgacagtggaggatatcctccagataataggagaaaaagtcggatttgaaaacatcgtctcggcttcgcggatgaacaaggccgtggttgtgtttttaaaatccgagtcactaataaacgagttgactgtgagcggaatatgggtaaaagaggcgtttgttccgataaccccgctatccgctccagcaacaaaagttactatctcaaatgttccaccttttgtaagtaacgaggctatcctaaaagaactacaacgttttggtaagattgctagccctgttaaggggattccactcggatgcaaaaatgccgcgctgaaacatgttctgtcttttaggcggcaggtttacatgtttctaaactccccagagcgcacattggaagcgtcctttcgcatcattcatgaagagagctccttcattatatatgccagcacagaaagtatgaggtgctatggatgcagagattttgggcacaaacgttttttgtgccctcaaaaaaatgaacaacgcgcttcttcatcccaagctgagacgagtaacgcggacacattgagagttcaggggacagacgaaatgacaggacagcaagaggtgagtgagctggaagttaatattactggcagtgtggagaaacctggctgtagtactgatagtaatgcagatgtgagtaatgctaagtgtgatgaatctaaagctcagagtgatactgaagttgtgtgtgaaggtggtacagaacaggaaagtggatcaaaggaaagttttgatgatgaaatggaggggttgtcacagtgcactgatgatggtctgagagaagatgatgaacaatggtctgaggttgtgaagaaggctaataaggatctatataccctagatcaaatcaatgcctttcttgataaaacaaaaggaaaaattggtgttgagataagtgattattttcctgatttagacaaatttgtctcttcagttatgtctgtcaggaagaaacataattatgatgagttgtctcaacagaagcgctttcgtctgaggaaacatctaactaatatacggtcaactggaaagataggaaaaacaaggggaaaatctaaataattaggatgtttaaactacttgttttcctctttgtttccctctctctctctcttttctatatggaaattttgagggtgggttctttaaacacaaatggtttgagggatgaaaagaagaggaacctattgttagaatccataaggattaagcaactaaatgttatttttttgcaagaaacccatagcaattctaataatgaagctgaatggggtttgtgttggaaaggggagaaagtgcttagtcatgggacgaatcttagcgctggtgtggctatattattctcctctgctctaaaagttcaaattttaatgataaatgagatagagttaggtagattggtagctgtaagagccaaaattaatgatctttctttcctgtttattaatgtctatgctcaaaataatggggcagatagattaaagcttttttctaatttagagtgttttttaaaacaacagcaagatggggactttattataataggaggtgattggaattgcactttagattttaaatatgataggaatagtgaagaaccacatatgcaatcagcttcacgtctggctggaattttaaagaatcaatatttttcagatgtgtggagggaacaaaatgcttcaataaaacagtacacttgggtaaaaataaatgatggtaggttttctggagcacgtttagatcggttttatgtatcgaacaatgtaaaaaatagagtggttggtgcaaatattattccttcatttctatcagatcacaaattaatcacagttgagtgtacattgttaaacaggactcataagagctactattggcattttaacaacaaactattgcaagataaatatttttgtgaaacatttaaatctttttgggaggcttggaagaatgagaaggggttgtatgaaaatattattcaatggtgggaaattggtaaagtgcaaataaaggttctatgtcagcaatatgctgcccaatcctctggggtttttaaaaaaacaatagagttattggaaaaggaaatagaggaaattgaaaaaagtatgactgttaatgatgctggtaacctacaagaattgtggactgaaaaaaagaaccagttgggttctattttaaatgaaaaagttaaaggggcacttgtaagaagccgtttctcaaccataaaagacatggatggtccaacatcttactttttcaacttggagaaaaaaaaaggacaagaaaaattgatgtttgttttaaaagatgatgatggtcaggacacctcagatccagttttaatgcgtagacttgctgtacgttattattctaatttatttgctgctgaaaccactgacgaacaaagcagaaatgaattgttacaggacattccttctttaacttcaacgcaaaaagaacttttagaggttgattttaagtttgaagaagttactgctgctgttatggacctttcttcaggaacagcacctgggatagatgggttatcttctgaattttttaaaacattttggactttaataggagctgattactatgaagtgcttaaagaatgtatgaaaaagaagattcttcctgtcagttgtcaacgggctgttttaactttgttaccgaaaaaaggagatttaactcttttaaaaaattggaggccagtagcagttttgtgttctgaatacaaaattatagcaaaatgtttatcaaacaggctaaataatgtattgcatgaaatcatacacaaagatcaatcatactgtataaaaggaagatcgattttagataatttacacttagtacgggatgtttatgattttgcttttaaaaataatattaatcttggatttttgtcattagaccaggaaaaagcttttgacaaagttgatcacaactatctttttgaaactctaaaagcttttggttttggtgacagttttatttccatggttaaagttctttataataaggctacatgtatggttaaaatggctggtggtcttagtgttcctattgaaattcacaagggtatcagacaaggttgtcctctttcaggacaactctatagtatagttattgagccactgttgtgtaaattaagaagatggttaactgggttaagtgttcctgaactagatttccaagagcctgtaaagatttctgcttatgctgatgatttaacagttatagtaaaagatcatagtgatgttcattttttaagagaaataattgaacaatatggcaaagcatcatctgcaagaatgaactggagtaaaagtaatgctctatggtgtggtcaagctactaatggtcctatgcttccgggtaatttgcagtggggcagaatgggttttaaatatctaggagtctttctaggcactgatgattttataaaacaaaattgggaggggcttgtggagaaagtgtgtgcgaggttgtctcgctggagatggttgctaccccagctttcctatagggggagagtattgatatgcaacaacttggtggcctcatctctttggcataaaatgatgattttagagccccccagggacctggtggcaaggatccaaaagcaactcatagactttttttggtcaggacagcactggctaagggcatccgttttatacttgcctatccaggaaggcggacaaggacttgtggatattggatccagagttgaagcctttagacttcagacggctcagaggttgctctatgggaaggacgtgtgttgggcaggaattgcctgtgcacttttaaagaaagctggtaacatgggcctagatcgtcacttatttttaatggacactaacaagctggatttaactggtctaacagctttttacagatcactgctgagaacatggtcacgattcaaagtttcaagagaactcggaagtatacggggcctctggtcgaaagaagaaccactcctttttaattctgctatggacctgaacatttttaaatctgattctttcagaaaagctttgtggtctgcaaagatcactaaaattggacatttggtttctggaggacaatggataaatgctgaggccttagccttaagattgggcatgagatcagtacgggtggctgaaagactgttgattgaaatacaggagaatttaccagtgaacattagattgacttcagaggaggacgtttcagtatttccagagttgattctctcagcggatacaggagaatggcaggagacagaaggaggacttctctcttttagaatacctcagccaagtctgttcgaagatgcagggaaaaaaactctgtatacactttgtgtaaaagtagtgcatttccacatgcttgaaagcctgaaggaatcaaagtggcagactctttttgaaccagattcttctcccaaaggttgctggaggaccctgtacaaacctcctattgaaaaaaggtctggagaccttcagtggaggatagtgcatggtataatagccacaaacagacacagagcacacattgatccacaggtgatggaggggtgtcctttttgcaatatgggagaaacagtgtttcacttatttttaaattgctctagattagaaatgttcctttatcaactgaatggatactgtcaaatgttaggagaagtttttacacccagtctttttatttatgggcctaaatacaacaggaacaagatgcatgtccatgttttattaaattttatttttggaaaagcaaaattggctatttggttgtcacggaaaaggaaactgacaggtctgggtttgactgatgttttttggtttttaaggaacttattaaatcccgtattaaaatagaatatgcgtattataagttgattgatgatttggacacttttagatctaaatggtgtattaatcaatgcctctgtgaaattggtcaaaatggttgtttggaaatacttgtttgattgttgaatgttagccagctcttatatatatatatatgtttattttctaatgtatgtatatgtataaggtttgtgatttttcattaatgtggtaaaaaaatggttgtaaataaagagattgttaaagtcaaaaaag

SEQ ID NO: 7 - DNA, 5541 bp, Danio rerio
gtgcgcatgcgctggttgagtggactgagtgtgtgggcgagagcgtgtggctgccgtatgaggtacgagtggtctatacttctctatctttacctgctgctttcctttttttttgttagcgttaattatagtttttgtttccttacattgttagtaagtattattttatgtttttggattagagaagtgagtgttggtttgagccggggagtccctgctctcacctgttgagagtatggctgccccaggtagtggaagttttaatgagttgacaagacgtcacggagtgaaaatagactcaactgctagtattgaagaatgtggtttagcagtgggggaagaagtcgggcatgataatattttatcagcttcccgaatgaatggcgctgttgttgtttttgtgaaaactgttgatctagctaatttgttagttcaaaatggaatagtgattaacggtatttttacaccggtgcttcctttgtctacaccctcaaaaaaagtaacgttgtcgaatgtgccaccttttatccctaacgaagtgttgacaaacttacttaagcgttatgggaaaatagtttcacctattaaaatgatcccgatcggaactaaatcgccgctcctaaaacatgttgtgtcatttagacggtacgtgtacatggttttgcaagaacatcttgatgaacttgacttgtccctaaatttccgacatgaggactttaattatgttattttcgccacaacaaataacgttaagtgttttaactgtggcggttacgggcatttaattcgcggatgtcccaataaggtggacaataaatcaaatgaggcaactttaccggttgcgactgatgagagtgacgcgcgtcaggaaaatcagaccgctgcggcgcaggttgtagaagaggaagcacctggaccaagctcaggtcagacagctgctgttttgactgagcctgggaatattgaagaaagggaatcagtggacagagctgtggacgaagaagatatgattgtcacgggtgatgaaatgaatgaagttgagaacgtttcaaccgctgcggaagctgtggtgagtgaattgtttgatcagcgggaaggtgcgatagcagagttggatgacaatttatttaaaacacctcagaaacgtaggcgggaacagtgtcctttaaatgagcgagcaaagagaggtgctggtgatgaaccgggtcaaacagacacggaaagcgaaagggatttctctgaatgtagcgtcagtttcagtttaccattgagcggctattctagcaagaactatactgcacacgaaattaaaacttttcttaaagacaccaagaatgcgagaaatattcgtattgaacagtattttcctgacgtgagacaattcattgacaaagtgaggatttatagaaacgaaggatgcttcaataagcaggaagtatttcgtcttaggaaatttattggcaagataaatgaagagatggagtccagtgctagtaatgagaactagtcggcacctttatgcagtattttgtttgtggaacttgctttgcttttggcttttcttagctatgggggaattaaacattgcttccttaaatataaatggagctagggagggaaaaaagcgtttttatctttttgaaatgattaaggagaaaaaaattgatgtcttatttgttcaagaaacccacagtgatgccctgaatgcttgtgattgggccagagaatataatggactacctatactaagtcatttaagctctgttagtggtggtgttgctgttttattttctaagaattttattccatgctcttatcaagtggaagaaattataaatggtagattattaaaaataagagctcaatttgagaattctgtttttgtttttatttctgtatatgttcctaccagagccatagaaagaatgtgttttttagaaactttaagtaatgttttggcaaattgcaatactgaagatgttttaattttaggaggggattttaactgcactgagagttctttagatagaaatcatgtagaaccccatatgccatcacaaagaaggcttatacagttgatacattttaatgatattactgatatatggaggaattttaattcttatcaaagacagtatacttggctacacacttatgataatttattatctttagccaggttagacagattttatggatataggcaccaacttaatttatttaaagaatgtgttatttctcctgttggcttctccgatcatagcttagtaaaatgttctgttactatgggccagtttaggccaaaaagtgcttactggcatttaaatactaatttactaagtgactgtacatttcaagatattttcaaggagttttggagtaactttaagtctacaaaatcaaccttttgctccatacaacagtggtgggattttgcaaaaacacaagtcaaacagttgtgccagcaatacaccattaatgttacaaaggacaggaaaagtacaattgaagtattagagaatgaaattaaagccatgcaagaaaaagcagatgcttcaggagacttgggttttataaggaattttaaagaaaaaaagaattctctaaacaatttacttgacctgactgctcaaggagctcttgtcaggtcaagatttcagaatatcgagtcgatggatgcaccatccaaatttttctttaatctagaaagaaagaatgggcaaaaaagatgtatatataacctgctctctgagaccggaattttgctgtcagaatcttctgaaataagaaaaagggcagttaatttttatcaagacctttataagagtgagatcatttctgatgaatcagatacaagtgatttttttaacaatttaccccaagttcctcaagattttaatgttgagttaaagaaggctgtcacactagaagaattacaaaaagcacttcaaagtatggaatgtaataaagtccctggcattgacggcttaccagccgaattttataagactttttggaaagaagtcggtttggacttattgcaagttataaatgaaagtttggcatatggacaattacctttaagttgtagaagggcagtgcttactttattacccaagaaaggtgatcttaatgatattaaaaattggaggcctgttagcctgttatgtactgactataaattactctctaaagttttagctaacaggctaagtgatgtccttagccatatcattcatccggaccagtcatattgtgttccaggaaggcgaatatttgataatatctcttttatcagagacattttagatattggaaaaatttttaatttgaattttggccttctttctcttgatcaagaaaaagctttcgatcgagttgagcacaaatatttgtggaacactttaacagcctttggttttaacaatgagtttgtatctatgttaaaagctttatataacgatgtggaaagtgtcttgaaatttaacgggaatttatgtgccccttttaaagtttttaggggcattagacaaggatgtgccttatcgggtatgttgtatactttagctatagagcctctgctaattaaaataagagcgaaattaagtgggttatctctaccaagttgtacaaattgttttaaagtgtctgcatatgctgatgatattgttgttttaattaatgggcagattgatgttaccttgttactggaattaatgaatgattttaaaaagatatctgccacaaaaatcaattggtcaaaaagcgaagccttattagttggaaattggcacaacgcagagccaaaacttccagaaggactaacttggactaagcaaggttttaagtatttgggagtgtttttgggagatgagctgatcatgcagaaaaattttgaagacattattgaaaaagtcagaggtcgacttgaaagatggaaatttttactttctaaaatttcctataaaggacgagtgttgatcataaacaatctaatcgcttctgctctgtggcatcgattaatttgtgtggaccctccaagtgacttattaataaaattgcagtcacttttgatagactttttttgggacaagatgcattgggtacaaaaagctattttgtacttaccgaaagaagaaggaggacatcatttaatgcatatccagagcagagttgcagctttcaggattcagttcattcaaagacttctgactggtccggtggactctagttggaaaattgctgcatgtgctattttgcgagggtttagaaatttgggccttgagaaatctttattttggactgacccacaaaagatggactggtctaaattgcccattttttatcgaaacatgtttaaagtttggtctctatttaaagtacagaggcatggcaatgcatcatctttattttggttgctccaagaacctttgatttttggatctcgaatggacttatcgaatcaggggattctcccttctgttaacgagattcttctgaatgcgggagttgtaactgttggacacttgtttaaactggctggccctgcttttaggaatgttgaacctgttgcgaatcgtttgggtttaaggtccaaacgaatagtagcaaagttacttgaaaagtggaaatccttttttacccctgaagaagctaacatgttggaaaattatgctgatggtttaatcattccaaattgcaatgatccttttcctgatttatatttatcaactgattttaaggagtgtgaaggtgtttttttgcaaaataatgtgttgtttttaatgggaaccaattctgagtttggaaaaaatgtttataatagttgtgtgaaattgctaaataggaagtcactgaatgataaggttgatactccatggcgctctgttctccatttaaaagagaatgctaaaccagagtggagagctctgtataaaccccccttaccaaaaaaagtgggggatttgcaatggagaatcttgcatggtgccatagctgtgaatgcgtttgtttcaattataaatccaggtaatagtgatgaatgtccattttgttctcaacgtgaaaccctatatcatgcttttatgttatgtaacaggcttagttccttttttcaggtcttatctaacttgtttgtttgttttggcgagacattttctatggaaacgtttatttgtggttataagtatacacgtaaacgacgttttttttgtcagttattaaattttcttttgggtcaagcaaaaatggcaatttatgacactagaaaaatacaaattgagcaaaactcaagtggctgtttaaaaacatttttttttaacttggtgaaatccagaattttaattgatttccagtattacaaaacaatgggtgatcttatgtgttttgaaaaaatttggtgttacaaaggagttttatgtcaaatttgtgatgaaaatttagagtttatggttcattaggctgtttctaatttttatgtgtaacatttgattgtataacgtctttaaaatgtttattaaaggcgtgttgaaaattcaaaat

SEQ ID NO: 8 - DNA, 5637 bp, Tetraodon nigroviridis
  modified_base (70)..(70): a, c, g, or t
  modified_base (714)..(714): a, c, g, or t
  modified_base (717)..(717): a, c, g, or t
  modified_base (812)..(812): a, c, g, or t
  modified_base (828)..(828): a, c, g, or t
  modified_base (883)..(883): a, c, g, or t
  modified_base (4430)..(4430): a, c, g, or t
gagcgtgmgcggacgtgtgagtgaggagctgagggcgaatagatattgcgattaaaactttgcagttttnaggtggaaaaaaatmtttcggtgtgggtgggtgtgtggatgaggtttatatattttthttttgaaggagtggggagtgttttgtgygtgagtragtggaagggtgtgtgagtgtgtgtrtgggygcgtggcgcttttgttgggcgthatgcaggtggtggggacgcacmggcggagttcgagaagctgactcgcygtcacrgagtcaagctgaaccccgcggtggcgtgttcggtggaggaggccgcgttagcggtgggggacgtggtgggacaggacagcgtgagatcggcctcgaggatgaacggagccatcgtcatatttgtcgagagcacggcgaaggttggcgagctggtggagaagggggtggtratccaggacgcgttcaccaccgtctcccctctcaccaacccggcmacaaaagtgatgatctccaacgtgcctccgttcatcaggaacgaggccctgtccarggagctgtcccgctacgggcagctggtgtcccccatcaggatggtctctctggggtgcaaatcactgaagmtaaagcacgtggtgtgtcaccgaagacaggtgatgatgatcmtaaaagamaaamaaagcgacctgaacctgtmtttctcmatctacgtggaaggttttaantanatggtgtttgcgtcctcagagrgcatgcggtgctttggctgtggggcggagggacatcaggtccgctcctgccccgggaaatgcggagcccagcnkktggcagccgcgganktagccgsgggcgggstccgcggtyttttstgcgctbkggtggtggcgaacgatncggtgggtgcggagccagtggctcccgcaccgatggaggccctgggggggggggctccccccacggtggggccttccccggccgggggggctccccccgtggtggggtcttccccggccggggcaggctccaacccccgaccagggtagtgtcatagagggagcactggagacaccggttcttccacccgtggaggactccgtgatgtctcaaaaccccagtgaggacgagggaacaatgagtgacattaaagtcaccagaaacaaaaagaaagagaagaaaaagacgtcatttgaagagacattgactgaggaaatgtcagatgaggaaatgatgaaaatgtcacagaaaaggaaaaacacagatttaggacaaaaaaacaggccaaaaaaggcaaatwaggaggcagcagggccggcagacccagagagcgacctcgggcagtcccaggacagccaggaggtctacactccggcccaaataaaaaccttcctggaacagaccaagggagcgcggctgccaaacgttggtgacgttttccctgacctagcatcgttcgtcaggctagctcgggttttaaccaggaaagcgtcagggaaaaccaatgaagagctcctgaacgaccaggagatctaccgactaahacaactagttttgagggtaaaatatcagatccaacatgatgaggatggattttagatttttttaaccctttgataaaatgtatttattttattttattctattaatgtgtgattttaacatcagtaccttaaacctcaacggggccaggtctgattttaaaagagctgctctttttaaactgatggacatcaaaaacatagacgtcctgctggttcaggagacccacagctgtcagaagaaccacagcgactggagaagggcttttaatggggaggccattctaagccacgggtccagtctgagcgggggggtgggmgttttatttgccagaaggttcctacccatctcttttacgactgatgaaatcattccaggtgttttattgaaagtgaaggctgtatttgaaaatgtgaaactggtgtttttaagtgtttatgctcccaccaatcaggtagagaggatggcatttttaaacattttaagtgactgtatagccaactctgctgatgaaggttttatgtttttaggaggggattttaactgcacagttagtccggacctggacaggaaccatcctgagccgcatccagcttcagcccgggccctcggacggctagcagagagccgggagctggctgatgtctggaggacttttaacagggaggctaagcaatatacgtacagtcacagcaggggaatggttttatctgcagccagactggaccgcttttactgttttaaacaccacttcaatgtttttaagaagtgtgttattagtcctgtgggttttactgatcactgtcttgtaacatgtcatgtttttatcaaaaatgtccgcgtaaagagcacctattggcattttaacgctgctcttttaaacgaccaggcttttaagaacgcttttaaactcttctggctgtcccagagagagagcagacctgccttcgccaacatacagcagtggtgggattacggcaaagcccaggttaaacagctttgccagcagctractcgcggtgtcactaaagagttggtgaggaacatgaaagacctggagcagcaggtaggagatatcgtttcttcagccactcctacaggaaacagggggtcattgagcaccctcaaatcaaaaaaggcagccttggccaacctgctgggcgtctcagcgcagggcgctctggtcaggtccaggttcatgaacatctcccagatggacgctccctcccggttcttctttgggctcgagaagaagaacggacaaaggaagatcattcactccttacggacgggtagcggttctgaaatctcagactcgtctgagatcaggaagtatgctgccgggttctacaaggacctctacaggagtgagtggtcgagtaatcctgacatgcaggacagttttctcaggggtctccctcaggtgggcgaggacaccaacgcagggctggcagcagaggtgaccctgccagaacttcacgccgccgccctaagcctgcagaacggcaaggctccagggatggacggcctgccggtggagttctacaagtccttctgggacgtcatctgcactgacctgctggaggtagtctcagacagcctgaggacaggcagactacctctgagctgcaggagagcggtcatcaccctgctgcccaagaagggagaccctcaggagttaaagaactggaggccggtgtccttgctgtgcacggattacaaaatcctgtccaaggctctggccctcagactgagggaggtgatgtcgtccatcgtccaccctgaccagacctactgcgtgcccggcaggctcattagtgacaacgtccctctaattagggacatcctggaactctccagctcattggccagacagactggtctcatttccatagaccaggaaaaggcttttgaccgggttgaacaccagtacctgtggcagaccctagctgctttcgggttcaaccctggcttcgtagccatggtccgagcgctctatagtgacatcgcgagtgtcctaaagatcaacggggggctaagcgcccccattgaggtccagagaggagtgaggcagggctgctctctctctgggatgttgtacacgatagccatcgagcctctgctccacaaactaagacaaagactggccggcgtctgctttccccagtgccccgtgtcttttaaactgtccgtctacgctgatgatcttattgttttaaccaactcgcaacaggacattgatgttttaacgaacactgttaatgattttggttttatctcatcagcgaaagccaactggggaaagagcgaggctctgatggctggaggggggctgggagaaggcctcacactgcccgggggtctccagtggaggtcaggaggattacgttatcttggagtcttcctaggggaggagtccttcatgagaagaaactgggaagattccctcgaaaagaccagagggaaactagaaaagtggaagtggctcctcccaaagatgtccttcagggggaggaccctaatcatcaacaacatcgtatcctcctccctgtggcacaaactaacagttgttgaacctccggcccccctcctgagccagattcaaagagttttagttgattttatttgggacaagttacattggatcccacagagtgtcctcttcctgcccaaggaggaaggagggcagggcttagtccacctggccagtaggagggctgcttttcgcctacagttcgcgcagcgcctcctaactgggccaaaggacactctgtggagaccgttgtcccgctgcgttttaaagcgttttaacagccttggtcaggattttagtttgtttttaatgaacacatcagaaataagtgcatctcctctgccttgtttttatcagagtgtttttaaggtntggggcatgctcttaaagaaaaggcaggagcgggcgggctcagcgtactggctccagccggagccagtcctatgggggaccaagctggacattcccaaccagatgaaggagaccatcaccaggaggatgaggaccacgaggatcgccaacctgggccaggtggtggcgctaacaggaccccggatgggcgacccttctggactcgctgcccggcttggtctgacatccgtgagggttattaaaaaactgctggaccactggagaagcaaactttcaccccacgaccgcctgctcctgacctcacccacaagaacggtgggcgagggagagcttttccccgccatcgccctcgcaccggattttaaagactgcaacggacccttgctaaaaaacacacgttttataccgctgcaggagaccaccggaaaaaccttttatagaatgatggtaaaaaccctgaacaagcaaagactgaaccagagagctgacacgccgtggagaggacacctgcacctggccccggactgcaggcctcagtggagggcgctgtacaagcctccactccctaagagacacgccgacctccactggagggtcctccacggcatcttccccgtcaactcctttgtgtcaaccatcaaccaaacggtggaagacaaatgcccattttgtgaccaaagagagacaattttccactgtttttatgaatgtcagcgccttttaccattgttttcattcctgcgaaacgtgtttcttaaatgtgaggagttttttatgaagcagtcttttatccttggttttaagtatacgcgccatcagaaggacaagtgccagctttcaaactttgttttagggcaggcaaagatggcagtctacctgagccggagaagaaagatggaggaaggttttagtgttgaacccgtggtcatctgtgttaacatgatcaagtccagactcctcatcgattttaacttccagaaggcagccggagatctggactcttttatccaggtgtggggttttaacaacgtcctctgtcaagtggtgaacaactctctgcagtttggagatgtactcagatgaattattgatttatttattctttttattttcttttttattcatttatttattagcccaaagtaagaaatgaaatatatatgttcctttgtgaaaggaaaataaagatgtgttcaaaatctaaaaa

SEQ ID NO: 9 - DNA, 5688 bp, Takifugu rubripes
tctctctctctctctgagcgggagggtggtgagtgtgtcggctctgggagtgagagacagatttcagcgtttttctaaacttttcctctatttgaatctttattgtttaatcacattggggagcactgttctgaattttcgaccgtgtattcactgcttttggtgaaattgtttggtggccacggtcgccgtgccggtcatggcagcggcgccaggaacctccgagctcgagaaacttacccgcagacacggcgttaaactctccccaccggacggtgtgtccgtggaggagtgcgtgctggctatgggggacattgtggggcacacaagcgttaagtccgcgtctaggatgaataaaatggtggtggtgtttgtggggagcacagacaaagccgatcagctggtggcggctggggtggcaattaagggtgaacacacaccggtgttccccctgtcgaacccggcgaaatcggtggtggtgtccaacgttcctccgttcattaagaacgaaatgttgttgagggagctcagcagacacgggcgcattgtgtccccgatgaggttctttgctctcggggccaaatccctgctgctgaggcacgtggtgtcctttagatggcatgtagtgatggttctcaataataacgagaaactggatggttttgattatactgtttatgtcaccaccaaatcccaaaaatgctttggttgtggggaggagggccatctggtccggtcgtgcccgaatggcgtggaggcccgccggccagccgacccgcctgtcagcgcagcgcgcgcacgacgaggacagagaggccgcacaaactacacggggcgacatgggcccaaccgcggaggtggaggagccagcaggtccacagggggaccacccgggagaccaccgggacctgcagaatgaacgtctcaccggagagatggtggagcggacggttccaagaaggaggatgtcggagtggaggagagcagcctcagtgtgcccacgaaaaggaagagcaaggacacaaaggtcaacgacaaagtaaagaaactgtccacagcagaacctcatacacacagctcaccgcacacacgtatcccacaggacacacacagcccacagaatgcacatagctcacaggacacgcacagcttagacgacacacgtaccccacaggacacacaaagcccacaggacacacgtaccccacaggacacacacagcccagaggacacacacagctcacaggtcacacacagcttatacgacacacacagcctacaagacacacgtaccccacaggacacacacagcctacaagacacacacagctcacaggacatgcatggcaccccgatggacacacaaagtacacaaagctctttggtgggcacacaagaggcttcgggtcatagtgatgatgtaaaggtggaggtacgccctggttaccacttggagaggatcaagtttttcctcaggatcacaaaggggcaaaggtgtgtacaggtggagaacccctttccagaccttcagctcttccaggataccgttaagcagcttatgagaatggagagtgacgacgggccctccttcaccaaccggaagacgtaccgcctcaagaaaatgttggtcaagattcggtcaggaatacatgtaataaaggttcactctcacactcactgactgactggtctttaaaactaatccaagagactcacagcgacgggaacaatgagggggactggaggagggagtggccaggccaggtctttctcagccacaaactgtgctggggtgggaatcctgttctccccacactttaagactctgtctgcggaaacgcaccacatcatggatggacacgtcttgatggtaaaagctgtttatgaaaacatgaaactggtcttcctgtgtgtttatgctcctgtgttgagcagagacagaatgaactgtttaaatgtcctgtgtaatgttgtcagaggtgtccaggatgagttcctattcatggggggcgattttaactgcacagtcaatgcaagactggacaggaatcacctggaaccccatcctgcttcatctgcccgtctgaagagacttttagagacttatgacctgaaggacgtatggagaggtttcaacaacgccaccagacagtacacctgggcccactgttgggacaacagcatgtctttggccagactagatcggttgtactgtttcaaacatcatcttagcatctttaagaactgtcacatcgtccccgtaggtgtgtcagaccactctctgttaaaatgtgagtttttcattcaaaatgtcaaaacttccagtgcctactggcactttaacaccgctctgttagaggatcatgcctttagacaggctttgcaggtgttatgggatgcacacagactcaggaaacccatgttttcgtcactgcacaggtggtgggattttggaaaaactgtaactcaacaattttgtcaacagtatactcgcaacgtcaccaagcacatcaccagatccctccaggacctggagactgaggtacagaacctgctgggctgtacagaaaacagaggatatgttgaagtccatccatccatccatccatccattctctaccgcttatccgggggggaagtcctccaaagcaaaaacgccgccatagccagcctgttgggcactacagcgcagggggcgctggtgtgctctcgctacatgaacgcctccatgatggatgccccgtccaagttctttttcagtttagaacagaagaatggccagaggaaggttatccactgcctgcgtgccgacgacagctccgacatcaccgacactgctaggatcagaagacacggcacttgcttctataaggaactttttaaaagttacgcggtggagaatccagggctggagacagagttcttgactgacctttctcaggtgggggagtcctcaaacactcttctgtcagcggacttgacccttgaagagctttatgtggccctcatgagcctggcaaacggaaaagctccaggcatcgacggcatcccagtggagttttacaaagccttttggtcggtggtgggaaaagacatgctcgaggtattcctggagagctggaggactggactgctgccacggagctgcaggagagcaatcatcaccctgctcccaaagaaaggagacctacaggatctaaagaattggaggccggtcttcttgctttgtggagactacaagatcctctccaaggcactagctatccgactcagggaggcaatggcagaggtgattcatgtagaccagacctactgtgtgcctggcaggcgaatctgtaataatatcaatttgattcggcatgttttggacatctctagctctttgggcattgacattggtcttatttcctttgaccgggaaaaggcctttgatcgggttgaacaccagtacctgtggaacacgctcgccgtgtttgggttcagcccaggatttattgccagggttcaggtcatgtaccgtgatgttgcgagcatactaaaaattaatggtggtctggctgctcccttcactgtccagagaggggtgcggcaggggtgttctctctctggaatgctctactctcctgccattgaaccgctgttgcacaaaataaggaaaactctgatgggggtgagtttcccaggttgcccaacagcagtgaaattaatggcatatgcggacgatgtggtggtgattgtaaacacgcagagagacattcaggttttgggggaaacaattgagctttttaaagctctttcctcagcaaaagtaaattggacaaaaagtgtggcatgtgcaaccacgagggactttctgggtggctggtggtgctgggtccagacgggagggttgaagtaccttggggttttcttggggaatgatgagtccttaaagaaaaactgggaaggggtgctggaagccgttgagggtcgtctaaaaagatggaaatggctactgccccacatgtcatatagaggcaggacattagtaataaacaatttggtgtcctccttcctatggcacaggctcgccgtagtagaccccccagcagacctactctcccgggtccagactgtcatagtagactttttatgggacagactccactggctcccacaggtggtgctattccttcccaaggaggaagggggacaggggctggtgcacttggccagcaagagagcggttttcaggctccaattcattcaaaggctgttgtatggtcccaatgacctggtctggaggccattggctcggctgaccctgcagagaatcaaaggcttaggattacaggagtctgcgttcttaatggagcttaagaacgtgagtatgtcttcccttccatccttttaccaaggtcttttcagaacatggaagctgctgtggaaacagagagccaatcatcaatcctcgttttggggggaaacagtgagccatggaagcctcctgagtcccccctcctgggctggagcaacagttgcagaggctctgtgcactgctggagttgccactctgggagccctgcgagaggcgactggacctgacctgaaggagacaacggagctgcaggtgcgtctgggctggagatcaaagaggaatgtgaaaagactactgagccactggagagactgtctgacagagcgagagaggcaactgctgagggagcatagccagaggatgacctctccctgtcccgagcatcctttcccttccctcgtcatgcgaccaggaccggatcaacagttggaagtgacgttggaaacggctgaaagcaaagctctgagtagactgatggtgaggggactgaacaggcagaggctggagcgccggtcccgatcaccctggagggccaaactaaccctgggggaagaggttcggcctgaatggaagagcttctacaaaccccctctctccaagaaggcggctgacctccagtggagacttgtttatggggttttagctgtcaacaagtttgtttcgattttgagcctttctgttacaggcacctgcccgttctgtgaagcagtggagactattgtacattgcttcgcagaatgtcctcgtctgctccctttatttcccttgctggaagctttgtttaggagggcaggtgaggccttctcactaaggacgtttgtttacggcttcaagtacacaaaggcgaaaaaagacaagtgccacctgatgaacttcattctaggccagtctaaaatggccgtgtacataagcaggaggaggaaggtcgaggacagtgtagactgcgacgtggttctgctactgagtagaagaatcaaggccagaatcctcattgactttcacttttacagaaaaatggaagatttagagcagtttgtaaggacatggacctacgggggtatcctgtgctccattcagttagaagaccttgtcttttcagaccaactggtctaaatttgttctccatctactcgtttatctagtgtcagttttcgagttcctttgtcctgtgacttactgctaatgtagaacaaagagcacattgtggaggaggagctggtctttggttcctcctcaactgaatgtctgttttttgtttgttttagatcatgttctttttgaaatggcaattaaattgagttttaaaaaatcaaatctctctctctctctct

SEQ ID NO: 10 - DNA, 5778 bp, Tetraodon nigroviridis
cgtgtgggaggagtgtgagtggaagagcagagtggagagtgaaagtctttggcttgttttctcctttttattacacttttttcgcggtgaattgtttcagtkttttgtgtttcacttggtgatatttggggttagtttgtgtttgttttttgtgtgttctggtggtgggagcgctgttcgggagccgtaatkgcaaccaacagcctcaccaastgtcgcgaaagcacggcgtcaaggtgggcgccggctccccctgcagcgtggaggaggtagcgctggcggtgggggagataatcgggcacagctctgtcaattctgctgcccgcatgaacaaggcggtggtgctgttcctggagaaggtggaacaggtgaacaagctggtggaaatgggaatcactgttaacgggctgtttgagccggtgctgccgctgacgcagccggcaacgaggatcaccctctcgaacgtgcctccgttcatcagtgacgagttcctcgttaatgagctgtcccgtcatggaaaagtagtctctcccatgaagaaaatcctgtccgggtgtaaatcaccgttgctgaagcacgtcgtgtcacaccggcggcaggttttcatgatcctgaacaacagatccgaggagttcgactaccgattcatggtgaaggtggacggctatgattaccagctgttcgccacctcctcgctgctgaaatgttttggctgtggggaggaagggcacattgtcagggcctgtccgaatcgggccggctcggccggggcggcgcgccccggcgggtccgccgccggcagatacgggaaaagcggcgcccgcbgccgccgccgagaggcccgttcctgcggcgcgccggcggaccgtcggccccgcacagcggagggagctgcggcagagcagcagggggagcacggggatcacacggaggtgaccagcggtggaggtgtggaagacatggtagttgagggagccggtgaggtaggtgaggtggtggacaacactggtgagamggtgggtgagacaggtgaggtgcagggtgagacaggtaagabggtgggtgagacaggtgaggtgcagggtgagacaggtgaggtgcggggggggacagatgacaaggtggaggtggccggtgagagggtgggtggtaggmgtcactcgggtgcwccggggggtttagtgggtgaactaagtgctgcaggtgaaacaatcgacctgataggtgaggtggtggagatcaggagtgagacgggtggcaggagtgagatggaracgggtgaggcagcaggcacacagagtgagagtgctgccaccgcatgtgccagtgtcgtggaccccagggtgttagagagtgtgtttgtgttttcgtcggcgtctgctcctgcaaagcagcgcgccaagccaagaacgtgctgtcaggagtggtggaggggcgtaaggccgggcggctggaaggcccggcagccatcgctgctgtcagcgacagcgaggcagaggcagacatgtcagactgcagcgacatgtccaacgtcaccactgccagtcaggaaaataaatattatccagaaaatatgatcaaaatgttcctgcagcaaactaaaggcctcaaaggcctgaacatagaaaaatattttccggacaagctcctttttttaaactcggccaagcacattgtgaaaaacaaaatcacgaccgagctcacaaaccaagaggtttttagactaaaaaaacatatggtaaaagtgaggaaggagcttgatttttaaaacaaaatgatggatacattgattttagttctttttttcatcgccagtgattttaacctctcccacaacatggagtcttttagagtggggacgttaaacgtcaacggcgccagggtggcagaaaagagggctctggtgtttgacacagcacggaggaaacgagtagaggtactgtttttacaagaaacgtacagcgatgagcacaaccaggcagactgggccaaggagtgggagggacaggtggtcctgagccacctgagcacggccagtggcggggtggggctgctgtttttaaggtcttttactcccacctcagtggaagtggagcacgttgtaaaagggagatgtcttttagtcacagcatgttttaatgagcgcaccgttgtttttatcaatgtgtacgctccaacaaacggcacagagaggaagagctttttagagaaggtcagcgccaggctgaaccgctgtggcccggaggattttttaatcatgggcggggattttaactgtacagaatgtgagtttgtagaccgcaaccacgcagagcctcatccaggatcccaacacgctctgaagcagctggtccactcccacggcctcgtggatgcgtggaggaggatgcacgcagactgccgtcagtacacgtggtcccgcctaggtgaggacaggatttccatggccaggcttgaccgtttttatgttttcaagcaccattttaatgctcttaaaagctgtagcatcacgccagccggttttactgatcattctttggttttatgtcatgtttttattaagaatgttttaccgaagagcgcgtactggcattttaattctgtcttaactagcgacaaaggttttagggaagcacttatttatttttggactgcttttagacgcagaaaaagtgattttacgtgtctaaggcagtggtgggaccacggcaagacagaaatcaggctcctgtgtcagcagtacacgctcaacgtcacacgcgacgcctgcagatctatcagagagctggagagcgagatcgtggacttggaaatattaagtgcgttcacagaaaatcgagggcacattgaagccctcaagtcaaaaaaaatggccttgaaagacctgctgggcaccaaagtgcaaggtgcactggtccggtcgcgggtccagaacatcgcggagatggatgccccttctagcttcttcttcggcctggaaaagcgacacggtcagaggaaggccatccactgcctgctgtctgacacggggcaggaactgacggaacctggccagctccggaagcgggccacggagttctactccgccctgtactcaagcgagtacagggagagggaggacctgttcgaggagttctgtggtgggctgcctcaagtctccgaggcaacaaacgttcgactggatgggccgctctcggtgtcggagctgcacgccgctctgcagagaatgcagggacggcgggctcccggcatcaacggcctcacagttgaattttacaaagcctattgggacattgtggcgcccgacctcctggaggtctttaatgagagcttgagttcaggttccctgccagtgtcctgccgcagggccgtcatggccctcctgcctaagaaaggcaacctgcaggacatcaggaactggcgccccgtgtcgctcctctgtaccgactataagatcttgtccaaggtgttggctaccaggctgagggaggcgatggaggaggtcatccaccgcgaccagacctactgcgtgcctggcaggtctattgtggacaacgtccacctcattcgagacgttttgaaaacctccagccttttggggcttaacactggtctgatttctctagatcaggaaaaggcatttgaccgtgttgagcaccgcttcctgtggaaaaccatggagaggtttgggttccgcacgagcttcattgccaagatccaggcgttgtacggaggcattgagtctgtactcaagctttcctttaacggcagtctgtgtgctcccttcagggcgtgcagaggtgtccggcagggctgcgccctgtcgggcatgctctatgcgctctcccttgaacccctcctctgcaaaatacgctcgagcatcgctggctttgttttaccgggttttaataagaacatcgttttatccgcctacgccgacgacgtcgtcattttaacacaaaaccagagcgacgtagacgttttatctagactaacagactcttttaacgttctgtcttcagcaagggtaaactggagaaaaagcgaggccctcgccgtcggcgagtggcgagacggtctcccagttttaccccagagtctgtgctggaaaagagacggttttaagtacctgggagtcttcctgggagatgaagacacagaaaaaaagaactgggaagacatcccaggaaaggtagaaggaaaactgaacaaatggagatggcttaagtcccagatgtcctacagaggtcgcgtcctggtggtcaacaacctcgtggcgtcgatgctgtggcatcgattagcgtgcctacagccgccaccagggctgctagaccaaattcaaaagaaaatagtggactttttctgggacaagaagcactgggttccccagggggttttattcctgccgagagaggagggggggcagggcctcatccacgtggccagcagaaccgcaaccttcaggttgcagtttgtccaaaggtttctgacaggtccagcggatctggtgtggagagaaacggccagctgcttgttcagacgtgtgagtaacctgggactggatgcggctctgtttttaattgattctaaatctctaaaggtaaatgggctacctcctttttatcaaagtgttcttaagtcgtgggctctttttaaaaacactctccaaaaaagctctaactctctgttttggcttttaaaccaaccgctcctgtacaacgccagaatggacatctcccgcgaggccacgccgggtctgaaggcggccttgcttcgctccaggacactggtttttaaacaggtcgtcgacgcagctgggccggcgctgacggatgccggggcgctgaggtcgcggctgggagtcaggaccaccgcaacggcagaccgagccctcaccctgtggaggaagagactcacgggcacagaggtactcctcctggccatgtacagcggagggatggaaccgaacccggaggaccccttcccggacctgtacctgaccccgcggctcggcgacacctcgggcccgctgctggagaaggcccgagaactgaaccttcacacaggtgacaagaaagccatctacctaaactgtgtgagagcaacccacagggcgagactgaaccacagaccgccgaccgtgtggagcagcaggctgggtggagacgggggcgctccgtgctggagagtcctctacaagccccccatccagaaaagaacggccgatctccaatggagacttttacacggtgccatcgcgtgcaacgccgtcgtgagtgcttttagcagtgctgtgtcaaacacctgcccattctgtggccaccctgagaccctgtttcatttttttagtgagtgtgagagactcacgggtttcttcactcttttagcacaggtttttaatttatttaacgttgggttttgtgagaggacttttatttacggagcaggctacaaaaaaaccagccagaagaaatggcagctcctcaactttgtgtgtggcgcagccaagctggccatctacgtaaccaggagaaacaaagttgaggggcgtgcaggtcaggatgcagcctcagtctggcgctgcagcgtcaggtgcagactgaggctggagtttgggttttataaaatgacagatgaccagcaaacttttatagacacatggtgctttggccagattttatgctctgttgacaacaacattctacacctctcgaagattttaaactactaatttatttgtatttgtgaataaagtgtgtttgtaaaaatcaaaaaaaa

SEQ ID NO: 11 - DNA, 5336 bp, Danio rerio
agcacagattttttttttgagagaaaatgatggactcacaaagcaacagcacagatttgtttgatgaagcacatggggaaaacatcacaggaaggagtggagaaagacaaaaagaaaacagcactggattacgaggggaaagacaattggaaaacaacactggacaggaaggagaaagaaacatggtaaacaaagaacgacaagaaaaccaacaacaggagatgcaacaacaaagaagtggaaaaaagtacatgaaggaagcaacagtgattctaaatgtggacaaagttaaagaggtgagagttttggaaataattaatgcagtaactgaaaagtgtggacttgggaaaattcttgcgataaggccgagacaggacaaagattatgaactaactttagaaaatgaagaaacatgcgataaactgatggatggactaataataaaaggagaaacctgtgaagtgaaaatgctacaaaatagagactacgtggtttccttcatgcatttgcccgcttacctggatgatcaattaatattagataaattagaaggctggggagtatttcccataacaaaaattaaaagaagggtatatccgggcacagaaatagaagatggaactcgatatctcaaagtgagattccccagagaagtgatatctctcccttacagcacaagactggaaacggcagaaggtcagcaatattttagggtgatgcacagccaccaggttaagacttgtaggctgtgcatgagccctgaccatatggtcaaagattgcccagactttaaatgccataaatgtgaggaaaggggacattttgccagagactgcgatgctattaagtgcccggactgccagaactatttaagtaagtgtgaatgttggatggaggaagaggaggaggaggatgagatccaggtgagtgggcaaatgcatgaaggaaacagtgaaaaggaaagtaatgaagaggaacaaacaacgacacaaacaatacaaactacaacagaggaaataacattgaaggaggagaatgcaaaaaaagaaaaggaaaaagaaacagaaacagacagtcaacaaatagagcatgaagaggaggtagcatggacaccaatggacataacttctagcttcaaaaacgttttggatgtaattgaaaaagaggatcttaaagaacaaagcaagggaacagacagagagactggaaaacatgaggaggaagtagaaaaagacaaacttgagaaaagacaaacaagacgatcggcaaaagttttatcaaaattagaaactgcaagaaaaaagggtttgaaaaaaggacaactgaaaagccacaacagatatgattctttgagaggtttgggagaagaagaggactaagatgacggtttttatttcctttttccttcttttaatggttttaaattgcgtgtcttttaatgcaagaggtttaatggacttaagaaaatttaagaatgtaaaggaaaaatgtaaaagagaagaaataattattttacaagaaacaaattggaaaaatgaggtgatggacatatataaaaaagaatgggatggggacttttattatagtaatggagatacgaaagctgggagaggagtagcaattttaataaagaagaatgcactgcaaatgagtaaagtaatatataaagacaaacaaggaaaatgtatgatattagaaataaaatatgaagggaaagatattattttagttaatgtgcatgcaccaaatgaagagagtgaaaagaaaagcttttttaacatattaagaaggtttttaaaaaactataaacaaataatagtatgtggggattttaacactgtttttagcagacaggacataacagaaggtatggtttttaaatcagacacgggaaggaaagaactaaaatcactaatagaggaaaaaggaatgatagacatttggagagaaagaaatgggaagaaaaaggagttttctagaagacaaatagtagggaattttgtaaaccaatcgagaatagactatgtgttatgcacaagaaatatagaaatttatattgaaaaaataaggtacgatgaaactgttttaagtgaccataaatttgtattttttaattttaatacagaagaaatacaaagaggcccaggggtatggacattaaatagtgaaattttaaaaaacgaagactatgttaaaaaagtaaaagaaataatagaaaaagaaaaaggaaaccagatctataatgaagacaaaagactatggtgggaaaatgtcaaatttctgattaaaaaatctacattaacattctgtagaataatacaaaagaataaaagacacaaagaaaagacaatcaaagaaaacttagaaatagaactagacaaaaatgaaaaagacattcaaaaaataaaagaaatggagggaaaactgaaagaaatagaagaaaagaaatatgaaggagctagactaagaagcaaagcaaaatatgtagtagagggagaaaaatgcacaaagttcttctttgatttagaaagacaaaaagcaaaagcagaaacaataaagataatacaaggggcaaaaggagaaagcatagaaggaaatgaagaaattttaaaagaaatcaaaaaatactatgaggagttatttaaaacacagggagttgatgaagtacaaatgtcaaaattattaaaacagataaaaacaaaaatagatgaagaggataaaaaagaatgcgaccaagaaataggggaagaagaaataagaaaagcaatagaaagcttgaacaaaaagaaaagtccaggaatcgatggtttaaatagtgaattttatgtatgttttaaagaaattttaattccgattttaactgacgtttttaaagaaatactgcaaaaagaagaactaaatgaaagaatgggaatgggattaatgaaattaatacacaaaaaaggagaaaagacattgttaaaaaattacagaccaatcacaatgttaaacacagatttaaagattttaacaaaaattttagcaaatagattaaaagaagtgatgccaaaaataattaaaacaacacaggcctatgcgataaaaggaagagacatagcagacataacaatgagcataaaagacatcatagaatatatgaaggagaaaaaagaggaaggatatataataagtctggattttgaaaaagcttttgatagagttgaacaccagtttttattcaaagtactcaaaaagtttggttttggagaagtttttagaaaatggataaagattttgtataagggtattttaacaaaaattaaatgtaatggctttttaacagaatgttttaaaataacaagatcgataaggcaaggatgtcctctgtcagcacttttatattcacttgtggcagaacccctgggcttagctatcaacgaagaagaaaaaataaaaggaattgagattgaagaaaataaagtaaataaaaaaatgtttcaatatgcagatgacaccacattaatagtaaaaggaaaagagagtgtgaaagaagccatgaaaatagtacaacaattttgtaaaggatcagggagtaaagtaaatgaagacaaaacggtttatatgaagtttggaaaggaaacagatttagcagaatgcaccaatttcaaagaagtagaagaaatcaagattttaggggttttaatggggaaagatgccagaaaagcgagagataagatgtgggaaggttttttaacagatatagaaaggaggttaaattactggaaactaagaacactaacattaaaaggaaaagttttgattttaaatgttttaatggagtctaaattgtggcatgttttatatgttttagaaatgccaatgtggatagaaaagaggttgaaaaaatgttttacagattttttatggggaggtaagccaccaaggattgcttttaatacagtcgtaggggaaatagacaaaggtggtctgggtttaatagatgtagaacaaagaaaaaatagtttaagagtgaaaagagtaaagaagtatctagaaaaagaaaacaaagcagagtggaaaaaaacaatgaaatattttttaaacaaatgtggtaattttaacatgggagatgggattttatggatgaaaacaaaagcttggatgacagaaaacttacctgaattttatagagaaattttaggtgcgtgggggaattttttaaaacaagtggaatatagtccacatggaagggaaaacattttaaaccaacctcttttcttgaacaataacattttaagtcaagggaaggttttatactataagaaatggatagaagttgggattttaaaagtgcgggacattttatatgaatttaaagaaggctttttaactgaacaatatgttatagacacaatggaggaggcgaaagaggaatacaacagaaaggaaattgagaaaaatcttgacataattaaacaggcaattccaaaagaatggataagaagcatagaaaaatttgaaaaagaaaaagaaacaaaagaagtgtatgtgaaaacaggtgaaaaaatatgcaattttaatgaatgtactgtgaaaaatatttattgtttttttagagagaatgtttttaaagaaccaacagcaaacaaatactggatagagaaatacaaaaatgtaaaagcaaatgaaatatggggaaacatgaaaggaaggtatgtggaaacaaaagtcgaatgtctagaatttttaataaggcacaaagcaatcttttctgatgtcattttaaacaagataggaatggaacaaagtggaatgtgtaaagtatgtcaaaaagaagaagagggttttttacacatgtttttatattgtcaaaaattggaaggttttttaaaagattgtaaagttttaattaaaggactacttggagactgggatgaaaatgaaacagaatggaacagagtagtgatgttgggatggaataagaacaatgaaaataagaaaatagtaaacctatgtataatgctgatgaaaaatgcaatgtgggaaaggagaattgtggcaaaaaaagagaaaatggtgatggatgtatggggaatttttaagaggaaaatggagagatatgtggaaaaactgtatgtatatcataaaaatgagaacattttgagtgagctgcacaaaattctgacggacaaagcatgtcaagtttttaaagaaatgaactggaaactaccacatttttaatgtttttgaatatgaaatgatcttttaatgtctgttttattatgatttactgtaaaagattgtaattgaaattggttcaataaaaaaaaaaaaaaaaaaaaaaaaaaaaaaaaaaa

SEQ ID NO: 12 - DNA, 5194 bp, Danio rerio
aggccaagtaggtggaagaaagtatttaaaggaggcaacagttatcattaatgtggaagatgtacaggaagtgagagcagaagatattattaaagcggtgattgaaaagtgtggacatggaaaaattctggctttaagaccaagacaagggaaggagtacgaactaacaatggaaacagaagaattatgtgaacaattgactgacaaactgatgataaatggggtgaactgtgaaattaaaaagcttcataatagggattttgttgtttccttcatgcacctgccggtctatcttgaagataaggaaattctggaaaaattagatacttggggagtttgtcccatatctaaaattaaacgaaggttttatccgggtaccgacatagaagacggaacaaggttccttaaagtgaggttccctaaagaggtggcatccttgccatacagcacaaaaatagagacagcagaaggaacgcagtacttcagggtgatgcacagccatcaggtgaagacctgtaggctgtgcatgagcccggaacacatgctgaaagactgtccagaattcaagtgctacaaatgtgaggaaagggggcattttgcaagagactgtatcactgtcaggtgcccggaatgtaaaaattttttaaacaagtgtgaatgctggatggaaggagaggaaggaggaggagaagatcaggaccggcaggtgcatgaagaaaacaacaaaagggaagaagataatgaagcaatagaaaggacaatggaggaggaaatgaataacaatgaaaaaaaggaaggagaaaacgaaaatgaagagaatgaagtacagttatcaggacaagatggacagtggtcacaaatggaaatatcagacagttttaaaacttttttaagcacggtggaaaaagaggaactaagaaagactggtcaagctgaaggaatggcaaatgatgaagaaacaaggatggaaaatgtggataagaacaaagtggaaagaggatttttaagaagaagaacttttaaggtaaaaccaaacttggacatggcaaagaaaaaagttttaacaaagaacagagctaaatatgtaaataggtatgaagtgttaaggggactggaagaagatgaagaaaaatgatgtttttaaaatattttatctattttaaaatgcttttaatctttgtctcttttaacggaaggagttgttggttgagagcgttggaaggagatgaaggacaatgaggatgtgtaggtttttaatttcatttttatttattttaatggttttaaactgtgtgtcttttaatgcaaggggactgatgggaaaagataaatttgagaaaataagagagaaatgtaaaaacaaggaagtgataggtttacaggaaacaaactggaaagaacatgcaatgaatgattttaaaaagttgtggcaaggggatataatatataataatggtgatggtaaatctggaagaggtgttgcttttttaataaggaaagatgttttaaactttaaaagaattgtgtatagggataattatggaaaatgtttagtaatagaggtgaactatgaaggacatgaattaataatagcaaatatacatgcaccaacagaagataaagacaaaaaagaatattttgaggttttaaataaagtattaaaaggttttaaagaaataataatgatgggagattttaatactgtttttagaaaacaagatatggctgatggaatggtttttaaatcggatataggaagaaagcaactaaatgagttaataaaggaaaatagtttaatagatatatggagggaaaggaatagagaaaaaagagagttttcaaggagacaaatagtggggaattttatatgtcaaacgagaatagattttattttatgtactagaaatattgaaaattttatagaaaacatacagtatgaagagaacagttttagtgatcataagctcttgcattttaaagtgaatatagaaaacatacaaaaaggaccagggacttggattttaaacacaaccattttaaaaaatcaagattatgttcaaaaagtcaaagaaataatagagaatgaaaaagaaaatagaatgtatgatgaagataaaaggatatggtgggaaaacacaaaatatcaaatcaggaaatacacaatcaaatattgcgcagtactacaaagatgtaaaaagtatacagaaaaagaagttaaaagatccttagaaaaagaattaaacaaggaaaataaagatattgaaaaaatcaaagaaatagagcaaaaattacgagatttagaagaagacaaatataagggggcaatgttgaggagcagatctaaatacacagtagaaggggaaaaatgcacgaaattcttttttgatttagagaagcaaagaggtaaagcaggaatactaaaggaaattaaagggaggaatggaaaaattgcgaaaggaaacatagaaatactagaagaaatcaagcatttttatgaagatctatttaaagcaaaaggtattgatgaagaaaaagaaaggaagattctaaattatataaaagtaaaactagaaaaacatgacaacaaagaatgtgacagagaaatagaagaagaagagattgaaattgcaataaatcaactaaataaaaagaaaagtccaggtatagatggaataggaaatgaattttatattgtttttaaagatattttaaaaggaatacttaaagaagtttttaaagacatttttaaatgtaaagagatgaatgaaagaatggggatgggattaatgaagttaatatataaaagaaaaggagcaaaaactgaattacaaaattatagaccaataacaatgttgaatacagatttaaagattttagcaaaagttttagcgaatagattaaaggaagtaatgtctaaattaattaaatcaaaccaagcatatgcaataaaagggagagatatagcagatgtaacaatgagtattaaaagcacaatagattatttgcaagaaaagaagatgaatggttttttaattagtgtagattttgaaaaggcttttgacagagtagaacatacttatttatttgatgtactcaaaacatttggatttggagagaattttattaattggattaaaattttatataaaggggcttttacaaaagtaaaatgtaatggttttttaacagattgttttaaaattacaagatcaattagacaaggatgtcctctttcagcactattatattccctaatcgcagaaccattagggttagcaataaaacaagaaactaaaattaaaggaataaaaatagaagaagaggaggatgaaggaaaaatataccagtatgctgatgatacaacaataatagtgaaggagaaaaagagtgtaaaagaagccatgaaaaaagtacaggagttttgtaagggaacaggaagcaaaataaatgaaaataaaacacaatatatgaggtttggtaaagcagatattttaacagattgtttccaatttagagaagtagaagaactgaaaattttaggaattttaattggtaaaaatgaaagaaaagcaacagaaaagatgtgggatgatctaataagaggaatagaatcaagattaaatttctggaggatgagagaactttgcttaaaggggaaagccttaatattaaatgttttaatgacatcaaagctatggtataaattatatgtaacagaaatgccatgttggatagaagcgagattgaaaaagtgtgttcaagattttttatgggaggggaaacccccaagaattgcgtacaatacaataataggagcaacagaagaaggagggataggattgatggatattaaacaaaggaagaattgtcttagagtgaaaatagttaaaaagcttttacaagaggagaactcaacagaatggaaaaaggttatgaaatattttttaaacaaagttggcaattttaacttaggagaagacattctttggttaaaaactaaaaactggatgacggaaaagttaccagggttttatcaagaaattttaagtgcatgggggaaatttttagacggagtattttaccaagtaaagggaagagaaaacttattaaatcaacctttgtttttaaataaaagtattttaaaagaagggaaggaactattttttaaaaaatggatggatgtggggattttaagaataagggatgttctttatgaattcaaaaagggatttttaactaagcaatatatagtagacttaatggaagaagctaaagaggaatacagtgtaaaggaaatagaaaataaacttgaaacggtcaaaggtgccataccaaaagaatggattacaagaatagaaaatatggaagaatgtgggaatgaaaaagtcatacatgtctatttaaaaggaaagctttgtaattttaaagattgtttactgaaagacttttatgtttattttagagatagtgtatttcaagaaccaatagcaaataacttttgggtacaaagattgaatagtgtgaaaaaggaaaatatatggaaaaacatgagaggaaaaataatagaaacaagattggaatgttttgaatattttataagacacaaggcaatttttactgagtgcattttaacaaagatacatatagaacaaaatgcaacatgtaaggtttgttttcaagaagatgaaggaattttacacctgtttttatactgtaaagaattagaatgtttttacaagaaatgccaaaaaatgctaaaagatttattgaaagattgggatgaagaacaattggaatggaatactctggtgatgttcggatggaatatgcaaaacaaaaacaaaaagtttgtaaatcttcttataatgatgattaaaaaatgtgtgtgggaaagaagaaatgtagcaaaacaggaaaaagttgttttaaatgtgtgaaatgtactaaaacgaaaaatggaaagatacatagaaagactgtactgctattttaaaggagaagatatgttaccaagcttttatgatgtgtttaatgatgaagtgtataatgttttaaatggtttaaagtggaaaatgcccaaagaggatgttatgttatgaagaatgttgattttaatgtaattgttttgtgaaatttcttgaagtatttaaatgttaatgtaatgtgattaaattttaataaaaaataaaaaaaa

SEQ ID NO: 13 - DNA, 5746 bp, Danio rerio
caggtgctgtaagcttttcaaagtccttcatttggcagctgatagacttccccgtgtcacagcttcgctgccattatttttctcgccttcaagggcattgtttctgtcgatgctgtgtcgatgccagctgagctgcgtccttccctggtgctgcgcctgttttaaatagccaactcttgacagcctctttcgcttacggccacaccaccctgtgcatgtgtgatagtggtacattccaggaagtgtttggctgcagttggtgagagaggctcaccagattttctttgtttatttttgtttttgtcttaaatacatttttgttaaacttttttttgtttgtttagtttgtcctcccagcagcgtgagctgttcgggaggagtgttttttatttatttatttttttttgcaatggacggatctacggtgacagacctggcaatggcggacggagttgagaaggcaaatgacaatggactggacagacgacaacaagaaacaaaccaatcggagaaggaagcaaggaaaaggatttatctaaaagaagcaactgtaacagtggacataggacaagcaacagaggtgagagcaatagatgtaattaaagcagagacggagaggattggggatggaaagattttggccgtaagaccaaaacacaacaaggaatatgaagtaacacttgaaagagaggaagatgctgatgagttaatggacgaattgactattaaagggataaactgtgcagttaagaggctacaaaaccgtgattatgttgtctccttcatgcatctgcctgtctatgttgctgataaagatattttagacaaattggatcattggggagtttgtcccatttcaaaaattaaaagaaggttttatccgggcacaaatattgaagatgggacgaggtttgtgaaaaccagattccccaaagaactggcgtccctcccgtacagcacaagaatagagacagcagagggtccacaatactttagggtgatgcacagtcatcaggtgaaaacatgcaggctgtgcttgagcccagatcatgtggtaaaagactgtcctgattttaggtgctataagtgcgaggaaagggggcactttgcaaagttttgcactgctgtaaagtgcccggattgtaataaggttttgaataaatgtgaatgttggattggggaagaggaggaggaggtagagcagcaggtgggcaggcagatgtatgaaggagacaatatccagtcggaggacaaaacaacaacacaagaaaaaagtacagaatctgaaagtgaaaaactacaagagaatgagactaatggaatagacagagtcacggaacaggaagggacaacatggacacaaatggatatgactgacagtttaaagagtgttttggaagcagcagaattgagcgattcgaataataaagacttgaatcaaggacaacaggaagacacattttggacacaaatggacatcacagacagttttcaaaaggcattggacacagaggagacaaaaggccaaagtaatgacgagcaagccgatttagagggacatttacaaaaggatggaaacaaagagacacaggggaaatcagcaaaaagaagaagatcgttaaagataaacctaatttagagactgtaagaaaaaaactgctaaaagatgaagaaattgaatgcgcaaataagtatgagttgctaaagggcttggaagacatggactgagatgatgttttttatgaatgtttttatgtcttttatgaatgtttttatattttttatggttttaggaattgtgtcttttaatgcaagagggcttttagacatcaggaaatttgaaaaagtgaaagaaatgtgtaaacgagaagatgtgattttacttcaagagacaaactggagggaagaatgcatgaaggaaataagaaaaaggtggagtggggaaatgttatacaataatggggatgggaggctagggagaggagttgcaattttattaaaagaaaacagtggggttttatgtaaaacaatctataatgacaaagagggaaagtgtatgatatgtgaaatggagtatgtaaagaaaaaagtaattatggtgaatgttcacgccccaacagaggagaacaaaaagaaagagtattataatgtacttagagattatttaaagaaacacgaaagagttattatcatgggtgattttaacactgtttttagtaaattagaaatggctgagggaatggtttttaaaacggataaggggagaaaagaactaaaaatattgatggaggaaatgaatttaattgatgtgtggagagaaaggaatgaacagacaaaagagtactcaagaagacagatagtggggaatttttgttgtcaaacaagaattgattttattttatgcacaagaaatgttgaagggtttataaacaagattaaatatgaagaaacaagtctgagtgaccataagccactttttatgaagctagactggagtaatgtgaaaagagggccaggggtatgggttttaaacacagcggttttaaagaatgaagactatgttttaagtgtaaaggaaattattcaaaaggaaaaagggaatgaaatctataatgaggacaaaagaatgtggtgggagaatgtgaagtatttagttaaaaagtttacgataaaatattgtagacaattacaaaattgtaaaaaatataaggaaaaggagctgaaagaaaaactagaaaacgaattgaaaaatgagaatggaaaaaatatacaaaagattaaagaactgcaaggaagattaaatgaaatggaggaggagaaatttgaaggtgcaagattaagaagtaaagcaaaatttacagtagagggggaaaagtgcactaaatttttctttgatctagagaagagaagagggaagtcagaaatgattagagaaataaggagcaaaaatgggaacgtagtagaacaacatgaggagattttggaagaaataagatcatattatgagaaattgttttgcacagagggaataaaagaaaaagaaaaaggggaattactaaatctaataaaatcaagagtagaagaaggggaaaaaagagaatgtgacgaggagataagagaagaagaaataaaaagagcaattagtggattaaacaaaaagaaaagtccaggaatagatgggttgggaagtgaattttatattgtttttaaagatattttatctagtattttaaaggaagtatatgatgagatttttgagaatggtgagataaataaaagaatggggatgggcttaatgaaggtgatatacaaaggaaagggggataaagtagatttaaaaaactatagacctataacaatgcttaatactgatttgaagattttagccaaagttttggctaatagactaaaagaagtgatgccaagcataataaaaacaaaccaagcatatagtataaaaggacgagacattgcggatacaactatgagtattaaagacacaattagatatataaatgataagcagaaagatggttttttaattagtctggacttcgagaaagcttttgatagggtggagcatgactttttatttggagtgttaaagagttttggttttggggaaaattttataaagtgggttcagattttatatagaggagcggtaacaaggataaaatgcaatgggtttttaacagactgttttaagataagaaggtcaatcagacagggttgtccgttatctgcacttttatatgctttagttgcagaaccactgggattagctgtgaagcacgaggacagaataaaaggaatagaggtagaggggggagtgaataaaatatttcaatatgctgacgataccacattaatactacaagatctggcaagtgtaaagcaagcaatggaaacagtacagcatttttgcaaggggtcaggggctaaaataaatgaaaataaaacagggtatttgagatttgggagaactgaggctttatctggacattttacttttaaggaaatggatgaaataaaaattttaggcattgtaattgggagggatgaaaagaaagcagaagtaaccatgtgggaggaaattttaggagggattgaacggaggctgaggttttggaaattaatgtctttaactttgaaggggagggttttaattttgagtgttttaatggtttctaaattatggaatattttatatgtgtcatcaatgccactgtggatggaaaaaaggctgaaacaatgttttttagattttttatgggaagggaaacctccaagaatagcatatgcaacgttaattggagaagtaggcaaagggggtctaggtttaatagacgtggagcaaagaaaaaacagtttaagagtaaaaatggtaaggaaatatttggatgaagacaataaggcagcatggaaaagaacaatggaatattttttaagtaaaagtggcaattttaatatgggagataatattttatacatgaggatgaaaaaattcatgacagagggtctaccagatttttataaagaattgattggagcatggggaaaatttttaacttgtgtacattttaacatacaaggacgcgagaacattttaaatcagcctttattcttaaacagtggcattcttaatcaagagaaagtggtgttttttaggaaatggtgggaggtgggaataacaagagtaagggatgttttatatgaatttaaggaaggatttttaccagtacagtatgttattgacgtaatggatgaagcgaaggaggattttaacagacaagacttaataaaggaatacgacataatcaaaaatgccatacctgcagaatggttaacaagaatagaaaatatggaagaaaataaacaaagtaaagatgtgattgtaagatttggagagaaatggtggaacttgaaagatagtactgtgaaaatgatttatgggttttttagagatggggtttttaagaaaccgcgtgcaaatgagaactggatacggatgtttaaagatgtaaatgaagacaacatatgggctaatataaagggcaaattagtacagtcaaaagtggagaatttggaatatttgatcagaaataaagcagtttttacagatataattttaaacaaaatagggatggaggaaagtgtcacatgtaaagtatgtcaagatgcagatgaaggattcttacacctgtttttatattgtaatgagttgaaagattttaatgagaaatgcaaaagcattattttaactttgaaaggagaaagagatgacgaacttgagtgggaaaaggtgttgatgttgggagtgaacaaagaatgtaataatgaaaagctcataaatttactggtgatgttaaggaaaagtgcaatatgggagagaagagttgctgcaaaaaaggaaaaagctgtattagatgtgtggaatgtatttaagaggaaggtggagaaatatgttgaatgtctgttttattattttaagttggaggacatgcaggaggctttttatgatgtttttactcaagaagtttcaaagattttaaatgacacaggaatgaaaatgcctttttaaaaatgtgattataccctttaaggagttctacttgcaacattttatatttaaaatgttttattgtgaagatatgatgtaataaggacctttttaatgttttgtctgaagtgaaatatgtataaataagtgaattgtaaaaaaaaaaaaaaaaaaaaaaaaaaa

SEQ ID NO: 14 - DNA, 547 bp, Trilocha sp. GAS-2011
catccatggtcgggtcctggccttggccatcaatgccctaggggaccgactcttgaggctttatgactcttgtctcgagtcgggacggtttccctcgctgtggcgagagggtagactcgtccttctcaggaaggaggggcgcccggcggatacagccgccggttaccgtcctatcgtgctgctggacgaggtaggcaaattgctggaacgcattctggctgcccgcatcgtccagcacctggtcggggttggacccgatctgtcagcggagcagtacggcttcagagagggccgctcaacagtggacgcgatccttcgcgtgcgagccctctcaaacgaagccgtatcacagggcgaggtggccttggcggtgtcgctcgacatcgccaacgcattcaacaccttgccctggtccgtgatagggggggcactcgagagacatggagttcccccctacctccgccggctggtcggctcctacttggaggccaggtcggtagtgtgcactgggcacgatgggactgtgtaccggtttccggtcgtatgc

SEQ ID NO: 15 - DNA, 459 bp, Scopula ornata
catccaggcaaagtcctcgcccttgctctgatctcgcttggggcattcgtgctccgattgctcaacgcctgcttggaggcgcgtcaattccccgcctgctggaaggctgggaggctcgttcttcttcggaaggacggacggcctgcagaccagccttcagcctatcggcccatcgtgttgctcgacgaggcggggaagttgttcgaacgcatactggcggcccgcatcgccctgcatctgcggcgggacgggccggatcttgcggactgccagtatgggttcaggcacggtcgatcaaccattgacgcagtgctcaggctcaaagccatatcggaggagacgatagctgggggcggcgtagtgttggcggtatctcttgatatcgccaatgcattcaatacgctgcccttcagttgcattgagcaggccctgctgttccatcgggccccggagaagaag

SEQ ID NO: 16 - DNA, 547 bp, Perigonia ilus
agtacccggacgcgcttgggtgctggctttagacgtgttggggtgcaaaatgagaagtctatttgacagttgctttcaaactgccatatttcccaaagcttggaaagaagctaaagtggtccttattaaaaaagaaggcagagccgcagattctccctcagcgtatcgtccgatatgcttattggatgaggctggcaagctattcgagagaatagtcgccgctcgcctcaatgagcatctgtcgcgcactggtcctgacctagccgatagccagtatggcttccgtcaagggcgtagcactattgacgcgattcttcgcgttcgctccttggcggaacaggcggtgactcagggtaaagtggctttggcgataagcttagatatcgtcaatgcctttaactctttaccctggattgtgatcaaggaggcattggtataccattcaatgcccctctacttgcaggccatcattggatcatatttgcgcgacagatacatacattgtccgggccaaggcggtcgcttatatcgcagagaatgtattgtg

SEQ ID NO: 17 - DNA, 547 bp, Oxytenis modestia
aattcccgctcgtgcttggattattgccgtaccacttttgggagataggatacggagtctttttagtaactgcctccagaaaggactcttcccaaaaatctggaaaactggtaacctagtcctgataaagaaacaaggaagaccggcagactctgcctcggcctatcggccaatctgcctactgaatgagattggaaaactgtttgagagggtgctggctgcacgtatcaaagaacacctaatgaaagccggccctgatctatctgagagtcaattcggctttaggtctggaaagtcaaccatagacgctattcttctagttaggcatatttcaaccgaagccgtctcccggggtcgagtcgttgcggccatcagcttggatatcacaaacgcttttaattctctaccctgggctgcaatcgaggaaggtatggcttaccaccagattccaacatatctgcatggcgtcgtccaagcctacctaagcgacagaagccttcagtacatgggacgagaaaagataatgcacacagtgcaaattgattgc

SEQ ID NO: 18 - DNA, 557 bp, Oxytenis modestia
ggatccccaatgtagctcttaaggatgctgttatggctacaccaggagttttcttggaaaccttcaacagctgcttactagaaggcacttttcccaccctgtggaaacgacagagactagttctgctacccaaagggaataaaccgcccgacgagccgtcctcataccgaccactctgcatgctggatactgcgggaaaaatcctagaacgcattatccacaacagaatcgaagcagccgtcgaaccacacctagccgactcacagtatgggttcaggaaaggcaggtctacgctggatgccatagagcaagtagtgagtacagcaaagcaagcagtatctggaaaaagatggaagggaggttccataaaatactgtctggttgccacgttggatattaaaaatgccttcaactcggcgaaatgggacttgattatggaagcacttaccactttgaaagtacctgtatatctacgaaaaatagtcgcaagttacttctcagagagggttctgacatacgtcacacagaccgggcgagaggagtatgaagtaactgga

SEQ ID NO: 19 - DNA, 545 bp, Oeneis magna
tatacctggtcgtgcatgggtgttggcgttagaagcattagggaacaggctgagacaactgttcaccagctgcctacgatcaggcgtctttccatccggctggaaggaagcgaggctagtcctccttaaaaaggaaggcaggcccgcagattctccgtctgcctaccgacccatatgcctgttggacgaggtggggaagcttttcgagcggattattgccgcgcgcctcagtgatcatctgtcacgtactggtcctgacttatctgatagccagtttggtttccggcagggccgatcgacagtggacgcgatcctttccgttcgaaagctttcagagcgtgcagttcgtaagggtggagtcgctttggcggtgagtttggacattgttggcctttaattccctaccttggatggctattaaagaagcactcattcaccacaatgtgccttcatacctgcgtgacataataggggcgtacctgtccaatagattaatccggtatacggggcgggaaggccgtacacatacgagggaaataagttgc

SEQ ID NO: 20 - DNA, 538 bp, Lymantria dispar
  modified_base (261)..(261): a, c, g, or t
tgtcccggggctcgtactcggcatcgccgcggaatacctcaagggggaactgctcaatacatgtttgaggtccgggcagtttccggagcaatggaagtgtggacgtttgtatctactgcggaaggagggtcgcccagctgacgcctcttccgcatacagaccactggtgttgctggatgagatggctaaattgttcgataaagtgctcgcagaccgtctcgtccagcacctcgaggaaattgggccgggactgtcagaganacaatacgggttcaggagcggccggtcaacaattgacgcgctggccgttctaaagtctctggccaccgaagcggtggccaaaaaggaagttgtcctggcagtctcgctcgatataaaaaatgctttcaacagtctcccacacgagacgctgaaggaggcacttcgataccatggagtgcctccgtatcttgtgagactgttggaggcgtacctcgagggaaggcacgtgctctgggaggggggcgacgggcgtatacatcgccatcgggtggagtgc

SEQ ID NO: 21 - DNA, 547 bp, Lymantria dispar
tgttccaaaccgcgtgttgggcctagtcctcgaccacctgggtccccgcctcagggagctgttcgacgcgtgtttagcgtccggacggttccctgggtgctggaaggagggaaggctggtgctcctgccgaagccgggacggtctccggggtcgccttcggcctacaggcctatcgtgctgctcgatgacacgggcaagctactggagagggtggtagctgcccgcatcgagcggcacctcgtcggcacggggcccgatctgacggacgcccagtttgggtttaggaggggtcgttcgacgatcgcggctctgttgcgcctgagggccgtggcgactgaggccgtcaccggtgggggagtgctgttggcggtgtccctagacatcgccaacgcattcaatagtctgccattcagctgcatcagggaggcgctccggtatcacggagtgccagcttacctgaggcggctagtggcagactatttggtggggcgcagcgtcctctgtaccaaccgagcaggggacgttgtgcgaacgcccatgacgtgc

SEQ ID NO: 22 - DNA, 551 bp, Janiodes laverna
agtgccggccgcgtcttaaccgccgcgcttaccgccgacgctcttaaaccgtgcacgttaaatttaataaatgcgtgcgttacgcagggacgctttccaaagcgttggaaagtaggtaaactcgttcttctgcggaaggacggccgtcctttagaagagccgacgtcttaccggccgatagttttactagatgagataggcaagctctttgagcgcctcctagtggctcgaattatcgagcacttggacgaagtagggcccgggctagctgagacgcagtttggattcaggagagggcgttccactctggacgccattggtagggttaaaaacctgtcggagcaggcaaccgcggcaggccaagttgtcttggcggtgtcgatcgacatcgccaacgctttcaacacccttccgtgggaatgcataggtgaagcgctccgctatcaccgcatgccttatatttgcgtagaatactcatgtcgtatctgtcaaataggttcgtcgagtgtaagactcgcgagggctatgttcgcagatggcgcatgacgcgc

SEQ ID NO: 23 - DNA, 552 bp, Janiodes laverna
cgtaccggccgcgtcttagccgcagcgctcgcagccgatgctttaaaatcgcgcgcgttaaatctcataaatgcatgcgtttcgcagggatgctttccacaacggtggaaagtagggaaactcgtccttctaccgaaggtcggccgtcctccagaagagccgtcgtcttaccggcctattgtgttattagacgagataggcaagctctttgagcgcctccttgtggctcgaatcatcgagcacatggacaaagtagggcccgggctagctgagacgcagtttggtttcaggagagggcgttccactctggacgccatcggtagggttagaaacctgtcggagcgggccaccgctgcaggtcaagtcatcttggcggtgtcgatcgacatcgccaacgctttcaacacccttccgtgggaatgcatcggtgaagcgctccgctatcactgcatgcctttatatttgcgtagaatactgatgtcgtatctgtcgagtaggttcgtcgagtgtaagactcgcgagggctatgttcgcagatggcgcatgacgcgc

SEQ ID NO: 24 - DNA, 551 bp, Janiodes laverna
agtgctcggccgcgtcttaaccgccgcgcttaccgccgacgctcttaaaccgtgcacgttaaatttaataaatgcgtgcgttacgcagggacgctttccaaagcgttggaaagtaggtaaactcgttcttctgcggaaggacggccgtcctttagaagagccgacgtcttaccggccgatagttttactagatgagataggcaagctctttgagcgcctcctagtggctcgaattatcaagcacttggacgaagtagggcccgggctagctgagacgcagtttggattcaggagagggcgttccactctggacgccatcggtagggttaaaaacctgtcggagcaggcaaccgcggcaggccaagttgtcttggcggtgtcgatcgacatcgccaacgctttcaacacccttccgtggaaatgcataggtgaagcgctccgctatcaccgcatgcctttatatttgcgtagaatactcatgtcgtatctgtcaaataggttcgtcgagtgtaagactcgcgagggcttagtgcgcagtaggcgcagagcgc

SEQ ID NO: 25 - DNA, 553 bp, Janiodes laverna
agtgcccggccgcgtcttaaccgccgcgcttaccgccaacgctcttaaaccgtgcgcgttaaatttaataaatgcgtgcgttacgcagggacgctttccaaagcgttggaaagtaggtaaactcgttcttctgcggaaggacggccgtcctttagaagagccgacgtcttaccggccgatagttttactagatgagataggcaagctctttgagcgcctcctagtggctcgaatcatcgagcacttggacgaagtagggcccgggctagctgagacgcagtttggattcaggagagggcgttccactctggacgccatcggtagggttaaaaacttgtcggagcaggcaaccgcggcaggccaagttgtcttggcggtgtcgatcgacatcgccaacgctttcaacacccttccgtgggaatgcataggtgaagcgctccgctatcaccgcatgcctttatatttgcgtagaatactgatgtcgtatctgtcgaataggttcgtcgagtgtaagactcgcgagggctatgttcgcagatggcgcatgacgcgc

SEQ ID NO: 26 - DNA, 554 bp, Janiodes laverna
agtgccggccgcgtcttaaccgccgcgcttaccgccgacgctcttaaaccgtgcgcgttaaatttaataaatgcgtgcgttacgcagggacgctttccaaagcgttggaaagtaggtaaactcgttcttctgcggaaggacggccgtcctttagaagagccgacgtcttaccggccgatagttttactagatgagataggcaagctctttgagcgcctcctagtggctcgaatcatcgagcacttggacgaagtagggcccgggctagctgagacgcagtttggattcaggagagggcgttccactctggacgccatcggtagggttaaaaacttgtcggagcaggcaaccgcggcaggccaagttgtcttggcagtgtcgatcgacatcgccaacgctttcaacaccctttccgtgggaatgcataggtgaagcgctccgctatcaccgcattgcctttatatttgcgtagaatactgatgtcgtatctgtcgaataggttcgtcgagtgtaagactcgcgagggctatgttcgcagatggcgcatgacgcgc

SEQ ID NO: 27 - DNA, 547 bp, Heteropterus morpheus
aattccaggtcgagctctgacgatcgctctttccatcctcggagcgagagtgcaacgcctcttcaccgaatgtctccgactcgggcactatccagcggactggagaagggcgaagctggtgctcttgcacaagccgggcagaccgaccgagtcaccagcggcctataggccgatttgcctcttggacgatgtgggtaagcttttcgagcgtgtaattgccgctcgcatcaacaagcatctcgcggagaggggcccagatttatctgagcaacagtacggtttccggcgacaacgctcaaccatggatgccatactcagcgtgagggcactctcagagcaggcggtatcggagggaaaggtggtactggcagtcagtcttgacatagtcaatgcctttaactcccttccctggagagcgattgacgaagcgctcacataccacgaggtgcctccctacttgaggaatgtactgagatcatacctctcagataggagcgtctgctaccccggccgatatgggattatgcaggagaggagcgtcgtgtgc

SEQ ID NO: 28 - DNA, 547 bp, Erinnyis ello
tatacccggacgcgcttgggtgttggccttaaaagtgctaggatacaagatgagaagactttttgacaattgctttcgcactggcatattccccaaggcttggaaagaggctaaagtgttccttataaaaaaaagaaggcagagctggagattctccttcagcatatcgtccgatatgtttattggatgaggttgggaaggtattcgagagatggtcgccgctcgcctcaatgaacatctgtcacgcactggccctgacctctccgataaccaatatggtttccgaaaaggaagaagtactgtagacgcaattctttgcgtacgttccacagcagaacaagcggttacccgaggcaatgtggcattggcgataagtctggatatcgtcaatgcctttaactctttgccatggaatgtgattaaggagtcattagttcaccactcagtaccactttacttgcagccctataattggggactacttgcgcgaaaggtatatccattgtacgacacagtatggctgcttatacagaagaaaatgtattat

SEQ ID NO: 29 - DNA, 547 bp, Erebia theano
aattccgggccgtgcatgggcgttggccttggagggcttagggaaccggctgaggagactttttaatagctgcctacgcacaggtattttcccttccggctggaaagaggctaggttagtcctcttgaaaaaagaaggcaggcccgcagattccccatctgcttaccgacctatatgcctgctggacgaggtgggaaagctatttgagcgcattattgcagcccgccttgccgaccacctgtctcgggtgggccccgatctgtcggaaagccagttcggtttccggaaaggccgatcgaccgtggacgctatccttcgcgtccgtaccttgacggaacgggcggtatgcaggggtggagttgcgttggcggtaagcctagatatcgtaaacgccttcaattccttaccttgggcggctatcagggaagctctaacttaccacaatgcgcctccatacccgcgtgacatagttggggcgtacctatgcgacaggtcaatagaatatatcgggaaagatggccataagtattccaaagaggtgaactgt

SEQ ID NO: 30 - DNA, 544 bp, Erebia theano
gattctggtcgtgtatgggtgctcgctttggagttcctaggtaacaggctgaagcggctgttcaataggtgcctgcgttccagcgtattcccgtctggctggaaaaaagcgggcttagttcttctgaaaaaggaaggccgacctatcgattctccgtcggcctatcgaccggtatgcttactggacgaggtaggcaagatgttcgagcggattattgccgcccgcctaaatgaccacctgtcgcgtgtgggcccggatctttcggatagtcagttcggattccgggaaggccgatcgacagtggatgcaatcctccaagtccgcgccttttcggaacgagctgttggtaggggtggagtggctttggcggtgagcctggatatagtgaacgcctttaattctctaccatgggtggctataaaggaagcattagtgtaccacaatgtgcccccttaccttcgcgaaatcatcggggcatccgagcgacagggttattcaatatagagggcgcgatggtcgtgcgcacgtaagagaggtaaactgc

SEQ ID NO: 31 - DNA, 547 bp, Erebia theano
tataccaggccgcgcatgggtgctagccttggaaagtctagggatccggctaaggagacttttagcagctgcctgcgctcaggcgtcttcccttccggctggaaacaagcgaggttaatcctcttaaaaaaggaaggcaggcccgctgattcgccatccgcttatcgaccaatatgtttgctggatgaggcgggtaagcttttcgagcggataatcgcagcccgcattaccgaccacctatcgcgtgttggccccgacctgtcagtaagccagttcggtttccggaaaggcctctccacagtagacgcgatccttagcgtccgtaccttttcggaacgggcagtatccgggggtggagttgcgttggcggtaagcttagatatagtaaacgctttcaattccctaccttgggtggctataatggaagctctaacttaccataatgtgcctccatacctgtgtgacatagtcggggcgtacctttgcaacagatccattcaatacatcgggcgggatggtcgtaagcatatgagagagataagcttgc

SEQ ID NO: 32 - DNA, 547 bp, Emesis lucinda
tgtccctgcacgggctctgaatctagctctttcagtgctgggagactggcttaggagtttgtttactaaatgctttcaaacgggccggtttccggcacaatggaaaatagcgcagttggttcttttgaaaaaacagggtagggctatggataatccttctgcttaccgaccaatttgccttttggatgagacgggtaaactactggaaagaatagtagcaaacaggattaccacacatttatcccagattggtccaaacttggctgactcccagtatggcttttgtaagcaacgttcaaccgtagacgctatactccgcgtccacgctatatcggatgaggccttgaaacagggtaaaattgcattagcagttagcctcgacattgtcaatgccttcaactctctacccttgcaagctatccgccaggcgcttgtttaccatcgtatacccacctaccttcgcaaggtggtagaagactacatatgtgataggaaaatacgatggttaggtcgtgactcgaaaataactgagatggaagtgcattgt

SEQ ID NO: 33 - DNA, 547 bp, Emesis lucinda
tgtccctgcacggactctgactctagctctttcagtgctgggagactggcttaggagtttgtttcctcaatgctttcaaacgggccggtttccggcacaatggaaaatcgcgcagttggttcttttgaaaaaacagggtagggctatggataatccttctgcttaccgaccaatttgccttttggatgagacgggtaaactactggaaagaatagtagcaaacaggattaccacacacttatcccagattggtccaaacttggctgactcccagtatggctttcgtaagcaacgttcaaccgtagacgctatactccgcgtccatgctatatcggatgaggccttgaaacagggtaaaattgcattagcagttagcctcgacattgtcaatgccttcaactctgtacccttgcaagctatccgccaggcgcttgtttaccatcgtatacccacctaccttcgcaaggtggtagaagactacatatgtgataggaaaatacgatggttaggtcgtgactcgaaaataactgagatggaagtgcattgt

SEQ ID NO: 34 - DNA, 550 bp, Coenonympha glycerion
tataccaggtcgcgcgtgggtttttgcccttgaggccttgaggcctaggttaaagcggctgtttaccagttgtctgagaaaagggatctttccctcaggatggaaagaagccaaacttgtactattaaaaaaagaagggaggcccgcagattctccaactgcttatagacctatatgcctactggatgaagtgggtaagctttttgagcgtgttattgccgatcgcattaatgaacatttgtcaacaggtccaggacctgacttatctaattgtcagttcggattccgtaaaggcagatcaacagtcgatgcgatcctttgcgttcgtactttaacagaacggacaattagcggaggtggagtagctctatcagttagcctagacattattaacgcctttaattctctgccatggacagctatcagggaagcgttagtttatcacgaagtacctacatacctgcggaaaataatcgaagcgtacttatgtaatagatcaatccaatattcaggtcgagacggcgctacacattcaagagcgatgagctgc

SEQ ID NO: 35 - DNA, 568 bp, Coenonympha glycerion
gcatacctggtcgagcgtgggtgtttgccctcgaatgcgttagagaaatagatttaagagcgatttatttaacagctgtctcaaagggctagtagtagttcccaaaagagaatgagaaatgatgagcaaaaactgggtccctctttgaaaaaagaaggaaggcctgctgactctccctctgcctacaggcccatatgcctactagatgaggctggtaaactttttgaacgtataattgccgctcgcctcagcgagcacctgtcgcaggtaggccctgatctctctaatagccaattcggtttccgacagggaagaatcaacggtagatgcaattcttcgcgttcgatcacttaccgaccgggctgtaagtgggggtggagtcgcattagctgtgagtttagatatagttatcgctttcaactcccttccctggacatcaattagggatgcattagattaccacaacttaccgccatacctgcggtgtatagtcggagcatatttgagtggcagatcggtgcagtacactggtcatgacgggcaaatacatacgagggatgtaagttgc

SEQ ID NO: 36 - DNA, 547 bp, Coenonympha glycerion
catacctggtcgagcgtgggtgtttgccctcgaagcgttagggaatagattaaggcgattatttaacagctgtctcaaggccagtgtgttcccaaaagaatggaaagaggcaaaactggtcctcttgaaaaaagaaggaaggcctgctgactctccctctgcctacaggcccatatgcctactagatgagactggtaaactttttgaacgtataattgccgctcgcctcagcgagcacctgtcgcaggtaggccctgatctctctaatagccaattcggtttccgacagggaagatcaacggtagatgcaattcttagcgttcgatcacttaccgaccgggctgtaagtgggggtggagtcgcattagctgtgagtttagatatagttaacgctttcaactcccttccctggacatcaattagggatgcattagattaccacaacttaccgccatacctgcggtgtatagtcggagcatatttgagtggcagatcggtgcagtacactggtcgtgacgggcaaacacatacgagggaagtaagttgc

SEQ ID NO: 37 - DNA, 548 bp, Coenonympha glycerion
catacctggtcgaagcgtgggtgtttgccctcgaagcgttagggaatagattaaggcgattattttaacagctgtctcaaggccagtgtgttcccaaaaggatggaaagaggcaaaactggtcctcttgaaaaaagaaggaaggcctgctgactctccctctgcctacaggcccatatgcctactagatgaggctggtaaactttttgaacgtataattgccgctcgtctcagcgagcacctgtcgcaggtaggcctgatctctctaatagccaattcggtttccgacagggaagatcaacggtagatgcaattcttagcgttcgatcacttaccgaccgggctgtaagtgggggtggagtcgcattagctgtgagtttagatatagttaacgctttcaactcccttacctggacatcaattagggatgtattagattaccacaacttaccgccatacctgcggtgtatagtcggagcatatttgagtggcagatcggtgcagtacactggtcgtgacgggcaaacacatacaagggaagtaagttgc

SEQ ID NO: 38 - DNA, 550 bp, Coenonympha glycerion
tataccaggtcgcgcgcgggttttcgcccttgaggccttgaggcctaggttaaagcggctgtttaccagttgtctgagaaaagggatctttccctcaggatggaaagaagccaaacttgtactattaaaaaaagaagggaggcccgcagattctccaactgcttatagacctatatgcatactggatgatgtgggtaagctttttgagcgtgttattgccgatcgcattaatgaacatttgtcaacaggtccaggacctgacttatctaattgtcagttcggattccgtaaaggcagatcaacagttgatgcgatcctttgcgttcgtactttaacagaacggacaattagcggaggtggagtagctctatcagttagcctagacattattaacgcctttaattctctgccatggacagctatcagggaagcgttagtttatcacgaagtacctacatacctgcggaaaataatcgaggcgtacttatgtaatagatcaatccaatattcaggtcgagacggcgctacacattcaagagcgatgagctgc

SEQ ID NO: 39 - DNA, 547 bp, Coenonympha glycerion
catacctggtcgagcgtgggtgtttgccctcgaagcgttagagaatagattaaggcgattatttaacagctgtctcaaggctagtgtgttcccaaaaggatggaaagaggcaaaactggtcctcttgaaaaaagaaggaaggcctgctgactctccctctgcctacaggcccatatgcctactagatgaggctggtaaactttttgaacgtataattgccgctcgcctcagcgagcacctgtcgcaggtaggccctgatctctctaatagccaattcggtttccgacagggaagatcaacggtagatgcaattcttcgcgttcgatcacttaccgaccgggctgtaagtgggggtggagtcgcatcagctgtgagtttagatatagttaacgctttcaactcccttccctggacatcaattaagggatgcataagataaccacaacttaccgccatacctgcggtgtatagtcgagcatattagagtggcagatcggtgcagtacactggtcatgacgggcaaacacatacgaggaaagtaagttgc

SEQ ID NO: 40 - DNA, 556 bp, Catocyclotis adelina
tattccaaacatcgctttaaaggcagccatcaatgaggcaccggcaatgtttctcgaaatgtacaatgcatgcctcagagagggtgttttcccacgtaaatggaagcagcaaagattagtgcttctccctaaaggaaagaagccaccggacgagccatcatcttaccgtcccctctgtatgctggacacagctggaaaaatacttgaacgaatagtccaccaaagaattgaagcagtaatagatccgctgctggccagaaatcagtttggttttcggaagggacggtcaacactggatgccattaaccttgtcatcaacaccgccaaggacgcgatagcagggaccagatggaggagaggcacaaagaaatattgcttagttgccacgttagacataaaaaacgctttcaactctgcaaattggcactgcatcatgaaagcccttaatgaaatgcaagtaccagcctccctaaaaaggatggtgttaagttactttagtgatagggtcttgaagtatgacactaaatccggaccaaaggtatacaaaatcacagga

SEQ ID NO: 41 - DNA, 547 bp, Caria rhacotis
aatccctggaagggcactagctttggccctgtcagtactaggagataggttgagacagctattcgataactgtctcgagcaaggccagtttccatggcaatggaaagtagctaatatggtgctacttaagaaagaaggaagacctgtggatagtccctctgcataccgaccgatttgtttgctggatgaggcggccaagctactcgagagagtagtagccgacagactcaccaagcatctatctcgggacggtccaaatctggcagagagtcaatatggttttcgacaggggcgctcaacagtggatgcgattcttcaagtccgctccatgtcgaatgagttcgtgagccagggtggtgtagcgttggcaataagccttgatattgtcaatgcttttaattctttacccatgcgggccatacgaacggcgctctcacatcatcgagtgccgcagtatctctgcaagctggtggaggattatctgtgcaataggataattcaattggacaggcgaagatgcatgacatgtcgtagagaggtccaatgc

SEQ ID NO: 42 - DNA, 547 bp, Caria rhacotis
agttcctggacgtgcactggctttgtctctgtcagtgttgggaaatagactgacacaattattcactaattgtctcaaatatggacagtttccatctcaatggaaagcagcaaacatggtgctcctgaaaaaagaaggtaggccggctgacagtccttccgcataccgaccgatctgtttacttgatgaggcgggcaagctacttgagaaagtagtagctgacaggctcaccaagcatttgtgtcagagcggtccgaatcttgcggagagtcagtacggcttcagacaagggcgctcaacagtggatgctatacttaaagtccgtgaaatatcgaacgagactttaagccggggtggagttgcattggcgataagtattgacatcgtcaatgcatttaactctttgcccttacgggccattcggacggcactccttcatcatagagtgccacaatacctccgcacacttgtggaggattatttatgtaatagaagaatccaatggaggggtcatgatggagtgatgtacgggagagaggtccaatgt

SEQ ID NO: 43 - DNA, 547 bp, Archiearis parthenias
tgtactggacgaatctgggctctagctatggaggccttagagcatcgactgagagcaatgtttaatgcctgtctggcccaagccataattccacagaggtggaagacaggacaacttgttcttattcggaaggatgggcgtccaggggattccccttctgcataccgccctatagtgctgcttgacgaagtcggcaaactctttgaggggattgtggccagtcgcattaacgagcacctggagacggttggcccagatctgtcggagaaccaatttgggttccgtaggggtcgttccaccatcgacgcgatcctacgggtgaggtcactcgcacaggacgcggtttcccggggtgaggtcatgttggcggtatctcttgacatcgccaacgcatttaataccctcccctggtgttgtatcagggaggcgctccggtaccatggagtgccaccttacctgtgccgtatattgggagcctacctgtctgagcgtagtgtggtatacccaggtcgggacgattggaatgcgaccgggaaaatgtcatgtt

SEQ ID NO: 44 - DNA, 553 bp, Brangas neora
cataccaggacgtgcttgggccctcgcgatggagtctatgcaggagaatgttgtgcaagtcctgtccaaccttgcctggcgcagggtcgatttccgacaccgatggaggacgggaaaattagtcctcattaagaaagctggcagaccagaagaccaaccctcggcctatcgcccgatcgttcttcttgacgaggtgggcaagatgttagagaggatcatcgcggcgcgaatcacggcccacctggaaagggtcggaccaaacttgagtgtcaaccaatttggtttccgcccgcggcggtccaccatcggagccattgccacactgaaggaccttgtcgacgaggagatctctcggggtggggtggttgtagcggcttccttggatatctccaacgcgttcaactccctgccctgggaatgtattcgtgagggcttgcgtttccacgcagtgcccaaatacttgcgcaaaatcgtcgcgcattacctgtcttcccgcacggtctgttacccttcgaacgagagtggatggaagatcgagggaacttatgtcgac

SEQ ID NO: 45 - DNA, 547 bp, Araschnia levana
tataccggatcgggcttggtcttagcattagaagcattagggaacaggttgagacaactctttaatagctgcttacgattaggtgtgtttccatctggttggaagaaagcgaggttagttctcctgaaaaaggaaggtaggcccgctgattctccatctgcataccggcccatatgcttgctggatgaggtgggtaagctgttcgagcggatcattgcggcacgcctaagtgaccacctgtcacacatcggccctaatttatccgaaagccagtttggcttccggcagggccggtcaacagtggatgcaatcttatgcctccggaacatcacggaaaggacagttcctaaggggggagtcgcgttggcggtgagtttagacatcgttaatgctttcaattcgctaccttggccagctatcggagaagcgctgactcaccacaatgtgcctccatacctgcgtgacatcataatggcgtatctgtccaacaggtgtatccaagtataatgggcgagagggccgcacgtatacgaggcaaataagttgc

SEQ ID NO: 46 - DNA, 547 bp, Araschnia levana
tataccgggtcgggcttgggtcttagcattagaagcattagggaacaggttgagacaactctttaatagctgcttacgattaggtgtgtttccatctggttggaagaaagcgaggttagttctcctgaaaaaggaaggtaggcccgctgattctccatctgcataccggcccatatgcttgctggatgaggtgggtaagctgttcgagcggatcattgcggcacgcctaagtgaccacctgtcacacatcggccctaatttatccgaaagccagtttggcttccggcagggccggtcaacagtggatgcaatcttatgcctccggaacatcacggaaaggacagttcctaaggggggagtcgcgttggcggtgagtttagacatcgttaatgctttcaattcgctaccttggccagctatcggagaagcgctgactcaccacaatgtgcctccatacctgcgtgacatcataatggcgtatctgtccaacaggtgtatccagtataatgggcgagagggccgcacgtatacgaggcaaataagttgc

SEQ ID NO: 47 - DNA, 556 bp, Anteros formosus
gattcccaacgtagcgcttaaacaagctattatggcaacaccaggagttttcttggagacctacaacagctgcttactggaaggcacctttcccactctgtggaaacgacagagactggttctcctccctaaagggaagaagccacgagacgagccatcctcataccgaccactctgtatgctggatactgcggggaaggttctagaacgtattatccacaataggatcgaagcggcactcgaaccccacctagccgactcacagtatgggtttagaaaaggtcggtctacgctagatgctatagagcaagtagtcagtacagcaaaacaagcagtgtctgggaaaagatggaagggaggctcaataaaatactgcctggttgctacgttggatattaaaaacgcttttaactcggcgaattggggggttatcatggaagcacttagcacattggaagtccctctatacctacgcaaaatagtcgccagctacttctctgatagggtcctaacatacaccacgcaaaccgggcgagaagagtataaagttactgga

SEQ ID NO: 48 - DNA, 555 bp, Anteros formosus
gattcccaacgtagctcttaaacaagcagtaatggcaatgccagaggttttcttggagacctacaacagctgcttactggaaggcacctttcccactctgtggaaacgacagagactggttctcctccctaaagggaagaagccactagaagatccatcctcataccgaccactctgtatgctggatactgcggggaaggttctagaacgtattatccacaacaggatcgaagcggcagtgaaccccacctagccgactcacagtatgggtttagaaaaggtcggtctacgctagatgctatagagcaagtagtcagtacagcaaagcaagcagtgtctgggaaaagatggaagggaggctcaataaaatactgcctggttgctacgttggatattaaaaacgcttttaactcggcgaattggggggttatcatggaagcacttagcacattggaagtccctctatacctacgcaaaatagtcgccagctacttctctgatagggtcctaacatacaccacgcaaaccgggcgagaggagtataaagttactgga

SEQ ID NO: 49 - DNA, 556 bp, Anteros formosus
gattcccaacgtagcgcttaaacaagctattatggcaacaccaggagttttcttggagacctacaacagctgcttactggaaggcacctttcccactctgtggaaacgacagagactggttctcctccctaaagggaagaagccacgagacgagccatcctcataccgaccactctgtatgctggatactgcggggaaggttctagaacgtattatccacaatagaatcgaagcggcagtcgaaccccacctagccgactcacagtatgggttcagaaaaggtcggtctacgctagatgctatagagcaagtagtcagtacagcaaaacaagcagtgtctgggaaaagatggaagggaggctcaataaaatactgcctggttgccacgtaggatattaaaaatgccttcaactcagcaaaatgggaagttatcatggaagcacttagcacactgaaagtgcctctatacctacgtaaaatcgtcgctagttacttttctgatagagtcctcacatacagcacgcaaaccgggcgaaagggagtatattgtactggg

SEQ ID NO: 50 - DNA, 556 bp, Agrotis exclamationis
gatcccaatgtggcccttaaacaagctcttcttgtcagcgcctgaaatgtttttggagacctataacaaatgcttcaaggaaggcacctttcccactctatggaagcgacagagactagtactccttcccaagggaaagaaaccactggacgaaccatcttcttaccgcccactctgcatgctggatactgcagggaaagtgctagaacgtatcatccacaataggatcgaagtagcagttgaaccccacctagccgacgcacagtatgggttcagaaaaggccggtctactctggacgctattgaacaagtagtcagtacagcaagacaggcaatctctggaacgagatggaagagaggatccattaaatattgtctggtagctacgttggatatcaaaaatgcatttaactcggcgaaatgggatgtgattatggaagcactcagcgtattaaatgtaccactatacctgcgcaaagtggttgctagctacttctctgacagggtcctcacatacactacgcacaatggcccaaagaactacaaagtcactgga

SEQ ID NO: 51 - DNA, 537 bp, Agrius cingulata
cgtcacgtacggcgaacttagaaaagccgatccaagtgcccgtgtactcacagcactctttaacgcagtctggcgcacggaatcggttccctcttcctggggtcgttcaaacacaatcctgttgcacaaaaaaggggacacaggagacattcgcaactggaggccaattgccctcgcagacacagttccaaagctgtttgcggccatcctctctgaaagaattaagagatgggcgaccgctaaccgcagatttagtgaagcgcaaaagggcttcctgcactttgagggttgttttgagcataacttcacgctgcaggaaattataaggaacgccaaaactcatagaaaggaactagtggtggtttggctggacctgacaggtgccttcgactcagtgccccattcctcaatattcagggcgcttgagggtcctggagtccccttgaagtttagaaatgtcttctcctctctttacgccgacatgtctactagcgtgcgggtggcaggtggaaacacagctcctatctgcatcggtct

SEQ ID NO: 52 - DNA, 538 bp, Agrius cingulata
cgtcacgtacggcgaacttagaaaagccgatccaagtgcccgtgtactcacagcactctttaacgcagtctggcgcacggaatcggttccctcttcctggggtcgttcaaacacaatcctgttgcacaaaaaaggggacacaggagacattcgcaactggaggccaattgctctcgcagacacagttccaaagctgtttgcggccatcctctctgaaagaattaagagatgggcgaccgctaaccgcagatttagtgaagcgcaaaagggcttcctgcactttgagggttgttttgagcataacttcacgctgcaggaaattatgaggaacgccaaagcccatagctaggaactagtggtggtttggctggacctgacaagtgccttcgactcagtgccccattcctcaatattcagggcgcttgagggtcatggagtccccttaaagtttagaaatgtcatctcctctctttacgacgacatgtctactagcgtgcgggtggcaagtggaaacacagctcctatctgcatcaagtca

SEQ ID NO: 53 - DNA, 547 bp, Aglia tau
tgttccgggccgtgtactaagcctgacgctggatcatctgggaggagaacttcgggcgctgttcaaccattgtctaatggttggacagttcccgaagctgtggaagcaggggcggctgtatcttttggcgaaagaaggccgccctttggactgcccgtcggcataccggcccctggtgttgttggacgacactggtaagctgtttgaaaaaatactagctgctcgtgtcgttcggcatctcacgcagatggggccggatctgtcgaaagagcagttcggctttcgggtcgggcgttccactgtggacgccctgacggcgctgaaggcgctctccgcggaagcgaccagtagggggaataggttgttggcggtgtcactcgacatcgccaacgccttcaacagcttgccgtacggagtcatactgcaggcacttcgttaccatggggtgcctctgtacctgcggcagctgttggaggactacctacaggcaagggaggtcgctttcgtggatagtcggggagtgatggtccagcgtgaggtgcggtgt

SEQ ID NO: 54 - DNA, 547 bp, Aglia tau
catacccgggcgtgttttagtattggctctccaagaagcgttgctggataaccttagagggctgtacgacgcgtgccttgagcaaggaaggatcccactaatgtggaagatcggtaaactggtcctcctcagaaaggagggccgtaatctagagtcgccttctgcttaccgacctatcgtgctgcttgacgaagtgggtaaactcttagagcgtataatcgctgctcgcatcgtcaagcacatgaatacagtgggacccaatctgtccgacacccagttcggatttagggtggggcgctccacgattgatgcgattggacgagtaaagacactggcggagaatgcggtgtcccaaggtgaggttgttttggcggtgtctctcgatatcgccaacgctttcaacaccttgccctggagctgcattggagaggctctccgatatcacggggtaccctcctatctgcgccaggtggtggaggattatttgtccgatcgctttgtggagtgccagactcaagagggtatgcgtcgatggaagatgtcatgc

SEQ ID NO: 55 - DNA, 556 bp, Phengaris alcon
aacccccggccggatctgggtaaagtccatggggccactcaagcacaggatgcgggacctgttcactgagtgcctcgcgcagacggagtttcccgagtgctggaaggagggtaggcttgttctgttgaggaaggacggccgccctgccgactcgccttcggcctacaggcctatcgtcttgctagacgaggccgggaagttactggagagagtgattgcatctagggtcaccaaacaccttgagcgggaagggcctaacctctccgaggcacaatatggcttccgaacgcagcgctcgaccatagatgcaatcctcaaagtcaaggagttctcggaggagcacacggcaaacggcggagttgtgctggcggtgtcatttgacatcgccaacgcatttaacaccttgcccttcgatgccatcgaggagggccttcgctatcacgaggtgcctttggtccttccgcaaaatcatcggagggtaccttaggagacggactatcatctgtatttgcacgtaattggtgttgccatccgatttgggacttggtgcggtgtt

SEQ ID NO: 56 - DNA, 553 bp, Phengaris nausithous
tattcctggacgagtctgggtgattgtactacctgccctcggtgaaaaactgagagacctattcacaggctgcctcaaggaaggcatctttcctaaattatggaaaattcccaagttggttctattccaaaaggaaggcagatctgtggatagtgcctcggcatatagaccaatttgccttttggacgaaattggtaaactttttgagcgaataattgctgatcgaatcaataagcatgtcaacaattgcggtccaaacctgtctcaaaaccaatatgggtttcgcaaagggcgttcaactgtggatgcaattttgcgtgttaaagatataacaacaagcgcaacttctaagggtaggaaagttcttgctataagtattgacatagtaaatgcatttaactctctgccctggagaacgataagaaaggcgcttgtttaccatcgggttccaccgtatctccaaagagtattgcattcatatctttctgatagatgtattatatacgtagataaaaatggagttgtgcaagttaaaaatgttgagtgtggcgtt

SEQ ID NO: 57 - DNA, 5412 bp, Bactrocera tryoni
cccggtgggactttaaatttccaaggggaatagtcaccgtcgctgagctttaagctaccgggggggtcggcaggtcgcggatagccggacggcctgtagtagcaggttagttgcgaaataagtttaaacgaataagcaatccccgacgaggagcggcaggagtggaggatgcggtataaaagccagcaagaccgttgaaactcctgcgacagtgggcgaatcgacaccgcccctttgaaatatgtgtcccccgcaacatgcaagggcatgttgtgtaataaaaaaatccaggcgcgacggacccataatgggcggcttcctggtcagcgtctgttcaccatgttaggtgcggctgatattacaacttgaccggtacacagcgcggcgcactgggagtccctggatatcttgacagcgatgtctccgctggtaggatggaaagggtgatgtgagcttgctctgccgaggtgtcagctgcgtggtgtatcagtaaacagccacttcggtccctggtcagggagtgtgcattgggcgcaggagtagtagcctgcgttgccccgggcgagcgccggtccgtccgtgttttccgggactggtaaagcgaaggacaggcctcagggaactggggtaggagcatagtctccgagggtacacccgttcctgtctatttcggcccgcccccctacacacgatgcgctgtaaaaaacaaacaaatggagaataatttgagaaaatacaccaaaaccaatagcagcagtgtacctgactgcatgatgagcaacggcactcaaagccctggcagcatgtttttagaaactgatttatccagggaaacgccgacgattagcggatctagcgaagcggatccattcaaacgcgcaccaagattgatgcgatcaccaaaacaggcgctagttgttgaaaaacctgtaagagcgagatcgtcaccaccagcgctgcaagacagcacgcctcgagcggaaccaacgcaaccgaagggtgacattatgtctgaattgggagatatgatcaagaggctaacggaagcaatgaaactgcctcaacgatcgatcaacaatcagatccgtgatctgctaacttctgtcacaaagctccacgaacgcgcccaaagcgagtacaacaaaatcaaggaaagcagacgaaatgtccttttaagacacgcaggagtggattcaacgccaaaaaggccccgcgaggatgagcagctgacgcgaaagaccccgccaaaaaagaaagccagccaagaggaagtccaaaagaggaccactgcgtgcaagaggaatgaaggaaacattcctacaaaagaacggaaggcagaggaacagggaaatgaatggacacaggtgaaacgaaaaacacaaaacccgattaaaaaggctgtttttgctccacgtccgaggcccgatgcaattatcattgcgcgcactggaaacatgtcgtacagcgatatgcttagagccgtcaaaaaggaagatgctctgaaagagcttggagaaaacgtttcgcggatccggaagacggcaaaaggcgaaatacttctagaaatgaagaaggcccagatgaaaaacacgggagcatatgaaaaggagatatgcaaggttctgggcgaccaggcgcaaataagagccctaacccacgaagtatcagtggagatccgagacttggacgaaataaccactaaagaagacatagcggtggcaatacgatcacaaatcaaagagctaaattcctttgacgaaaatgcgatcaaaaccatgagacaggcgtacgcgggcacgcaaacggcagtcatcagccttcccgcagcggactcaaaacggctgcttgacgcccataagatcaagattggatgggtggtctgcagaataagggaaaagccgaacctcagaaagtgtttcaggtgcctggaatacggccatctggcgagggcatgtacgagcgaggatgatcgaagcaaatgttgtgctaagtgtggtgaaaaggggcatttcgcaaaggaatgtgataaaagcccgtcgtgtgcagcatgcaaaagcagtgggaaaaaggagacaggtcaccggatcggaagttggaagtgtcctctatatcaagcggcgtgtaaaaagacaaaatgagagttgtccaaatcaacctaaatcactgtgaagctgctcaagagctgctgaagcaaacaatcttcgaggaaaagatagatgtggcgatagtgtgtgagcagtataaaaacataaacgctggcacgtggatctccgacaaggaaaacaaagctgccatatgggcctgtgggggcaacgccttccaagataagccgctcctgggcagatcttactatacgcgagcgaaaataggtggcatttatttttacagctgctatattcccccgagtgtgctgcaaggagattacgaaagaattctcgatgaactagtccgagacgccctcactactacgccaaacgtgatagcaggcgatttcaacgcatgggcaattgaatggggtagtagctacacaaacaggcggggtaatgctctactcaaagcgttttctatgttagacgcagtgctgctcaataccggcggtagaaatacttttgaaaagaatggacgcggatcgataatagatattacattcgccagcagcacgctggttcgatctgcaaattggaaagtgtgcgacttttacacacatagcgatcacctggccatcttgctggaaatccgcaagcaaacacaaacccgatccagcgtaaaaaaattgcagaaaaaaggatggaaggtggaaacgttcgatgaagaaattttcaaacttatgttggatgggaacctagatgatgcgatcaatgttgaccgacaggctgaaaaactagtgaagcacataagtaaagcctgtgatgctgctatgtgtagaaaaaggcacaacataacccaaaggcccgcatactggtggaacgaggagatcagcacattaagaagcgaatgccataaagcgagacgcctctgccaaagaagccaaggtacgccacaccatacaagactgcgagaaagtttcaaaaaaaaacgtaaggaactcaagaaagctatcaaaagaagtaagtcctcaagttttaaagaactatgtgaaaaggtggacgagaatccgtggggtgacgcgtataaaatagtgatggcgaaaatcagagggggtaaaagtcaagcaccaacctgtccgaccctcctagaaaaggtggtgaaaacgcttttcccaacgcaagaaccccaatcgagtagaacgataccaaccgtgatggaatctccaattgtcgacgagaaggaggtaatggaagtggcggagagatttggcaacgcaaaggcaccaggacttgatggcatcccgaacaaggcactgaaaattgccatcaaccatagcaagagggccttcgccgaactctactcacgatgcctaaaagaaggagttttcccaaaaatttggaaaaaacagcggctggttcttcttcagaagccaaacaaaccagcgggagagccgagtgcgtatcgcccactctgcatgatcgacacgatggccaaaatactggaaagactgatttgcacacgtctagaacgtcacctagaagaagagtctcctggcttatctgaaaaccaatttggattcagaagacatcggtccactttggacgcagttggaaaagtgacggacattgcggccaaggccatagagggcaccagatggatgcatggagataaaaaatactgcgcagttgtcacgcttgacgtgaaaaacgcttttaactctgcatcctggccacatatactgagggcattagaggcaagaaacaccccggggtatcttctgaggacaattagcagctatctgtctgacagactactgctgtatgataccgatgcaggtccaaaaacctacatggtgacaggtggagtaccgcagggctccgtattgggtccgttactttggaatgtgctatacgacggggtgttacgcctaccgctgccaaaagaggcacaaataattggctatgcggacgacattgctgtgacgatagttgctaaagagctctcccaaattcaaaacttctgcaatgcgaccacagcaaaaattaaggactggctcacggaaactaagctgcagctggccggagaaaagacggaagcggtgcttatcacgagcaggaaaaaactagaaacggtcaccttaaatatcgatggatacaacattacaacgcaaaactccctgagataccttggcgttatgattgatacgagattgaatttcaaagcgcatgttgaaaaagcctgtagcaaggcagctactgttacagcggccctgtcaagaataatggctaacactggtggccctagtcaaagtaggagagccctactagctaaagtaagtcagtcaacactgatgtatgcggcccctatatggggaaaagcactgcgccaaaaaacaaatgccaataaggcaaaggcagtgaccaggctatgcgccatcagagtggcctgtgcattcagaacggtctcacatgaagcggccagtatcatatctggtcttatgcctccggacttaatggcctcagagttacgtagagtctacctaaaatctaaagctatgaataggcgtctaacagctgacgagcgaaaaaaggagagacaggttagcctcgaagagtggcaaagacaatggaacgcggcagaaaaaggaagatggacgcacaagctcattaagaacgtatcagcttggattgagagacaacatggggagacagacttttatctgacgcaattcttgacaggccatggctgtttcagggaatacctttacagattcggccacgatgatgacacaaaatgttcattctgcagcagtgccaatgaaaacgccgagcatatctttttcttctgttcgagatacgtagtggagagaactaccatcgaaggaataataaaccaaaggatgacgcccgacaacatagtaagtcacatgctgcgatcacagctggtgtgggcgaaaatgaaagagtgggccgcaatagcgctccaagaactcagaataaaagaaaggcagcgaagaagcataagaccacatgaataaccccggaggtaggtcgtgaagaggcagttatcgcccagcttggtcctgcgaagtagtgcttaacggcggtcccgcaggtccgaatacaagctacagcagccggagttaagggtttagtacgtaggcatactgtttcgcaagtccagcatagttatttaatactgtctgggcgtggtcccgaaagaggtgtactctagcggacaatatgaatcgtgcatgctaccagtctcaccctggcagtatctttagaagattcccccttcggaaacaaaaaaaaaaaaaaaaaa

SEQ ID NO: 58 - DNA, 5314 bp, Bactrocera tryoni
ggtaaggctgagctcaggctactaccggggtcacagctggcggatagtggacggcctacgctaagtaggttagctgcgaatagtaatacgcagcccccgaccaagagctgcaggagaggagggcttggctcaaaacgcctcacgcgcccaatgaacctcccgcgaagaggcgagaagatgccgcctttaaataagcgtccacaacccccaccggggttgcaccgagggagaacctacccacgagagggaggcaacaaagcgacgagggaacagaagacgacgaaaaaccctgggcaagagcccatcagaattgagaccagtaagattctgattatggtgtactggaaaaccgaaacggatcagattgacaaagggctggggagggcagtattctgtcacctcagtagataagagtgacatcttaccgaaatggctggcaggctaatactgctctcacctccgtctcgttaaaaccatggcaggtcttcaagtacgttcaatgcacgtcgccataatttctttggccgtacaggttcagttgagacgagctcctgattcgtgcccgaacctggctctgaacacaagctcccataaggacttgtgtcaaccctcgcgtggcctccctgcttgcatagataaccacggggttcataaagggcaactgttacaacgtgcggagatagcggcttgaagcggagacccactagaaaaaaaatgaatacaccgcaacaacaacaaaaaccccaacagaaggaacaacaaaacaaagatggccaagaagaggaatacgggacagtcttccgtagaagcagtagggtactcagatcccccgtactcatcgccactccaaaacagacagacaaaactggagaaaagacagactcaagggagactccggccacacaagcagcaccggcaaaacaaggagaagggaagagcaccccagctgccactaaagaaggaactcaaaactcgccgaaacaagagtacatcacccaaatgagacgagcagaagaggaatccctagaaaagtgcaagggtatagtgcaaaaaatgaagttggcgatggcaaagcaaaagaacgtcagcatggacgtcaagaacggagcggcacagctagacgaactcttcgacgtcataaagagctaccgcagaaactggctcaccgcagaaaacgagaaaaggcgagcacacctaagcagacgcatcacgacccccgagtcagcaacctcgaagcggcgtgcgacaagccctgtggagccgcgagaaacagtgcgaccacgacacgaaaacgacggccagtggcaaaaagttttgcctaaaaaagccaggaagacccacgtaaacgaaggaacgagtgaagaagcgcccaaaaacgcaaacaagaggcaacaagtcaacaacatggccgcaagccagaaaggaaataataggcctaaacgacaaacagaggccgttataataaaaccagcagaaggaaatagctacgccgaagtcctcaagaatatccgtagcaaggtagatcttaaagaagcagaggtcaaaatcaaagggatccgcaaaacaagagccggggccctattactagagctagagaagggacagtccacaaaggccagcttctgtgaggcacttaagtccactcttaaagagactgcaactgtggccgaccttaaaactaaggctacaatagaaatcagagacctcgactcgctcacaacaaaagaggaagtagcaggggctgtcaaagaagcgctacaggaccccaccgaagacttgacgattaacataacagctcctaacacaagagagcaggtaagggcatatataacgctggaccaggatagggctgacacactgatgcgacaggcacgcatcaaaatcggctgggttaactgcaggctgcggctgaaagaaacccccaaaaggtgcttccgctgctttggaccagggcacttaacctgggactgcaaagggcccgatagaagaggacaaggtgtttgcataaaatgcggccaaccaggtcacaaattgaaagagtgcacaaagcctccttcatgctgcctttgcgaagaggctaaacacgaaaaagtcgatcacatcccgggctccgcaaaatgcacggtatataggaattaccgaaacaaatgaatatcctacaggccaacatgcatagatgcaaggctgctgacgcactactctcgcaaatggtgatggagaacgactacgagataatcatcataagcgagcaatacaaaaagaaagagagaggtacctggctagaagatagcagctcaaccgccgctatatggctaccaccagggagtaacgccaccactgtaaacaatgggaacggcaacggtttcgtctgggccaaatgcgacctttttacagtaattagctgctacttgacgccaagcgatagtatacaggaattccaagaaaagctcgacaatatagaggacacagccaggtctatagaaggtcaattgattatcgccggagacctaaattccagagccgtagagtggggtatgccaaacacggactcgagaggaaagcgcattctagaaatggctgcgcggctaggtctaatagtgctcaacacgggaaatgcaaccacgtttagaagaccgggatgcgaggaaaccacaccagacatcaccctatcaacagaacgcatggcaggctcaataaagaattggaaagtcctggaggattacactggcagcgatcatcactacatctctttcatgatcgacactggaacaaacgctaaccagcacaggaaaaatactggaacacgaaagtggaacatttcgaagctagatacttcgaaattaatctccgcaatagacgaccaaaacccatctagcaactcccccataattgcaagaaaaactgtcgagcacacaatgcttaatataacaagagcctgtcaaaaatcaatgcccaaggcttcccacagcaaacataaagcagcagtttactggtggactgaaaatatcgcccaactcagacgcacatgcctccgccttcgcagatcctacacgagatccaggcgcagaggagccgcaccccaagaagccgagcaatacaaagcagcaaaaaaggagctgaagcacgccatcgacgacagcaaaaagaaaaaatgggaggaactacgcgaggatataaacagaaacccctggggactcgggtataaaatagtgatgaagaaactcggcgctcgagcaaagccacctgacttaaccgctgccaaaatggatcacatcgtgaacgcactattccccacacacgaaaaaagggctagtgatccagaacaaactctaagatctgcgcaaatcccccagtttacccttgaagagctgcaactagccactggcaagctcaaggccaacaaatcacccggcccggacgggatcccagcagaaatcctcaaaataatcgctgcagagcgcccggcagtactactgaatatgtacaacgcctgccttgaagccggaatattccctgaaccctggaaaaagcaacggctggtgctaatcagtaagggaaaaggagaccccaattcgccatcagcataccgtccactatgcatgcttgacacagcgggaaagctatacgaaagcctacttaaacccagactcgaagcggctatcaacgaagctggaggactgtcccctagacaacatggctttagacccggcagatcaactataggagctataaaatgcgtcattgaaagcgtagaagccgcacagcgtagatggcataaatacaaaagaatagtgttgctggcgactctagatgtccgaaacgccttcaacagcgctagatgggtggatatgatcgacgctctcgaaaaaagctttaagatacccgactacctcagggctgtggtgcggagctaccttagcaacagaaaactgctgtacgaaactaaagagggatcacgacagatagcggtcacgtcaggagcagcacaaggatccattctaggcccagacttatggaacattagctatgacgctatattaaaactagaaatgccagatgaatcgtatttaattggctacgcggacgacattgcagcagtaatcacagcaagggacacagaagaagcgcgaagaaagctgaatcaggtcatgatacggacgcaagcatggctcgactcacacaacctccagctcgctacggagaaaacagagctactgctgctaacaaacaagcacatacctctcgagataagcatgcacacgactacggatattcttaggacaaaaaaagcagtaaactacctaggcgtaagactggaccccagactaaccttctgggtacaaatccagcacgccgcaggaaaggcagcgaagatcacctctcaactgagccgattaatggccaacataggaggccccagccaagaaaagagaaagctcctaatgtcgacgacaatcagcgtcttattatacggagccgagatctgggcagacgcgcttaaaaaggaaaaccggcgtaaggtagtggccagagtgcaccgcaccgcagccctcagagttgcatcagcctaccgaacagtgtcaggcgatgcaatattagttataagcggtaatgccccaattgaccttctagcatatgaaaggaaaaagctgtgggagctaaagaaatcatccgataataacaagagcgcaatacaacaaataaggaaagatacaataacaacatggcaacaaagatgggagaatgaaagtcgcggcagatggacggccaggctaataaaagatctagacttatggacaagccgtaaattcggagaagtagatttttacacaacccagctgttatccggtcacggatacttcaaaaagtacctccacagaatgggaaaagtcgaagagccgtcatgcctatacaacgacgcgacagaagacgacgctgaacacacattctttgaatgtgtgcgctggcaaggagaacgcaccgccgtagaagacctggttggcccaataaacgcggacaatttagtcagcgtcatgttggagagtgaagcaaactgggggattatcaagaaattcgcagcaatcttgctacgcagcaaaaagcgggacctggacgcaggtgcgcagatgtaaatctctcaatgagaaaaatggaacgccaccctgaagtaatgcaaatgcggtcccagggtgggcgacggttccttagagggggggtttttagtgacctgcaagtggcacataccgctgctgtgacgatagcaccgatgatgcggaaggcattttccaccccctcacccgcaaaaaaaaaaaaa

SEQ ID NO: 59 - DNA, 4928 bp, Bactrocera tryoni
gatttagtgaagtgaggtagacgtgtttttattgagctcccgtaatttcttaacaaatttctagttctcttgatattgaaaaaataagtttttgtgtgggacgttccggcaggattgaccacctaagtggacaccagacctacgggattagataagtacactttgatttatacttatatataatcatacgcacataccttttgttttttacgcgccaatttgcaaaataaatttaatttttccccttataacagcgtgcagttaattgtatttttctttttctgccgttgttattttgatcgatcagctgttcccctcctcgtgttttcgttttccttttggtttgcgcattgccaaccatcgaaaacacaagtatcagctgttccctttttctgttctgttctgggattgccaaccgtcttgtttttagttaagcagtaaggctagggactgaacatacacagcgacgggtgttcccaaactattctttcgcagaggatatggcctctgaaaatagtattgggcgaacaccggataatcctttccgaaggatttccaaaataatgagaacgccgcctaatggtaaaaatgaggagtccgccgctgctggaccaaataagcgaggagatattgctgcccaagaaagcaaagggggcaaacctgaggagtttgaaaaagatgaaacggttagcatcttttgcagcctgagtaaaaaaattaaagaactagaaatgatgatggccggccaaaggcatattaatcaagctatgcgcgaattagtaagcagcatagtgatattacatgccaaaacggaaaaattgggaaatcaagcgagaagagttttgatagggaaaccatcgcaagtacccactattggtagagatgataataccccaaaaagaatgcgagaggcatcaggctttttaccacccacaaaaaagccaaaaaatgtaaacgaaaagccgcaattgttgtacagtggagcagcaaaattaacccaagaggaaaatacgactagtctaaacacaagtgaaagatgggtagacgtggttaaaaagaggaaaccgatggaaaagaaaataagaacaaaaccggatgccatcattataacaaagaaggaaggtgcgtcgtatgcagatattctgcgaaaaattaaaagtgacagcgggcttgaagtactgggttcaaatgtaacccatattcgtaaaacgctaaaaggagatttacttattgaactaaaaaatcgagcagacacgaaagccgaatctttccaaagcgccctggagggagtggttggagaaatggctatgatacagcccaaaacccacaacgtcacgattatgtgcaaagacctggacgaaataacaactcccgaagaaatctgcgcagcactgaaaagggagtgtggaatccaaaatctggagatatcgagtgtcaaaagtctgcgaaaaacgcgtagtggcacacaaatagcacttgtatgcatgcgtgctcaagatgctaaggccgcactcaaattgggaaaaataaagattgggtggtcgatctgtcgccttcgagaatactcgcctattcccagatgttataagtgtttccacctgggtcacatggcgcgtaaatgctgcagtttgacagacagatcttcccaatgcacacgttgtggaaccgcgggacatttagcaaaggtatgcacaaacgttccgagctgcatgctctgcaaaggggagcactcagtattgagcacgacttgcccaaagtacctcgagatgatgaagtctctaagtaaatgaggatactacagttaaacctaaaccattgcgcagcagcacaggatttgctagatcagacaatcatagaagagaacattgatgtcgccatactaagtgaacaatactcccagcgtccggaaagcacatggattgcagacaaatctggcaaggcagcaatatggtcctgcaaaggtcaaccttttaagacctgctccagagaagctcataactgcttcacatgggcgaatatacaggggatatattttgtaagttgctatgctcgtcccagcgcagcaatcacagaattcgaagatttcctcttaaggctgtctttagaaaccagaggcaaaacacctattataatagcgggtgattttaatgcttggtcaactgcatggggcagcagatgtacaaaccatcgcgggcggctaattcaagaatatctgagtcaaacgcacttaacaataatgaacaccggaacacaaaacacgtaccaaaaagggaataaaggatccataattgacattatgtttgcaaatgattcgcttagtaggcacattaagtgggcggtgtcaaacatatacacaaacagcgatcatatggcaattatagcacaaatctcgtactcccgagagccggaacttcttagcagaaacacttcccgaaagcgaagctggaagcaacaggagttcgacccagacctgtttgagctagtctggagtgcatcaaaagcatcaggtgacgacgccgcccacttggtatcgacagtgcgaaaggaactggtcgcagcatgcgatgcaacaatgcgtagaacatcacatcacaacaagcggcggcctgtatattggtggaatgaggaaatttccacgctgagaaagctttgtcactcagctagacggcgtctacagcgtaaccggggtgaaacgaacgaaaatcgccttagagaagaatttaaaagccacaagaagctcctgaagtcggcaattacccggagcaaaaaatcatgttttgagaagctctgtgaggaagcaaacattgacccttggggaactgcttacaaaatctgtatgtcgagatttaaaaataagcagcagcaacctaaagatgcctcttttatgggaaaagtcgtcgaaacattattcccgaaacacgaccggatttcatatgccaagcgacgaaacgaagctgcagagtcacccccgttagtcacggaagacgaactattggccatagcaaagaaaatcaaaaacaccaaagcgcctggattggatggcataccaaacagagccctgaaggaagctataagctcaaaacctcaactattcgctaaaatgtacaacgcttgtataaaggaagaggtattccccgactcgtggaaagtacagcgtttggttctgctcccaaaaccaaagaaaccacctgaagaaccttcatcgtaccgacctctgtgtatgctcgacacaatgggtaaagtgtacgaaagtataataagaaaccgcttggagttagcaatccagaaagccggcggattatcagagagacaatacggctttataaaaaagagatccactattgacgcactacgagaagtcgtcgatactgcgaaatgtgcagtaagtggcaaaagatggaaaggtggcacaaaaaagtactgcgcgctgattaccctggatgtcaagaatgcgttcaactcggcaaaatgggcacacataatcaaagccctggatgaaatacgggcccctgaatacctcataaacattataatgagttattttaaaaacagaaggctgatttttgatacggacgaaggcaccaagagctactctatctcgagtggagtaccccaagggtcagtgttaggcccactattatggaacctcatgtatgacggggtgctaagaagacagcaaccaacagacgtgaaactagtagcttatgcggacgatctcatggtggtagcagtggccaaacaattagccgacctgagaaataaatgtaatgagtgcttaaatggtctacgccaatggttctcttctgtgagtctgaaactggcggaggaaaaaacagaagttttactcataagcactaggaagatagaagaacgaatagagctcaccataggggagtgcgagattacttcgcagccgcaactgaagtatctgggagtaatattggattccaaattaaaatttaaagaacacctggagtattcttccggtaaagcaaacaaaatttataatgctctatcgagaatgatgaccaatagaggctgtgtgcgttccagccggcgattcttaatagcgaaagcaatgagttccgtaatactgtatgcagcaccagtatggatacaggcaatggatataaaagcgtatgctaaacaaataattgcagtgcataggctttctgcaattcgagtaataagtgctttccggactatatcaaccgacgctgctgaagtattagccagcatgccgcccattgacatccagggagatgaactcgagcgtttatatcagctatcagcgcctaaaacagtatcggcaaggacagaggagagaaacaagagcactaaaatgtggcaggagcggtggaattcctcatccaaagggcgctggacccatcgacttataccggacatccactcgtggatagacagacgacatggggacctagatttccatctgacccaaatacttagtggacatgggtgctttagaagctaccttttcagattccacaatgacattagtccgaactgtccgacgtgtacagagtatatagaagactctgaacatgtattattttattgccctcgattttcaaatacaagggaaaaactaaaaaccacactcggtggtagttttacggtcgataatttaacgacactcatgtgtcagtcgactgataaatggaaagctgttaaatggaaagctgtcagcgaagcgtcagcattcataatgacaaaactgagactttttcaacagattaggcgtccgtcagtccgcgcaatagaggagacttaaatgtcctgtccctcccacgaagtaatacttaatcggtggttccgtgggagagtcttgagttgggagtaggttaggtttagcggattaaagttccgcactccggctttcgatgcttccccctactataaaaaaaaaa

SEQ ID NO: 60 - DNA, 5992 bp, Bactrocera tryoni
  modified_base (5081)..(5081): a, c, g, or t
cattcgttagttgactgtcgacgcggatagacgtgcgtgcgcatcgttgcgatattcaaagtgttttttcggtgattttttgcgattctcttttgtgcggttatttgtttacgcgatttagttggcaccgttattgcctggcgcgtgtgcgtagcggttcggtggaattgtttgtgcgatcgcgagtagtgagggtcggtgaccgcgagtgtttttgtgcgggtacacatttttgtgcaattttgtgcatttttgtgtgccaaatcgtcgtgagtagcggtaagtaatttaattattactactgtatatacggacaacgtggtcatccacgttgttgttattggcggaagcttcgcacggttccagtgtagctccgtgttgttggcattcttgctgactggactgcctgccagtagttctgtgctgagcatctggcggttagttggctcagtgtcaggaggatctggacaggattgcccaaagggtgcaagcgtctgtccagcgttggagattgcgactcctgtgaggaccaacggtcgtaacagcgctaccgtttagcccacggtgcgattcggctcagcgccacatcggtcgactccggaccgttacggggactttgtccggccggcggccaattgagtggccttaatccgaccactggttggggttgtgggctgtgccaccgcgagcacgctataatcgaccgcttgggtggtcgctgttactgagcgggcccttgcgtgagtcgcacttttcagcgcgttcagacgcacgcacctggagagcatctgctccagaatctttctgtccgtgagccttctacgctagtggtacgccagcggatcagttcgactgaagggtgagttgggaagcgagatgcctcctggacggaagaggaggacgaaggccctcgctggaagcggagaatccgccgcttccacagtcgtggatgactccacgtcgggtggcgagggggaagcgacgggaacgacggtaaggtctccaccgcggagtaaggcgcgtttggggtcgccgcgtaatgagggcggaagcgagggagggagcgggagttgtggcgggagtgccaacgtggcctccgctgagaaggtggttacgcgtgctgggtcgccgcgtaacgtagggggtgtcgagggagggagcgggtgttgtggtgggagtgccatcgtggccaccaccgagaaagcggttgcgcgtacggggtcgtcgcgtaacgagggaggtagcggtagtgggagcgtggcccatccgtctagtacggtgggcaaaggagtgggcgtcgcgaaggagggcgctgcgaaagttgtcactcgtgtcgcgagtggcaataaagagggaacgcgggctcttccaaggggagctgttgttgttgggggtggggcagtcagccatgttgcggctgccaaacgaataacgggggagctaaacgagctggtattcgaggccaaaaatttcgatgcagggaccgcgaaggggctgatggagcttgcctcaaagtatgaggcgctcctgatgacggtcattaccgagaatgcccatcttcgcggtcaggtagatgcccttaggggaagttgtgggggacactcctcgacgccgagcaggtcaatgccggctccgtcggcaccgatgcctgcgcctccagcacctgtgctggatgcgatcacaccggtgacgccgaagcctgtggagacctggtcggtcgtggtaaggagtaaggggcctgcaacttcctctaaggaagttataaagaaggtggtcaaggaggtgggtccctcacttggtgtgagggtccacgaagttagaccaattaagggtggtggggcggttattcgcactccctctgttcttgagagggagagagttgcgaataacaagaaattcgaggaggtggggttggacgtctctgtcaaccggaagttgggtcgtcgggttgtggtccagggggttcatacggagatcccccatgaggaattcatggaggatctactccggctgaacctcaaggacttcagcccggcgtcccagaggactgacgtgaggatggtcagtcgcccctggaaggtggccgctgacggtagcaccaatgtcgtcctggagggtacggacaagttgatgtccgccctcttggagacaggtcggtgctacataaagtggttttccttccgggtgcgaccggatagccccgtcgctggctgcttccggtgtatgggttttgaccatagagtggctgagtgtagggccaaagcagatgtctgtcggaggtgcggtcaagaaggccacaaagctgccagttgcgtcaatgcaccacattgtcgcaactgtgagtttaagggtagaccagctgggcatcttatgatgtcagctgtctgccctatatattgtggcattgttgagcgcgccctcgccagacactgatgggtgggattatccagctcaactgtcagggctcttatgccgtaatgtgtgagttggggggttgcatggttgagggtgggtgcagtattgctctactccaggagccctacgccaccaatggtgtggttcggggtcttcctgggggttttaaggtcttcactgaccttagagctaacgctgcaatagttgtgaataatccacgctacgattgcgtagttgtggattcttcacaactgggtatatgtgtagctatagaaggggagttcggtaggatgattgtcgctagtttgtattgtaaatatagcgagcccctagagccctacctgggctacatggataagctgctactacttgcgagtagtagtccatttatcctagggctggatgcgaatgcctcgtcctcgatgtggtttagtaaggtatcccggcattcgtctggataccaaagccacagtcgaggcgaggcattaagcgaatgggtggtggctaaaagcctccacattttgaatgagccgagtgaatggtatacgtttgatgggcctgggggcgtaagtgacattgacgtgacgcttatgaatgaggcagcaagtagggcttttagcgttagatgggaggttaagggagggtggggattgagtgatcataatttgattcaaattatggttacccctcgatcccctccctcgccttatgagagtccattgcggcgatggcgtaccactggtactgactggaaccaatatggactctcggttagggaagcggtatcttgtataccgcttagtgagtttgaggagttgggggtggacgagcaaattgctcgtctctatgaggtagtttggggggtaaatgatagggtttttcgtaggtatgactgttctaaggttagtaaaattaaatggtggacgcgtgagctaaccttgaagaggaggactgtcaggcgattgaggcgaaagtttcaacgcgcccgacggtccaattctgataggctgtcccagcttaggtatgaatttagttgtgcggatagggaatataaggaaatgttagttaaaattaaagaggaagagtggaggagttttgttagggaaaataggaacgacccctggggtcaggtctataggatctgccggggtcgtaggagggaggatatcacctctcttcgcgtcggtgacactctgttatcgtcgtggagagagtgtgcgggggttctgttaggtgcgttctttcccaggtcggaggtgcaggtacctcaagcacaagaggtgcctgtccctccattagatgatggggagttggggtacgcctttggcctggttaggtctaaacggtccccaggttttgatggtttgaacggagagatgtgtaaaagcttatggaagttcattccggaatacctggaggccatttatgataagtgcgtctgggagggatattttccacgcgagtggaaaagtgctagggttgttcctctcctgaagtcccctgataagatcaggagcgatcctcgatcttatcggggcatcagtctccttccagtacttggaaaagtgctggaaagagtcatggtggaacggcttcaggagctaacgcggggtatgtggtcggataggcagtttgggttcaggaaaggacgcagtatagaggatgcgtggttttatgttcagaatgttgttagggagaatgtcaacaaatatgtccttggcatatttgttgacttcaagggggcgtttgattacctaagctgggatcgagtggtgcaacggctggaggagcttggctgtccggaaattactctttggcggagttatttttcggacagaaaggcctctcttgtcggcatgaatgggagtgtggagatcggagttgttcgtggctgcccgcagggttccatctgtggtccatatatttggaaccttatgatggacactctgcttgggcagctcgagccactctgtaagtgttgtgcgtatgcggacgaccttcttcttatggttgaaggtcgctcgaggtctgagttagaacgggcgggaggagatctcttagagatcgttaattcttggggtttaggtgtgggggttgacatatcgatggaaaaaacggtggcaatgctgctgaaaggtagattgtcaccggttcgtccaccgattgtccgtgtgaatggggtcagcatcagatatgtgacgcaagtcaaatatctgggactgaccatgagtgaaaggatgtgttttactccacacttggcgaatgtgaaggagcgactgcaggcaactgtaggcaaaatacgacggattttgaggagcgattggggtctcggacgtcgtgctgtccgcaccatatatcgtggcttgtttgtggcctgtgccacttatggagcccctgtatggtgggagacagccacgactgtctgggggtctcaaaaactcctctcaatccagcgttgcatgatgcttgcttgtttgcctgtatgtcgcaccgtctcaacggatgcgatgcaggtcttgttaggtgcaccccctcttgacctgattgtcatacagcgtgctgttgcattcaggttaagaaggggcttgagtgtgtcattgctgcggaatgactggatttccgacgatgatgtggagagggagggatatctagggagcaagaggctnctagatgatagggttaggtgtaggtggcaagaacgttgggacaatagtcctaacggccgagtgacgtacgagtacattcgggacgttgggttcgttgaggataacccagacttcagattttgtctgagtctgggttttctgcttacggggcatgggcctctgaatgcatttttgcatcagaggcacctatcggatacgtcggggtgtttttgtggggcggggttagaaaattggtcgcatttaattgcggagtgcccgatgtactcggacattagggatctgggtggtatggggattagctggactgatggacgattagatgttagtggtgtgatctccactagtcggaataccgaacagttagggtcgtttgcgcgtgaattatttaagcggcgaaggcggttagctggaaattagggttagtttctgtatgattggtgtgtgtaagtgatgtgtgtatggggtccaacccctggccaccagtccagagccgtatggaagctcaactggtagtagtttcggctacgaggtctgaccggagacttaattctggtaccacggggagcaggagcccttggagttcgctccaacctgctcatgcggactggcccctcggggagtatcgtggtggttgtggttaaaacccaaatgcgggaagaactgactttgtcagttgaatgtggagttgcattgcaaccgggtgccggacccaaagcacggcagaggttttagatgggcctcgaaccctaccaaggtggttagtgtgtccattccacactgccaattggtactgaaaatgcttagcattctcagggcgctgatcaacgcattgatttgatccgctgtgcttttgagcgccgtggagtaaggctgtcgtcagcaggtacccacgttaaacacaccggacgttg

SEQ ID NO: 61 - DNA, 582 bp, Papilio xuthus
ttaggttaggttaggttaggttagggtgcggtggccggtgacctcctcgtggtgcaccctggaaactccccaccttctgtggggaggctaacaaccggccggggaggggatagtgttcgcggggctataccggatagggctacccataccgggcaggcccgcgaacactacggggctcttgtcgggtcctgcggttagcgcagaccctggactgggcccaatgggcggtgtagggcgcgacgtgcaccttggtgccgtcgtgcagagcggaggggtgttttccgcggggctatgccggatagggcctcccataccggacaggcccgcgggaaacaccagtggacccttaggggtcggaggatggcggcctgctaggccgcgagtgaggggggacctcaccccgtatcaaaggcggtttccggtgtccgacaacactggaaaatcgtatgtaatggcaactcttaatttagtattaccccaggagggtacctccagcttagctggaggagaatccctccccgcggcctcggccgcgggctgcccctcgtattctggggggggcaaagactgccttacgacacc

SEQ ID NO: 62 - DNA, 592 bp, Papilio xuthus
ttaggttaggttaggttaggttaggttaggtaggggtgcggtggccggtgacctcctcgtggtgcaccctggaaactccccaccttctgtggggaggctaacaaccggccggggaggggatagtgttcgcggggctataccggatagggctacccataccgggcaggcccgcgaacactacggggctcttgtcgggtcctgcggttagcgcagaccctggactgggcccaatgggcggagtagggcgcgacgtgcacctaggtgccgtcgtgcagagcggaggggtgttttccgcggggctatgccggatagggcctcccataccggacaggcccgcgggaaacaccagtggacccttaggggtcggaggatggcggcctgctaggccgcgagtgaggggggacctcaccccgtatcaaaggcggtttccggtgtccgacaacactggaaaatcgtatgtaatggcaactcttaatttagtattaccccaggagggtacctccagcttagctggaggagaatccctccccgcggcctcggccgcgggctgcccctcgtattctggggggggcaaagactgccttacgacacc

SEQ ID NO: 63 - DNA, 3317 bp, Papilio xuthus
gagaaagcgtcaagagcaccaagagcgccagcgcgaacaccagcgccaacagcgagtgcacccaagaccgccgcggtggtggtcaccatcacgcctgaggccatggcaaatggattgacgtacgatgcggtcattgcggaggctaaagccaaaataagactgcaagacgtgggcatagcaaccggggtacgcttccgggtgtgtgccacaggagcgcggaggtttgaagtcctgggcacagacaacggccagcaagcggacgccctagccgcaaggctgacgcaaattttcaatggggacttggtccgtatctctagaccggctaagacgacggagataaaaatatccgggctggatgactcgacaaccgttgaagaggttctggcagcggctgccgaagtgggaggctgtcccaaagaaagcttcaaatgtagcggtgtcgtcagggacagatttggagtgggacacgcctgggtagagtgcgaggtgccaactgcgaaacgggtggctgcagcaggccggctcaccatatcctgggtgtcggccaccgtcacgctgcttgaaccgcgacctctgcgctgctaccgctgcctgcagaaggggcatgtaagagcgcaatgcagtgcagaggtcgacaggagtaagcagtgcttccgctgtggcgaagagggccacaacttcaaaggttgtcaggccaagccccactgctccatctgtgctgaggccaaaaaaccggcggagcacaaactgggaggcagaggatgttccgcacctgcccccaaagtcaccagagggaggaaatcaacgccgccacaaccagcacaacaggcgacaatagaggttgcaatggagacggatgaagatggcaacagaaatggctctacaaatccttcaagccaaccttaaccactgcgctcgagcacaagacctgctcttacagagcatggctgagtggtcgacgcagctggcagtagtgtcggaaccatactttgtccccaacagggatgactgggtgggagatgaggataacctcgtagcgctcatcgtgccccggtcctcgagatccccgtctcttgatggggttcaaaagggtcgcggatacgtgggcgctacagtaggaggaggaaccatggtcatcggtgtatactgtgcccccagcaaaaccctcgcagagttcgagggtcttctcgattgtatcggaaccctcattggcagaaatctcccccattccgtgctggtaatgggggatttcaatgccaagagctctgcgtggggtggttcaaccacgaatgctcggggtgcagtgttagaggagtgggccgtgaccatggggctttgtattctaaacagagggtcgagacccacgtgcgtacggccgcagggtagttcgatcgtggacgtatcgttcgcctgccctgcgactgcgagacgggtgtacggttgggaggtagtggagggtgtggagacactatccgaccaccgttacatccgtctctcattatcggagacaccatcggtcccagcacacccgggaccggagtcgcttcaccgggacaccccacggtgggtggtgaagcggctcaacacggatttactgtcggaagctgcccaggtcgaaacttggtcgcctgcggacagcacactggatattgacgaaagggctgccgcgctgcgtgcatcgatgactcgcgtttgtgatgcgtcgatgccgcggcaaggccccccaccacgaaagagacaagtgtactggtggtctgcagacatagcggcaatgcgcactgcgtgcgtggctgccagacgccagtaccagagacaacgccggagaagacagaaggacgcaatcgccgaggcaagcctacacaacatatacaaggccgcaaaacaccatctaagccgcgcgatatgcgaagctaaggacaaggcacgagaggagatgatagagaccctgaacttagatccttggggtcgtccctatctcatggtgcgagggaaactccggacgcaggcatcgcctctaacacagagcctccagccccaactggtgcgggaagtggtgacgtccctctttcccagcggagtggcacatacgccgccttacaggattccgaacaccaggaatgaaaatcctggctccgctggggaagaggtcattccaccggtcacccccggcgagtttggggctggaattcaccggctacgcgccaaaaggacggctccggggcctgatggcataccgggccgggcctgggtgctagccgcggacgtattcgaggagagagtggtggggctgatgagcgattgcctcgctcaaggtcgtttcccactgctgtggaagaacggcaccctggtcctcctaaaaaaggagggcaggcctgtcgactctccggcagcataccggccgataattttgcttgacgaggtggcgaaggtgttcgaacggattatcgccaaccggttaattggacacatgacgacgatcggcccggacctggatgccaaacaatttggcttcagggcgggcaggtcgaccgtccatgcgataatgcgggtgaaagagatagcggaggaggcaattacccagggcgacgtcgttcttgcggtgtcccttgacatcgcaaacgcgtttaacaccttgccctggagttgcattactgaggccctccgctaccatcaagtgccgaactatctacagcgcattgtgaccgactacctttcatctaggtcggtctcctacagaagcagggacgagtggactcgtcatgaggtgacatgtggcgttccgcagggctcagtcctcggcccccttctttggaatgtgggttacgactgggtgctgcggggcgccaacatcaaaggcgtggaggtcacctgctacgcagacgacactctggtgacggcgcgaggaagaacgcaccgggagtgtgcgatactcgcgacggccggagtggcccaagttgtgggcaggatacgagctctgggtctcgaggtggccctgcacaaatccgaggccctttatttccacggacctcggagcaggccacctccgggagcccacatcatagtcggcggagtgagtattccagttaactcgcacatgaagtatctaggcctcacgctggatggtcggtggacattcgagggccacttccgccagctaggccccaagctgctgcgtacggccgccgcactcggcagtttactgcccaatgttggcggccccaaagcggcttgtcggcgacgtttcacgggcgtcgtgaaatcgatggcgctttacggcgcccctgtatggagcggcgcccctgaactcccggacgatt

SEQ ID NO: 64 - DNA, 4352 bp, Papilio xuthus
gagaaagcgtcaagagcaccaccagacagtccacctaagactgctgcagtggtggtaacaattacaccggaggccatcgcaaaaggcctcacttatgacgcggtcattgccgaggccaaagcgaaaataaaactacaggacgtgggcatcacaactggagtacgcttccgggtgtgtgccacaggagcgcgaaggtttgaggtcctggggacggaaaatggcccacaggctgacgccctggcggaaaggctgatgcaaatattcgatggagagtcggtccgcataaccaggccgactaaaacggtagaaataaagatatcgggattagacgattcgtcgaccattgacgaagtattagcagcagtggccgaagcaggaggctgcgcgaaagatagcctcaagagcagcggggtagtcagagacaggtatggagtaggacatgcctgggtggagtgtgcagttccaacggcgaaacgggtggcggcggcaggtcgcctcacaatatcttgggtgactgccaacgttacgctactggagccccgcccattgcgctgctatcgatgcctgcaaaaggggcacgttagagcgcgatgcaatgcggaggttgataggagtaggctgtgcttccgctgtggggtagaaggccacaaatttaagggctgcctggccaagccgcactgtaccatctgcgcggcggcccagaaaccggcggagcacaaacttggaggtaggggatgctctgctccagcccccaaggtcaccagagggaagaagacgctgccacaaccagcacaacatcaagcgccaggagaggtcgccatggagacggacgaagacggaaatagaaatggctctacaagtactgcaagccaatcttaatcattgcgcacgtgctcaggatttactcttgcagagtatgactgagtggtcgacgcagttagctgtggtgtccgaaccttactttgttcccaacagggatgactgggtaggggacgaggaaaatctagtagcgctcatcgtaccccggtccgcgggatctccgtctattgatgggattcaaaaaggccgtgggtacgtgagcgcaacagtaggaggaaccttagtcgtaggcgtatactgtgcccccagcaaaagcctcgcagaattcgaggttcttctccatctcattggaatcctcgtaggcagaaatctcccccattccgtgctggtcatgggggattttaatgccaagaattctgcgtggggtggcgcaaccacgaatgctcggggtgcagtattagaggagtgggccttgaccctaggtctttgcatattaaataggggatcgagtccaacttgcgttcggccgcagggcagctccatagtggacttatcttttgcctgccctgcgactgcgagacgggtgtacggttgggaggtagtggaaggtgtggagacactatccgaccaccgatacatccgtttcgcactatcgatgacatcaacggtcccagcacaccagggaccggagtcgctccacagagacaccccacggtgggtggtgaagcggctcaacccggaagtactgacagaagctgcccaggtcgagacatggacacctgcggacagctcacccaacattgacgacagggctgccgaactgcgtgcgtcgatgactcgtgtatgcgatgcatcgatgccgcggcaaggccccccaccacggaaaagacacgtgtactggtggtcggcagatatagcagcattgcgcgctgcgtgtgtatctgcccgacgccagtaccaacgacaacgccgaaaacgacaaagagacgctaacaccgaggaaagtctacttaacacgtataagactgcgagacacgatttgagtcgagctatacgtgaagcaaaggacagggcgcgggaggagatggtggagaccctaaatctcggtccttggggtcgtccatacctaatggtaagagggaaactccggaagcaggcgtcgcctctgacgcagagtctccagccccaactggtgcgggaggtggtggcgtccctctttcccagcggagtggcgcacacgccgccgtacaggattccgaacaccaggaatgaaaatcctggctccgttggggaagaggtcattccaccggtcacccccggcgagtttggggctgggattcaccggctacgtgccaaaaggacggctccggggcccgatggcataccgggccgtgcctgggtactagccgcggacttatacgaggaaagagttgtggggctgatgagcgactgcctcgctcaaggacgtttccccctactgtggaagaatggcaacatggtcctccttagaaaagagggcaggccagccgaatccccggcagcgtaccggcccataattctgctcgacgaggtggcgaagttgttcgagcgtattatcgccaatcgactcgtgcaacacatggcggtggtcggcccgaacctggatgagaagcaatacggcttcaggtcgggcaggtccaccgtccatgctataatgagggttaagaagatagcggaggaggctgtggcccagggcgatgtcgttcttgcggtgtccctggacatcgcaaacgcatttaacaccttgccctggagctgtatcatcgaagccctccgctatcacaaagtgccagactacctacggcgaatagtggccgactacctctcgaatagatcggcctcctacaggagtcgagacgagtggtgccggcatgaggtcacctgtggcgttccgcagggctcagtcctcggtccacttctatggaacgtgggctatgactgggtgctgcggggcgccaacatacagggtatagacgttacctgttacgcagacgatactctggtgacggcgcggggaagctcgcaccgagagtgcgcgatcctcgcgacggccggagtagcccaagtggtgggcagaatacgggcactgggcctggaggtggccctgcacaaatccgaggctctttatttccacggacctcggaacaggccacctccaggagcccacatcattgttggcggcgtgaacatcgaaattgaggcacacatgaactacctgggcctcacgctagacggcaggtggtccttcgaggaccatttccgtaggctgagtcccaagwtgctgcgtacagccgccgcattgggtagtttactgcctaatgttggtggccccaaagcggcctgccggcgactattcacgggcgtcgtaaaatcaatggcgctttacggtgcccctgtatggagcggcgccctgaattcccggaccatcgacgtattacatcggccacagcgaactatggccataagagcgattcgtggctaccgcacagtttcctatgacgcggcctgcaccctggcgggttccctgccatgggtgctggaagcagaggtgcttgcggcagtccacgaatggcgcgagcggaaaaccctaattgacggagctccacccttaagggtggaggtcgaaaatttcaggaggacaaggcgagaagcagcggtgaccagctgggaacgtcgcctccgccagacgcgggctggggccagaacaatcggggcaatctgtccagtgttcatggcgtggctgaggaggagacacgggacggtaaccttccgattggcgcaggtgctgtcgggacatggctgtttcggcagttatctgcgccgtatcgggagggagccgtctgcagtgtgccaccactgtgacgattgccccgaggacactgcccagcacacgctggcggagtgcccggcgtgggcggaacatcggagggaccttgtggccgcagtgggcgaagatctttccctgccggccacaataaaatcaatggtcggatcggacgaagcgtggaaggcagtccaaatcttctgcgaggtggtgatcaagatcaaggaggaagcggagagggcgagagaggtgtctagtgaagacgccttgcgtagccgccgcaccggggggagaagacgggcgtatgcccggacgatcccaccgtgacaggactcgagtggtgggcagggggaagcccgccactcagaagagagttgaagaggacgcgttcgtttcccgcgcaaacagatgaggcctaagctgacgatgagctgataaggcaatcacgaccggggcgtgtgaagaatacttttcagtgtacccacgctcccggtagaaagtgaaaagaggggaacagtggtggtttagcgggtatgctcacattcggtgagagaatcccacataactaccgtgcctctccccgaggcacggagtatgcataaagcattccccactataaaaaaaaaaaaaaaaggttaggttaggttaggttaggttaggttaggttagg

SEQ ID NO: 65 - DNA, 2722 bp, Papilio xuthus
gagaaagcgtcaagagcaccaccagacagtccacctaagactgctgcagtggtggtaacaattacaccggaggccatcgcaaaaggcctcacttatgacgcggtcattgccgaggccaaagcgaaaataaaactacaggacgtgggcatcacaactggagtacgcttccgggtgtgtgccacaggagcgcgaaggtttgaggtcctggggacggaaaatggcccacaggctgacgccctggcggaaaggctgatgcaaatattcgatggagagtcggtccgcataaccaggccgactaaaacggtagaaataaagatatcgggattagacgattcgtcgaccattgacgaagtattagcagcagtggccgaagcaggaggctgcgcgaaagatagcctcaagagcagcggggtagtcagagacaggtatggagtaggacatgcctgggtggagtgtgcagttcccacggcgaaacgggtggcggcggcaggtcgcctcacaatatcttgggtgactgccaacgttacgctactggagccccgcccattgcgctgctatcgatgcctgcaaaaggggcacgttagagcgcaatgcaatgcggaggttgataggagtaggctgtgcttccgctgtggggtagaaggccacaaatttaagggctgcctggccaagccgcactgtaccatctgcgcggcggcccagaaaccggcggagcacaaacttggaggtaggggatgctctgctccagcccccaaggtcaccagaggggagaagacgctgccacaaccagcacaacatcaagcgccaggagaggtcgccatggagacggacgaagacggaaatagaaatggctctacaagtactgcaagccaatcttaatcattgcgcacgtgctcaggatttactcttgcagagtatgactgagtggtcgacgcagttagctgtggtgtccgaaccttactttgttcccaacaggggtgactgggtaggggacgaggaaaatctagtagcgctcatcgtaccccggtccgcgggatctccgtctattgatgggattcaaaaaggccgtgggtacgtgagcgcaacagtaggaggaaccttagtcgtaggcgtatactgtgcccccagcaaaagcctcgcagaattcgaggttcttctccatctcattggaatcctcgtaggcagaaatctcccccattccgtgctggtcatgggggattttaatgccaagaattctgcgtggggtggcgcaaccacgaatgctcggggtgcagtattagaggagtgggccttgaccctaggtctttgcatattaaataggggatcgagtccaacttgcgttcggccgcagggcagctccatagtggacttatcttttgcctgccctgcgactgcgagacgggtgtacggttgggaggtagtggaaggtgtggagacactatccgaccaccgatacatccgtttcgcactatcgatgacatcaacggtcccagcacaccagggaccggagtcgctccacagagacaccccacggtgggtggtgaagcggctcaacccggaagtactgacagaagctgcccaggtcgagacatggacacctgcggacagctcacccaacattgacgacagggctgccgaactgcgtgcgtcgatgactcgtgtatgcgatgcatcgatgccgcggcaaggccccccaccacggaaaagacacgtgtactggtggtcggcagatatagcagcattgcgcgctgcgtgtgtatctgcccgacgccagtaccaacgacaacgccgaaaacgacaaagagacgctaacaccgaggaaagtctacttaacacgtataagactgcgagacacgatttgagtcgagctatacgtgaagcaaaggacaaggcgcgggaggagatggtggagaccctaaatctcgatccttggggtcgtccatacctaatggtaagagggaaactccggaagcaggcgtcgcctctgacgcagagtctccagccccaactggtgcgggaggtggtggcgtccctctttcccagcggagtggcgcacacgccgccgtacaggattccgaacaccaggaatgaaaatcctggctccgttggggaagaggtcattccaccggtcacccccggcgagtttggggctgggattcaccggctacgtgccaaaaggacggctccggggcctgatggcataccgggccgtgcctgggtactagccgcggacttatacgaggaaagagttgtggggctgatgagcgactgcctcgctcaaggacgtttccccctactgtggaagaatggcaacatggtcctccttagaaaagagggcaggccagccgaatccccggcagcgtaccggcccataattctgctcgacgaggtggcgaagttgttcgagcgtattatcgccaatcgactcgtgcaacacatggcggtggtcggcccgaacctggatgagaagcaatacggcttcaggtcgggcaggtccaccgtccatgctataatgagggttaagaagatagcggaggaggctgtggcccagggcgacgtcgttcttgcggtgtccctggacatcgcaaacgcatttaacaccttgccctggagctgtatcatcgaagccctccgctatcacaaagtgccagactacctacggcgaatagtggccgactacctctcgaatagatcggtctcctacaggagtcgagacgagtgg

SEQ ID NO: 66 - DNA, 4324 bp, Papilio xuthus
  modified_base (1612)..(1612): a, c, g, or t
gagaaagcgtcaagagcaccatcagacggcccaccgaagactgctgcggtggtagtctctatcacaccggaggccatcgcgaaaggcctcacatatgacgcagtcattgctgaggccaaagcaaaaattaagctacaggatgtgggaataacaacaggggtacgctttcgggtgtgtgccacaggagcgcggaggttcgaagtcttgggaacgaacaatggcccgcaagcggacgcccttgcggagagattgacgcaagtttttagcacagacttggtccgcgtctccagaccgacgaaaacgacggaggttaaaatatccgggttggacgactcctcaaccatcgaggaagtactggcggcggttgcggaaataggaggctgtccaagagagagcctcaagagcagcggggtggtgagggacagattcggagtaggacacgcctgggtggagtgtgcagtgcccactgcgaaacgagtggctgcagcaggtcggctgaccatatcgtgggtgtcagccaatgtaacgctgctcgaacccagaccgatgcgctgctatcgatgcctacaaaaagggcacgtcagagcacaatgcaatgcagaggaagataggagcaaattgtgcttccgctgtggggtagagggccacaagtttaagggctgcatggccaagccgcactgcaccatctgtgcggcggcccaaaaacctgcggatcacaaattgggaggcagaggatgttcggctccagctcccaaaatcagcagagggaagagaacagcacagccacaaccagcacaacaggcaccagaagaagctgcaatggagacggaagaagtcaacatcagaaatggccctacacctactacaagccaatgttaaccattgcgcacgggctcaagacctgctcatacagagtatggctgagtgggcgacgcagatagctgtggtgtcagaaccctactacgttcccaatagggatgactgggttggggacgaggacagcctcgtagcgctcatcgtgccccggtccgcgagacccccatctattgatggggttcaaaagggccgcgggtacgtgggtgctacaataggaggaaccttagtcgtcggcgtgtactgcgcccctagcatgaacctcgtggagttcgaggacctcctcgaacgtgtaggaactcttgttggcagaaatctcccccattccgtgctggtaatgggggatttcaatgccaagagttctgcatggggtagcacttccaccaatgctcggggtgcagtactcgaggagtgggctttgacttcgggactctgtctcctgaataggggatcgagacccacttgcgtccggacgcagggcagttccatcgtggatttaacattcgcctgccctgcgactgcgaggcgggtgtacggctgggaggtagtggagggtgtggagacactatctgaccaccgatacatccgcttcgcaatatcgacgacaccaacggtcccagcacaccagggaccggagtcgcttcaacgggacaccccacggtgggtggtgaagcgactcaacacggatttactcatagaagctgcccaggttgagacatggtcgcctgcggacagctcnccggatttagccaataggactgccgagttgcgtgcatcgatgactcgcgtttgcgatgcgtcgatgccgcgacaaggcccccccccacggaagagacaagtgtactggtggtctgcagacatcgcagcaatgcgtgttgcatgcgttgctgccagacgccagtaccaacgacaacgccggagaagacagagagatgaaatcgctgaggcaagcttgcatgacatctataaggccgctaaacatgccctgagccgagcgatatgcgaagctaaagacagggcacgagaagaacttattgagaccttaaacctggatccgtggggtcgcccatatcgtatggttcgagggaagctccggacgcgggcgtcgcctctgacgcagagtctccagccccaactggtgcggggagtggtggggtccctcttccccaacggagtggcacacacgccgcctttcaggattccgaccatccggaatgaaaatcctgactccgttgatgaggaggacattccaccaatcacccctggcgagttcggggctgggattcaccggcttcgtgccaaaaggacggctccggggcctgatggcataccgggccgtgcttgggtactagccgcggatgtatacgaggaaagagttgtggggctgatgagcgactgcctcgctcacggacgcttccccctgctgtggaagaacggcaacctggtcctccttaaaaaagagggcaggccagccgactcccccgcagcatatagacccataattttacttgacgaggtggcaaagttgtttgagcggattatcgccaaccgcttaatcaaacacatgacgacggtcggcccagacctagatgaaaagcaatttggttttagggcgggcaggtcgaccatccatacaataatgcgagtaaagaagataacggaggaagccattgcccagggcaatgtcgtgcttgcggtgtctttagacatcgcaaacgcttttaacaccctgccctggagctgtatcatcgaggccctccgttatcaccaagtgccgaaatacctgcgccgtattattaccgactacctctcggctaggtcggtttcatacagaagtcgggacgagtggtgtcgacatgaggtcacctgtggcgttccgcagggctcagtcctcggcccacttccatggaacgtgggctacgactgggtgctgcggggcgccaacatccaaggtgtcgacgtcacgtgttacgcggacgacactctagtgacggcacgtgggagcacgtatcgagattgcgcgattcttgcaacggctggagtagcccaagtggtgggcagaatacgtgctctgggtctcgaggtggccctgcaaaaatccgaggccctttattttcatggacctcggagcagaccacctccgggagctcatatcgtagtcggcggtgtcaacatcaacatagagtcacacataagatacttgggtctcatgctggatggcaggtggacctttgagggccacttccgacagctgggacccaagctgatgcgtacggccgctgcactcggcagtttactgcccaatgtaggcggccccaaagcggcctgtcgacggttgttcacgggcgtcgttcaatcgatggcgctgtacggcgctcccgtatggagcggcgccctgaacagccggacgactgaaattttacatcggccacagaggaccatggccattagaatgatacggggataccgcacagtatcttatgacgcggcttgtaccctggcgggttccctgccatgggtgctagaagcggagatactggcggctatccacacatggcgagaacttaagatcacaacagacggagctccgcccttaagggttgaggtcgaagccttcaggaaggagagacgagaagaagcggtgtccaagtggcaacgccgcctccgccagacgcgggctggtgccaggacaatcggggcaatctgtccggtgttcatggcgtggctgaggaggagacacggggcggtaaccttccgtttggcgcaggtgctgtcggggcatggttgcttcggcagttatctgcgccggattgggagggagccgtctgcagtgtgccaccactgtgacgattgccccgaggacactgcccagcacacgctggcggagtgcccggcgtggacggaacaacggagggaccttgtggcggcagtgggtgacgatctttccctgccggccacagtaagatcaatggtcgaatcggatggagcatggagggccgtccaaacttactgcgaggcggtgatgaccatcaaagaggaagcggagagggcaagagaggcgactagccaggacgccattcgcagccgccgcaccggagggagaagacgggcgtatgcccggacgatcccaccgtgacaggactcgagtggtgggcagggggaagcccaccactcagaagagagttgaagaggacgcgttcgtttcccgcgcacacagatgaggttaaaccgatgaggagccaaaaaggcaatcacgaccggggcgtgtgaagaatacttcttagtgtacccacgcccccggtggaaagtgaatagagggaaacagtggtggtttagtgggtatgctcacattcggtgagagaatcccacataactaccgtgcctttccccgaggcacggagtatgcataaagcatttcccactataaaaaaaaaaaaaaaaaggttaggtt

SEQ ID NO: 67 - DNA, 4339 bp, Papilio xuthus
  modified_base (1466)..(1466): a, c, g, or t
gagaaagcgtcaagagtaccatcagacggcccaccgaagactgctgcggtggtagtctctatcacaccggaggccatcgcgaaaggcctcacatatgacgcagtcattgctgaggccaaagcaaaaattaagctacaggatgtgggaataacaacaggggtacgctttcgggtgtgtgccacaggagcgcggaggttcgaagtcttgggaacgaacaatggcccgcaagcggacgcccttgcggagagattgacgcaagtttttagcacagacttggtccgcgtctccagaccgacgaaaacgacggaggttaaaatatccgggttggacgactcctcaaccatcgaggaagtactggcggcggttgcggaaataggaggctgtccaagagagagcctcaagagcagcggggtggtgagggacagattcggagtaggacacgcctgggtggagtgtgcagtgcccactgcgaaacgagtggctgcagcaggtcggctgaccatatcgtgggtgtcagccaatgtaacgctgctcgaacccagaccgatgcgctgctatcgatgcctacaaaaagggcacgtcagagcacaatgcaatgcagaggaagataggagcaaattgtgcttccgctgtggggtagagggccacaagtttaagggctgcatggccaagccgcactgcaccatctgtgcggcggcccaaaaacctgcggatcacaaattgggaggcagaggatgttcggctccagctcccaaaatcagcagagggaagagaacagcacagccacaaccagcacaacaggcaccagaagaagttgcaatggagacggaagaagttaacatcagaaatggccctacacctactacaagccaatgttaaccattgcgcacgggctcaagacctgcttatacagagtatggctgagtggtcgacgcagatagctgtggtgtcagaaccctactacgttcccaatagggatgactgggttggggacgaggacagcctcgtagcgctcatcgtgccccggtccgcgagatccccatctattgatggggttcaaaagggccgcgggtacgtgggtgctacaataggaggaactttagtcgtcggcgtgtactgcgcccctagcatgaacctcgtggagttcgaggaccttctcgaacgtgtaggaactcttgttggcagaaatctcccccattccgtgctggtaatgggggatttcaatgccaagagttctgcatggggtagcacttccacgaatgctcggggtgcagtactcgaggagtgggctttgacttcgggactctgtctcctgaataggggatcgaggcccacttgcgtccggacgcagggcagttccatcgtggatttaacattcgcctgccctgcgactgcgaggcggatgtacggctgggaggtagtggagggtgtggagacactatctgaccaccgatacatccgcttcncaatatcgacgacgccaacggtcccagcacaccagggaccggagtcgcttcaacgggacaccccacggtgggtggtgaagcgactcaacacggatttactcatagaagctgcccaggttgagacatggtcgcctgcggacagctcaccggatttagccaatagggctgccgagttgcgtgcatcgatgactcgcgtctgcgatgcgtcgatgccgcgacaaggcccccccccacggaagagacaagtgtactggtggtctgcagacatcgcagcaatgcgtgttgcatgcgttgctgccagacgccagtaccaacgacaacgccggagaagacagagagatgaaatcgctgaggcaagcttgcatgacatctataaggccgctaaacatgccctgagccgagcgatatgcgaagctaaagacagggcacgagaagaacttattgagaccttaaacctggatccgtggggttgcccatatcgtatggttcgagggaagctccggacgcgggcgtcgcctctgacgcagagtctccagccccaactggtgcggggagtggtggggtccctcttccccaacggagtggcacacacgccgcctttcaggattccgaccatccggaatgaaaatcctgactccgttgatgaggaggacattccaccaatcacccctggcgagttcggggctgggattcaccggcttcgtgccaaaaggacggctccggggcctgatggcataccgggccgtgcttgggtactagccgcggatgtatacgaggaaagagttgtggggctgatgagcgactgcctcgctcacggacgcttccccctgctgtggaagaacggcaacctggtcctccttaaaaaagagggcaggccagccgactcccccgcagcatataggcccataattttacttgacgaggtggcaaagttgtttgagcggattatcgccaaccgcttaatcaaacacatgacgacggtcggcccagacctagatgaaaagcaatttggttttagggcgggtaggtcgaccatccatacaataatgcgagtaaagaagataacggaggaagccattgcccaggacaatgtcgtgctcgcggtgtccttagacatcgcaaacgcttttaacaccctgccctggagctgtatcatcgaggccctccgttatcaccaagtgccgaaatacctgcgccgtattattaccgactacctctcgactaggtcggtttcataccgaagtcgggacgagtggtgtcgacatgaggtcacctgtggcgttccgcagggctcagtcctcggcccacttctatggaacgtgggctacgactgggtgctgcggggcgccaacatccaaggtgtcgacgtcacgtgctacgcggacgacactctagtgacggctcgtggaagcacgtatcgagattgcgcgattcttgcaacggttggagtagcccaagtggtgggcagaatacgtgctctgggtctcgaggtggccctgcaaaaatccgaggccctttattttcatggacctcggagcagaccacctccgggagcccatatcgtagtcggcggtgtcaacatcaacatacagtcacacataagatacttgggtctcatgctggatggcaggtggacctttgagggccacttccgacagctgggacccaagctgatgcgtacggccgctgcactcggcagtttactgcccaatgtaggcggccccaaagcggcctgtcgacggttgttcacgggcgtcgttcaatcgatggcgctgtacggcgctcccgtatggagcggcgccctgaacagccggacgactgaaattttacatcggccacagaggaccatggccattagaatgatacggggataccgcacagtatcttatgacgcggcttgtaccctggcgggttccctgccatgggtgctagaagcggagatactggcggcaatccacacatggcgagaacttaagatcacaacagacggagctccgcccttaagggttgaggtcgaagccttcaggaaggagagacgagaagaagcggtgtccaagtggcaacgccgcctccgccagacgcgggctggtgccaggacaatcggggcaatctgtccggtgttcatggcgtggctgaggaggagacacggggcggtaaccttccgtttggcgcaagtgctgtcggggcatggttgtttcggcagttatctgcgccggattgggagggagccgtctgcagtgtgccaccactgtgacgattgccccgaggacactgcccagcacacgctggcggagtgcccggcgtggacggaacaacggagggaccttgtggcggcagtgggtgacgatctttccctgccggccacagtaagatcaatggtcgaatcggatggagcatggagggccgtccaaacttactgcgaggcggtgatgaccatcaaagaggaagcggagagggcaagagaggcgaccagccaggacgccattcgcagccgccgcaccggggggagaagacgggcgtatgcccggacgatcccaccgtgacaggactcgagtggtgggcagggggaagcccaccactcagaagagagttgaagaggacgcgttcgtttcccgcgcacacagatgaggttaaaccgatgaggagccaaaaaggcaatcacgaccggggcgtgtgaagaatacttcttagtgtacccacgcccccggtggaaagtgaatagagggaaacagtggtggtttagtgggtatgctcacattcggtgagagaatcccacataactaccgtgcctttccccgaggcacggagtatgcataaagcattccccactataaaaaaaaaaaaaaaaggttaggttaggttaggttaggtta

SEQ ID NO: 68 - DNA, 4569 bp, Papilio xuthus
  modified_base (1514)..(1514): a, c, g, or t
  modified_base (1516)..(1517): a, c, g, or t
gagaaagcgtcaagagtaccatcagacggcccaccgaagactgctgcggtggtagtctctatcacaccggaggccatcgcgaaaggcctcacatatgacgcagtcattgctgaggccaaagcaaaaattaagctacaggatgtgggaataacaacaggggtacgctttcgggtgtgtgccacaggagcgcggaggttcgaagtcttgggaacgaacaatggcccgcaagcggacgcccttgcggagagattgacgcaagtttttagcacagacttggtccgcgtctccagaccgacgaaaacgacggaggttaaaatatccgggttggacgactcctcaaccatcgaggaagtactggcggcggttgcggaaataggaggctgtccaagagagagcctcaagagcagcggggtggtgagggacagattcggagtaggacacgcctgggtggagtgtgcagtgcccactgcgaaacgagtggctgcagcaggtcggctgaccatatcgtgggtgtcagccaatgtaacgctgctcgaacccagaccgatgcgctgctatcgatgcctacaaaaagggcacgtcagagcacaatgcaatgcagaggaagataggagcaaattgtgcttccgctgtggggtagagggccacaagtttaagggctgcatggccaagccgcactgcaccatctgtgcggcggcccaaaaacctgcggatcacaaattgggaggcagaggatgttcggctccagctcccaaaatcagcagagggaagagaacagcacagccacaaccagcacaacaggcaccagaagaagctgcaatggagacggaagaagtcaacatcagaaatggccctacacctactacaagccaatgttaaccattgcgcacgggctcaagacctgctcatacagagtatggctgagtgggcgacgcagatagctgtggtgtcagaaccctactacgttcccaatagggatgactgggttggggacgaggacagcctcgtagcgctcatcgtgccccggtccgcgagacccccatctattgatggggttcaaaagggccgcgggtacgtgggtgctacaataggaggaaccttagtcgtcggcgtgtactgcgcccctagcatgaacctcgtggagttcgaggacctcctcgaacgtgtaggaactcttgttggcagaaatctcccccattccgtgctggtaatgggggatttcaatgccaagagttctgcatggggtagcacttccaccaatgctcggggtgcagtactcgaggagtgggctttgacttcgggactctgtctcctgaataggggatcgagacccacttgcgtccggacgcagggcagttccatcgtggatttaacattcgcctgccctgcgactgcgaggcgggtgtacggctgggaggtagtggagggtgtggagacactatctgaccaccgatacatccgcttcgcaatatcgacgacaccaacggtcccagcacaccagggaccggagtcgntnnaacgggacaccccacggtgggtggtgaagcgactcaacacggatttactcatagaagctgcccaggttgagacatggtcgcctgcggacagctcaccggatttagccaatagggctgccgagttgcgtgcatcgatgactcgcgtttgcgatgcgtcgatgccgcgacaaggcccccccccacggaagagacaagtgtactggtggtctgcagacatcgcagcaatgcgtgttgcatgcgttgctgccagacgccagtaccaacgacaacgccggagaagacagagagatgaaatcgctgaggcaagcttgcatgacatctataaggccgctaaacatgccctgagccgagcgatatgcgaagctaaagacagggcacgagaagaacttattgagaccttaaacctggatccgtggggtcgcccatatcgtatggttcgagggaagctccggacgcgggcgtcgcctctgacgcagagtctccagccccaactggtgcggggagtggtggggtccctcttccccaacggagtggcacacacgccgcctttcaggattccgaccatccggaatgaaaatcctgactccgttgatgaggaggacattccaccaatcacccctggcgagttcggggctgggattcaccggcttcgtgccaaaaggacggctccggggcctgatggcataccgggccgtgcttgggtactagccgcggatgtatacgaggaaagagttgtggggctgatgagcgactgcctcgctcacggacgcttccccctgctgtggaagaacggcaacctggtcctccttaaaaaagagggcaggccagccgactcccccgcagcatatagacccataattttacttgacgaggtggcaaagttgtttgagcggattatcgccaaccgcttaatcaaacacatgacgacggtcggcccagacctagatgaaaagcaatttggttttagggcgggcaggtcgaccatccatacaataatgcgagtaaagaagataacggaggaagccattgcccagggcaatgtcgtgcttgcggtgtctttagacatcgcaaacgcttttaacaccctgccctggagctgtatcatcgaggccctccgttatcaccaagtgccgaaatacctgcgccgtattattaccgactacctctcggctaggtcggtttcatacagaagtcgggacgagtggtgtcgacatgaggtcacctgtggcgttccgcagggctcagtcctcggcccacttctatggaacgtgggctacgactgggtgctgcggggcgccaacatccaaggtgtcgacgtcacgtgttacgcggacgacactctagtgacggcacgtgggagcacgtatcgagattgcgcgattcttgcaacggctggagtagcccaagtggtgggcagaatacgtgctctgggtctcgaggtggccctgcaaaaatccgaggccctttattttcatggacctcggagcagaccacctccgggagctcatatcgtagtcggcggtgtcaacatcaacatagagtcacacataagatacttgggtctcatgctggatggcaggtggacctttgagggccacttccgacagctgggacccaagctgatgcgtacggccgctgcactcggcagtttactgcccaatgtaggcggccccaaagcggcctgtcgacggttgttcacgggcgtcgttcaatcgatggcgctgtacggcgctcccgtatggagcggcgccctgaacagccggacgactgaaattttacatcggccacagaggaccatggccattagaatgatacggggataccgcacagtatcttatgacgcggcttgtaccctggcgggttccctgccatgggtgctagaagcggagatactggcggctatccacacatggcgagaacttaagatcacaacagacggagctccgcccttaagggttgaggtcgaagccttcaggaaggagagacgagaagaagcggtgcccaagtggcaacgccgcctccgccagacgcgggctggtgccaggacaatcggggcaatctgtccggtgttcatggcgcggctgaggaggagacacggggcggtaaccttccgtttggcgcaggtgctgtcggggcatggttgtttcggcagttatctgcgccggattgggagggagccgtctgcagtgtgccaccactgtgacgattgccccgaggacactgcccagcacacgctggcggagtgcccggcgtggacggaacaacggagggaccttgtggcggcagtgggtgacgatctttccctgccggccacagtaagatcaatggtcgaatcggatggagcatggagggccgtccaaacttactgcgaggcggtgatgaccatcaaagaggaagcggagagggcaagagaggcgaccagccaggacgccattcgcagccgccgcaccggggggagaagacgggcgtatgcccggacgatcccaccgtgacaggactcgagtggtgggcagggggaagcccaccactcagaagagagttgaagaggacgcgttcgttttccgcgcacacagatgaggttaaaccgatgaggagccaaaaaggcaatcacgaccggggcgtgtgaagaatacttcttagtgtacccacgcccccggtggaaagtgaatagagggaaacagtggtggtttagtgggtatgctcacattcggtgagagaatcccacataactaccgtgcctttccccgaggcacggagtatgcataaagcattccccactacaaaaaaaaaaaaaaaaaaaaaaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttaggttagtag

SEQ ID NO: 69 - DNA, 4384 bp, Papilio xuthus
  modified_base (120)..(123): a, c, g, or t
  modified_base (1483)..(1483): a, c, g, or t
  modified_base (4277)..(4277): a, c, g, or t
  modified_base (4280)..(4280): a, c, g, or t
ggttaggttaggttaggttaggttaggggtgcggtggccggtgacctcctcgtggtgcaccctggaaactccccaccttctgtggggaggctaacaaccggccggggggggaattccgtnnnnctataccggatagggccacccataccgggcaggcccgcggaacgatggggagcgcggcagggcaggtcaactcggccaccctgtcgggcaatcgtcgaggatgtgtggcagcacaataacttgcagaggacttcggtcggtgtatggcggccttcatggctcgcggcgcggcagggtcggtcaacccggccaccctgtcgggcgtaaggtcgagggcgtgcagcagcacgttaaactgctgaggacttcggtcggcggacggtgaccttcaaggttgcgcatattggtcggggacctcaccctgcttcgaaaaggcggtttccggtgtccgacaacaccggaccaacccagcatgatggcaagtttaaagacgaatttaccccaggagggtaccaccagctccgctggtggagaatccctccccgaggccactttggcctcgggctgcccctcgtactctggggggggcaaaaactgctttgactgcacgacgactttggccttgaatatggatactgatgcacgcgatgtggaagtgacggggagtggaatggaagaggagatggagctggacacggagttgatgttgagcgaggaatcgacatcaatgtccgagagcagtcgccgagccagccccctgccaaggaagaggagaggacgaccgcccactacgggccactatgtcggtctggccaaagctaagttggccctcatcgaggctgaacgggaggaggaacgaaggagagcggaggcggaagtagtcgctgcctcgcgcgtggcccgggctagatcccaagcccaccggctgtcggagacggccactgaagatgaggagttccaggcggccggttccctcggtcaagtgatagaggagaacatagaggtcatcaagaagatggccaccacgtctaagaacttgaaagggggatacgtgcgagccctaaaggacgcagcggaggaaatcactaagatgacaaaagctctacaaagaagaactacatcggaagagacaaagggattacaggcggataatgctcgcctgcgagccgaggtagcacagctgcgcaaggaggtggcagagatgaagaagcatctccttgcaccgaacgagaggtcagaggttgcagttgaggccaggcggcagcctgaaccacagccgcaaagacaacctaacgacagcgaggagcttgtgcgcaccatattatgccaggtgggcaatatgataaacgcaaggtttgaggcgctgcaagaccggctcctcccggagaaacgactccgtccccagctggcggcggacaacaggcctgtgtccgagagtcgcggtgcaccggaggtcctaaaagcggcgggtaaagccaanggcaaaacctcgggaaaagttccgaacaaagccccgagcaaaccccccaaggagaagacgacggcggagccccaggcccaaccacagccaacggcggcggtggaaccggcagaccatcagcccaaagagctgccctggacccagtggtcaaaaaagggcttaagaaaaagaagaaggacagaccgcgggtgtacacaaacaccgaaagagagaaagcgtcaagagcaccatcagaccggccacccgaagactgctgcggtggtcgtctccatcacaccggaggccatcgctaaaggcctcacatatgacgcagtcattgctgaggccaaggcaaaaataaagctacaggatgtgggaataacaacaggggtacgctttcgggtgtgtgccacaggagcgcggaggttcgaagtcctgggaacgaacaatggcccgcaagcggacgcccttgcggagagactgacgcaagtttttgacacagacttggtccgcgtctccagaccgacgaaaacgacggaggttaaaatatccgggttggacgactcctcaaccatcgaggaggtactggcggcggtggcggaaataggaggctgcccaagagagagcctcaagagcagcggggtggtgagagacagattcggagtaggacacgcctgggtggagtgtgcagtgcccactgcgagacgggtggctgcagcaggacggctgaccatatcgtgggtgtcggccaatgtaacgctgctcgaacccagaccgatgcgttgttatcgatgcctacaaaaaggccacgtcagagcacaatgcaatgcagaggaagataggagcaaactgtgcttccgctgtggggtagagggccacaagtttaagggctgcatggccaagccgcactgcaccatctgtgcggcggcccaaaaacctgcggatcacaaattgggaggcagaggatgttcggctccagctcccaaaatcagcagagggaagagaacagcacagccacaaccagcacaacaggcaccagaagaagctgcaatggagacggaagaagtcaacatcagaaatggccctacacctactacaagccaatgttaaccattgcgcacgggctcaagacctgctcatacagagtatggctgagtgggcgacgcagatagctgtggtgtcagaaccctactacgttcccaatagggatgactgggttggggacgaggacagcctcgtagcgctcatcgtgccccggtccgcgagatccccatctactgatggggttcaaaagggccgcgggtacgtgggtgctacaataggaggaaccttagtcgtcggcgtgtactgcgcccctagcatgaacctcgtggagttcgaggacctcctcgaacgtgtaggaactcttgttggcagaaatctcccccattccgtgctggtaatgggggatttcaatgccaagagttctgcatggcgtagcacttccaccaatgctcggggtgcagtactcgaggagtgggctttgacttcgggactctgtctcctgaataggggatcgagacccacttgcgtccggacgcagggcagttccatcgtggatttaacattcgcctgccctgcgactgcgaggcgggtgtacggctgggaggtagtggagggtgtggagacactatctgaccaccgatacatccgcttcgcaatatcgacgacaccaacggtcccagcacaccagggaccggagtcgcttcaacgggacaccccacggtgggtggtgaagcgactcaacacggatttactcatagaagctgcccaggttgagacatggtcgcctgcggacagctcaccggatttagacaatagggctgctgagttgcgtgcatcgatgactcgcgtctgcgatgcgtcgatgccgcgacaaggcccccccccacggaagagacaagtgtactggtggtctgcagacatcgcagcaatgcgtgttgcatgcgttgctgccagacgccagtaccaacgacaacgccggagaagacagagagatgaaatcgctgaggcaagcttgcatgacatctataaggccgctaaacatgccctgagccgagcgatatgcgaagctaaagacagggcacgagaagaacttattgagaccttaaacctggatccgtggggtcgcccatatcgtatggttcgagggaagctccggacgcgggcgtcgcctctgacgcagagtctccagccccaactggtgcggggagtggtggggtccctcttccccaacggagtggcacacacgccgcctttcaggattccgaccatccggaatgaaaatcctgactccgttgatgaggaggacattccaccaatcacccctggcgagttcggggctgggattcaccggcttcgcgccaaaaggacggctccggggcctgatggcataccgggccgtgcttgggtactagccgcggatgtatacgaggaaagagttgtggggctgatgagcgactgcctcgctcacggacgcttcccccctgctgtgaagaacggcaacctggtcctccttaaaaaagaaggcaggccagccgactcccccgcagcatatagggccataattttacttgacgaggtggcaaagttgtttgagcggattatcgccaaccgcttaatcaaacacatgacgacggtcggcccagacctagatgaaaagcaatttggttttagggcgggtaggtcgaccatccatacaataatgcgagtaaagaagataacggaggaagccattgcccagggcaatgtcgtgcttgcggtgtccttagacatngcnaacgcttttaacaccctgccctggagctgtatcatcgaggccctccgttatcaccaagtgccgaaatacctgcgccgtattattaccgactacctctcggctag

SEQ ID NO: 70 - DNA, 5215 bp, Blattella germanica
ttttttttttataatatcaatttgttgtaatttcttataagataagcccatatgcaaagagtctaatctccttcccttaatactactaatttgaaatgtcttgttaaatggtcgcctcaacaaccagcaagaatttcgaaatgaaatggcgactataggtaccggtaaaacatttccacattactcatacagcataggcctacgtcataacttacgtcattaatacacgtaatagactttctagtgaaactccactttgcttgtaactcaaagtaaaagtcccatttatgtttgaacgctcggtatactatagaaaggaaatatttactgaccggtatctacaaacaaattcaaatcaccacccagaccaaaaacgagtcagaaatcaatacacacaaacgaaacacatggaatagggaaatacagaaattacctgaacacttgtgggggaaaaaggagttaagatggcggaagaagcgggtggtgaaattgtagcggtcgtgatcgatcatctgaataaagtgaaagaggctctccagtcgagacacaatatggaaaaaaccataaaggaagaagcattgcactcggtaagtgaaataaacaacttattgaacaagctaagtggcatgtttttaggtctggaatgtaccctaaaaaaggcaataacatcaggcgctacggggaccccacgactttacagtgaacaactagtggcatctgttgacgccggcgggacccgcaagacccatacctaccctcccctgacacctagcggagaccaacccgaaacagcaggaataataatcacgcccacggacccgaacatgaaacaagacagcattaagcaaattattagagaaaccatagaccccaaatccctgaaagtcggggtaagtaaaatgaagaaattaagcaacaactccctatttgtggaatgcaacagcaataccgaccgcgaaatactggaaaaggaattatccaaactggagaccctctccacagagcgcccaaaaaagaaacttccagcaatgcttctgaaattcgtaccacagcacattgaaaattccgaaatccaagatataattctgcaacaaaacgatctcatgcatttggcaaatccagagatcatcgtaaaatttacaaaaaagtcatttgacgattctaggcacgtagttatccaagtcagtcctcacctacggaaggaactgctagcaaagcaaaggattaaaatgaaatggagcatgtgcagaatagaagactttgttatagtcactagatgctacaaatgcttgggctatgggcacactaaaaatttctgtaccaacaaacaaacttgctcaaactgcgccgaagaacacgactggagagaatgccgtaacacacaacacaaacgctgcgtcaactgcgtcagagcaaacaccctaatcacaaacaacaataagaaactggatacaaatcactccgccataagccaatcatgtcccagactgaaaagaatagactccataataataaacaagaccgaatattaataatggataagctctcttatgcacaattaaacactcaccactgcaaagctgctatggcacatctctcactgtttttaaatcaaaacaacatagacatattattaaatcaggaaccttactgttacaatggaattccctgcttcactcccttaaattacacactttactacatcgtctccaacaacgaccccagggcctgcatctacataagaagtgcaatagcacataattttactctacttcacagcttctccacgccagatgacattatcgtcatgttagctaccaatccctctctctatattgccagttcttacttacctccctacgacacactagaacgagatctccaacccatagaagcttttttaaattctatcaaccccgtaaacttcatctgggggctcgactcaaactgtaagcacgacatgtggtatagtccagtcacagacgcaagaggcaggacgctagtagacttcctcacagcacacagcttgctcacggtaaatgaaaaggacggtcccactttctccggggcacagggagatagttggattgacatcacaatcacatccatcaacgcagctcacagagtcctgaactggcaagtcagagaagaagaatcacaatcagaccacaacattataacatacgaactactgtttcccaacactcctaagaagtttatcaggcaggctactaattccactcgacaattcgccactcaagcaggtaactggaaactatttcagcataatataaattctaacagcaaactatggacaacccagataaataatgcaactacaagcctacaactgaacgaagccatcgaaaccatatggcaccaactacaggaaataaatagaggctgcttcccaccgttcttacctacagccaactttaagccttggtggtcccctgagataaatattctcagaaaacaagtaaacgcagcaaaacgcagagcaaagaaatgcaaaaacccaacactcaaggacatatacaataccaagtataaagccctaagaaaacagtataaagaggcactgtgtaaagcaaagcaagaawcctggaaaagcttctgcactgagagtataaaagagtctccttggaaaatctayaaaatctgcaaatcaggcttygccaaaagaccacctccatctacactaacccgaatagatggatcctctacttcrtctgaggctgatactgcaaaagctattctggataaattcctcccggatgatatccctgctctcgatagcaatgaacaaccggatcatcagaacattaaacttagaaaaccaggcctcccgacacatcatctgaaccagagttcgaggatcatgaaattgaagaaattgtacacacttaacgacaaaaaatgccctggcccagacggaattgatggaaccatcgtcaaaaacatacatatgatagcacccaacctatggaagacaatattcaataaatgtcttaacctaggatgctttcctaaagtatggaaaacggcaagtgtgatcgcaattcccaaaacggacaggagcaaactacaatcggtatcaggatatcgaggaatcagcctactatcaattccggggaaatgtctggaaaaactgattatggaaaggccaaactatttccttcaatcaaacaatctaatagcttcacaacagtatggtttcacagcaggtaaatctactactatggatgccataaaagcagtctctaattatgtgcaccacagcaaaatgcttggtctgagaagctgccttcttaccctagacatcgtcggggcttttgacaatgcttgggcacccagcatcctagctcgcttaagggaacaaaagtgcccctccaatatttataacattattgtagatcatctacaggatcgtacagcccacattactctagacaacacttcgatctcaaaagcagtcagtaaaggctgtccccagggatcggtcgcagggcctaccctgtggaacgtcattgtcagcaccctaatatccacagttagccgatataccaacatgcatattgtggcttatgccgatgacataatgctcatgttcagaggtacttccaactctcaaattctctccacgctccagttagcactacaaattacgcaggactggtgtagcaaaaaaaactggaaatcgccaaggacaaatcagcatgatgccattgttcgcgaggaagaaggaagaatacatcagtcaacccacagtcaaagcgtgggaattcaaagtagtataaaaaataagtacctaggcgtaatgttggacagtaaaattgactggtacccccacatactttacctagaaaataaagtaacacacatccgaaacagcctagtgagatgctccagaactacatgggacatttcctattcccatctgatgacgatctacaatcgtgccattctcccggtaatactgtatgcagcggaggcctggagtatttctacatcccaaagggccagactcaagctgcgtctaattcaaagatcctttctgatatttgcaacgaaagcttataaaacagtctcaaacaacgctctgcaagcaatcgcctgtgccatgcccatagacccagccatacacttacataatgacataagagccatttcgagaggtcaagctacaaatgcagtaatccctatactaaaaagaacagaaatcccaacaagatcgaaaggcatccaccccaaagacaaccacatagatattgacacctcaggaatggtaggaaaggcagaaattctcattttcacggacgggtcgaaaaccgaaagccatgttggtacaggaatggtggccatggaaaactcgaaagagatcttcactggaataagacgacttgacctagaatgctcagtcttccaggctgagcttctgggtatttatatagctacagagtggatagagcaacagaaaaaagtcacctcaagttacgctattcacgtcgactcgaaagccgccctattcgccactgccaacaggaaaactacccacccgttagctgttcaaattagagaaaaaatcatcaccctcaagaagtcaaacacaattactctccactgggtcaaaggtcatgcaggactcggcgggaacgaaagagccgactatcttgcgaaaattgctgccagtcacaagtctaccatagattacacatccattcccataacccggagtaagcagctgttaaccgaatattacaacacaatttggaattcaatctacacccgatccaacgatgcatcccacaccaaacatttcatccctaacatccctcacagaatgtccctatctatctggcccaatcacatgaccacccaatttctaaccaatcacggccgatttcaatcctacctccacagaatgcacataagagcttcaccgttatgcagctgccctgaaaaacctccacagacaactttacacttgattacagaatgcagtaacttcgcaagagatcgaccacctgtactacattcagctccactgccaatggttttgaagactcacttccaaacagttgcagtttcagagttcctcaagaacatcttccgcacacttgtataaatacggacttaaatatgtaactctacaatgtaaatatcccgtgatatacccatgggtggaacacgggttgtaaataaatgtacaaaa

SEQ ID NO: 71 - DNA, 5597 bp, Blattella germanica
caaaatattgaagccatatttagcccattcttcatttatgttttttaaatttcatttttctgtaaaaggtctacaacaattattaggccaaaaatattactttcattctacaaatctacctgttattaggctatattatatttatttttatggaaggtcagaataacaaggaagtttattgtttatatcaaattcacaaaacataattagttaattactgaagagaatattgaaaaaatgtaaaaccaaaaaaatatatatatgtaatgaaaaaacaaaaagaaataaagaacgggacatttgcgtcgcgataaaaaaaataggcgtttgtgggattcgatccgacacataccgtaaccgtaaacagtaagccgacacgataccaaagagctatcggtctcttccttctggcgcaacaatcagatacttagttgaagaataaacattaaacctgtaacaacagatactggacggcacatccactcgctcgtgacaaccgcgcttcaggacttacaaaaatatagccgggcaatctttttgcctctcactgtacatgctggatccggccagcaagatggctgacgatgtagaagatgtgttggatgggtctcttgataatttagtgactgtcactgaaaaaagcggcaatctaaaaaaaggaccgaaggaccttattctaaaatctgtaagtaacattagaaaagtagttacagagcttagaacttgcgtagaaaaaagtaacatagagaaaaatgcattgcatgctaaagttaaggaaactgaaaaacagttacaagaggagaggaatctgcgcttgaggtcgagacaagtggtgccatctcttggtgctaaggatactcacaccactgccgaatcccagcctagcccttcatctagcggagttcagcagaagttatattcggaagtggctggctcagtcgcacagaagactgagaaaagatacaaacttatggtgagctcgaaaattaaagaatcakcggaatcagtaaacgcaacattgaagagtaaaatagacccaacagcaataaaggttggcataaaaaccttaaaatcaatgaaggatgaaagagtgcttattgaaacaggaagtaaggaagaaatagacgctttaaatgcaaagatcaatgactgttgcagtcaaacgttggaagcaaaagttgcgaaactgagaaatcctaatctcataatatataatatccccaacgacatcaagaaagatgatgccaatgaaattattataatgcagaatgcagaaatagcactaaaagaagaagacatcacacctaaatttatgtttcgaaacaaaagaaacaatctgaacttggtagtagaagtaacacctaagacacgtaaaaagctactggaacacaagataaaactgggatggcaaatatttagggcagaggattatattattgttcctctgaaatgtttcagatgtagccgcttccatcataaacaaacaaaatgtgagggagaagtaacttgccctctgtgtgcaggtagtcacacattaaaagagtgcaaatctccggccacggaattcaaatgcataaactgcataatctataacaggcacaataaaggagaaaaaatctgtgagaatcatacagccctaactaaaacttgcccgagctatctagcggcaattaggaaatgtatagaaaacactgactactagaaaatggcgcacacgcccaatactcttatatgcttacagtttaacctccaacattcgaggccggcaacgtataatctcactcaactagtcacagaactaaaaactgttatcgccctactacaagaaccctacttattcaacaataaacctacaggatttccatcaaaacacagactatttttctctggtaaaggaaaatgcagatcggcaatattagtactgaatagaataattgatgcactcctaatccatcagctatctgatgaagacacaacggttcttgaaatcaaacatggaaagacgagtctcgtcgtagcaagtctctacttcgacataaagagaaatactgtaatagaaatagatttgtataaacttactaaaataatacaatttgcaaaaggaagaggcttaataataggagtagacacaaatgcaagatcacgactctggtatgacacaattactaacataagaggtagaattctagaagaatttattatagaaaacaaattatttatcatgaacgaggataacggacggcccaccttccaatctaatcaaggcgctagtaaaattgacttgactataagtaatcaaacactacttaaagaaataaggaattgggataatgatatcgaagaaagctgttcagaccacagtgtaattaccttcacggtaggacactccgatggaacacagcatgtaaacttccaaggcccaaggtacatagttaaggaagaggactacttccggttcgacgcaaactgtatcaaggaggttaaaaaacaaatgaactgtgagggtaaagatttgtgccaactagatagaaacatggagaacctggtaatacagcagctggatgtagaagaaatggtcaacaagctacaaacaacaataatcgaatcttgcaagcaatcattcaaatgtcgttcacaaaacaaattaatcaacaccaagtctgttccttggtggtctactgagttgactattatgaggaagcatgtcaatgctcacagaagaaggttccagaggacaacaggaggcaacgaactgcgccaaacaagaaaaataaagtaccaagaagctaaaagacaatatcagaacgttatcaaacatgaaaaatttaaatcgtggaaatattactgtaatgtcaccacaacttctaacccctggaatgcagtctacaagttagcggcggggaaaactagaaaaaataccacatcatcaaccctaaagaagaccgatggaacatatacaacagatttagccgaaacgatgaactacgtcatcgaccaattcactcaggaagatactgaaatcacggacaacgaataccacaaacggattagaaataaagtaactcagccgccatccacgatcgatgacagaccattcacaagcaatgaaattggcgaaataattaaaacatggatggcaacaaagctccaggtgagaacggagtcacagcagatagtacttctacacgtctttcacatggtcccgtcctatctaactgcagtgtacaacaagtgtctggcagctggtacgtttccgtcccatggaaaagagccacgcacgattgtcctaatagttaaaccgggaaaagagagctccgaagaacccagcaaataccggcctatcagcctaataaatgttgcggcaaaggtcttggaaaaactatttattaatagaataatgtatcacacatactcaaatcagttgcataatcagaaccaattcggcttcacaccacaaacaagcaccattgacgccataatggcaatgaaggacttaatagaagagagcttgaatgacaagagaagcgtcgctatgattagcctagacgtggaaggtgcctttaacagtgcgtggtggcctgggatacttcatgcattaaaagaatttcgctgccccaaaaatctatataatctaacaagaagttacctcgccgatagattatgctccctaacactaaacaacataaaagtagaaagaaaagttagcaaaggatgtcctcaaggatcgtgttgtgggcctggtctatggagcattcaatatgactccctactaaatctaaattacaaggcagatactaaagttattgcgtttgcagacgacgtattagtcctcgtcaaaggccaaagtgtattagaaatcgaaaacaaggttaacatagaaatgaacaaaatttcatattgggcaaaagaaaacaaaatgtcgtttaatgcgaacaaaacacgagcaatgcttatctcaagaaaaaacccgaagactccacaattattaaatatttaccttaataacgggaggattaggcaaaccgacagtatgaaatacctcggaatcctaatagacaaacgtttcagatttgctcaacacgtggaatatattacagataagtctataacattagtgcatgcactggcaaagtctgcgaagattaattggggtctgaattcagatgttacaaaaatactctacaagggagcaatcttacctatactttcgtatggaatccccgtatggatagaagccctaagatcacagcacaacatcaggaaacttaaaagggcacagcgtatgattaacattaagattgctaaagcattcagaagtacatcgcacgaagcactttgcatactaactggaatgactccaatcgtctatgaactcactgccatatccaaattctatagtgtaacaaaaggaagaattggagactctgtaggaaatgcatcactggacacaccagtaaactatagagattggcctcatccttccctaaaagttaaagttgttgaaaaatcagaagaggaatattattcagtccagatttacacggacgggagtaaaactgataaaggagtaggggccggagtagtaatctaccaccaggaaggagcgcctcaggaacttcgtttccgcctaggaagtagatgctcgaacaatcaagctgaacaggtcgcgatattgcgagcccttgaggcgttaaaaaattacaacactccaataaagtccgctgctattcacacggatagcaaaataacacttgacctgataagcaacaactcaagccactgctttctaatagaggaaataaagcaaaacttacagatcctaacacaacagacctggaaaatacacttccaatgggtgaaagcccatgctggcaacgaagggaatgaacgagccgaccagttagccaaacaagctgcaggatgtctacaactacaaccgaccttcgagctagtaccattcagcacggtgaagagagatctgcgtgaagaggccaacaacgcctgggatgaggggtggtcaactaccaccaacggcggaacaataaaatcatacttcccaactgttcgaagcaggcagcaacctaatatcaagctaacacacaacatcaccgcagttactacaggccacggaaagttcggggaatacttctaccggttcagaatctcagatgacccaacatgtgtgtgcggagtgacctcccagactgtagatcacatcctttgggagtgttcattgttacagaacgacagagaagcatttcggagacaactgttaacttcgggtggacaatggccaccaaataagagtgatctcgttttaaaacatttaaaagaattcaaaaactttgtaaatagcataaactttgataaaatacaaactgtaaactaagttaatttattaagtgaaagtgacaactcgcgtattataaattgtatatatgtatataaaaatgaaacccctacaatagcgaaacactaaagtgttaacactacggcacttatcaagtccaaaaatctgtgaatcaatgtatataacatgcatgtagtattgcattgcaatggagcatgcagtaataaataagttcagttaaaaaaaa

SEQ ID NO: 72 - DNA, 1467 bp, Aphonopelma sp. WDB-1998
gcatacgcggatgacctgctggttctaattggcggtaacaacagagatcgactaaaagaagacgtaagctccatcttcacagatatcaacgattgggccctggctaacaaactaagtatcaacaaagaaaaaacaagggccatttggttaccggggagagatcaaggactactcctacgcaatgtaaaactccctgaggtgaaattagaacagcatgtaaaatatctagggatcacctacagctctgatggcacattcaaggagcaccagcgaagaatagacagcaagataaggaagctaaacaataaaataagatcaatcaggatcggaaatcgtggattaccaggtgaaaagatgagaagaatatataagacggtgatcgagaaaattatatcatatggagccaacacttggacaaaagcacttggaagtgtagagaagaagaaactgaacagcctacaacgaaccatgttgttaagcgtaacagaggcataccgtacaacttcaactgaagccatgcaggtcatcgcgaatataacacctttagatctgattcttcgagcagagagtaagagggcggacattctggagtgtggggggagcgccacagtctcgggcaggccgataggtgcttcagggattgagatgcggccgcacaagtttgcgacccatcccaagaactggacgcgtgtcggctgggccgagtggcacgatcgggatgactatattctgcagatctatacggatggatctaagacttccgatggtacgggggctgccttcgtggtcctggacaggggcaggcaaattttctctgccggattctctctgtccaagcatcatacccattaccaggcagaggcagtggcaattttgaaggccacgatgtggttcgcagaggaatgccaagggaataaagttgctattatttcagacagccagtcagcactaaaagccctatatcgcacccaggaagtttctcccaccattcgagacattaaaagaaccatcacaacaatcaaaagacaaggaagacaaatcgatctttattggacgaaaggtcacgcgggtcaagctgggaatgaaatggcagacagagcggcgaaggaggcagttatttcaggtcaacgatacgtcatgccgcgaccggtttcctgggtcaaggcactgatcaaaaaagaaactctgagagaatgggccacaaggtgggccggctctgacaagggacgacacacacacaacatcatctctgccccggggtttaaggagtggatcttctccaaagaaatcactcaaatcttaacgaatcacggtaggacaccttcgtacatgcatcgctttggtttaacaagttctccactctgctcctgtggcggggtgggggactgggaacattacttctttttttgcagatcaacagaagcagtagccggagtgtccgcagattacagaacctacaacaactag

SEQ ID NO: 73 - DNA, 2232 bp, Aphonopelma sp. WDB-1998
tacgcgtttgcgcaggttgagatcgatgctgtctgtaagtctcttccgcggaagaaggctcccggagaggaccgtttcacctacgaaatagttcgaggactgcatgaagctttgccaaggctgttgggtgcactgttcaacagatgtctttctttgaaggtattcccgaatgagtggaaaaagggtgaactagctttgctagcgaagattgggaaagacgtaaaccgtccaaacgcgtacaggcctatttgccttctcccggctctgggaaagatctatgaaaagttgatcgtcaatagactctggcattttgtgacgatcaacaaagctctatcagataaccagttcggcttcgtcccatatcgctccactactatggctattgataaacttttggggacattccgccactttgaggatgaacgctgcgtcacgcttttggtctccctggatatctcaaacgcttttaactcggtctggtatccgagtgttttgagatacctacggcaaaacaggttccctggtaacctcatagacataatcgtagattacttccgggaccgcacgatcagcgttcgttttgggagcactcgtgttacccgcaatgttgttagaggctgcccgcagggatcggttctgggacctcttctctggaacatggtcatagaccctgtcctccgagagaggcttcccggaggtgccatactccaagcctatgcagacgatctggtccttgcggttcccggtaaaagcagagtagacctactaggcaaagcggttgactgccttagtacggtccgtgagtgggcaggacgaagcaaactggcgctggacacggctaaatccaaagccatggtcttgaacagcaagtaccgttcgcttgatcttagccaccacttagtagggggcattaaggtggaaaaagagttgaagtacttgggtctgatcattgactcggacttaaacttccagtcgcactttaaggcggtcagtgcacgagtcaacagattcgtgcacaacttaagatctatgaccgttcgagcaaatggcatttgcccagatgccataagaacctattaccatcaggttctgcgacagtggatgagctacggggcagccatatggttccccgggcacattaaaaagttctatgatcgtttcaatgcgatccaacgatcggctctgattcttgcgactagagcgtaccctcgtgccctactacggcattacaggcgatcagtggcatcttgccaggatctccaaatgtggaggtctgtgtacaacacgcaactcctgcacttgcagaaggtgactatggtggatggaagaagctaccatcccacgatgtttcagcagagggcgaataggttcagcatccatccagggaaatggatagctattgaatggtcgaacttcggttctccgagcacggtctcggactcagataaactggctcgccaccagatctatactgacgggtcgaaaagtgaatcagggactggtgctgcgtttgtggtgtttcggaacggcgagttgtggatgagcagaagctacaagatgactgcgagtaacaccagcagtcaggccgagattttggctatttggaaggcgttgcaatggctgcttgcggatggtgtcggcattaagagctgtgcagtcattactgacagccaatcgtcgttacaggccctagccaatccttcttgtgattggctattagtaatgcgggcaaaggcagcctatcggcagctgctgcgaaatggagttgcagtccgtttcttttggaccaaaggacacgcgacttgcgagggcaataaaatcgccgacagtgcggcaagagaagcctcggcttcgggactctcgatcgaggtcccccttccgcactcatacttcaaatccgtgacagccaagatggcctaccgcctttgggagcagcggtggcgcgcctccaatggctccagtgcgacgcatttgttcatagaggtacctacctctaagagttggagtaactgctcggaaatgactcaagttctgactaagcatgcgcagtaccccgagtacttgcacagacgtggagttattaattctccaaggtgtgtatgcggcgagatgggctctttggaccactacctcgccgcatgcccggaaaccctttgtttccgacagaagctcacgtcgcgttgcagtacatacgcggacctaccgcgattgtcaggatttcctctaatttag

SEQ ID NO: 74 - DNA, 5139 bp, Bombyx mori
gcgcatgaatggattaacgagattcccactgtccctatctacttgacttcgccgtcggccttggtcgaggacagacgtgcgttccgttatttctttattttccgtcatttaagtgtattgtgtttctattggtgtatcggaccctctcgtttcggcttgaggtttaagtcataagacgccgcggccatcttgctgtgtgagcggtgtgacgagtgcgaaggcggagtttagctcgacgtggagtcggcccctctcgcttcctcttgggtgccggtccatataggtcggtgtccatattggattgcgtgtgagacggccgatttgcgtgagggcggacccgccatttaggtctgtgacagtgacactagtgtgcgatagtgacgttttataatttgctgtgggcggtagccgccattttgtgatagtgacactcgaggatgcgacagtgacgttggtttgtgtttgtgttcgtgtgcgtgtgtgaatatctttgcgtgatagtaatataatttggaacaatgtcggaggaggagagggagctattttcccctcgggtctctttggcgcgctcgccgcctaggggaccgactgcacctctgccggcgcctatgccgccgccggccccccggggggttagggcgggagcggctatgagtgccaaaggccggaggaccggcctgcatatcccggttgcttctggactgtcgtcctcggcgcctgtcaccccggttgacccagtggctggtgtccctagcttccccattcctgttgcgtcgggggctccgactggaccccttgatgtagcagcgcaggggaggctggagctgctcgagcgggcaaaccgagcggtgcgcgggatcatgtcggtggcgacggcggcatctaagctcaataagtcggaggtcaatctaatctctgaactcggtcgcgatatcctggccgtagttggggccctcgggatccagctctctgataaggagctggtggtcgaaaggctccgctcggcagaggcctctgcacggcgtgactccgtggcgccttcgatggctgctggtgcggcggccgggtctgggactgggcctgcgaccttcgccactgtcctcaggacgggccctggtggggtcccgaggtccattggggcctctcaggggccttccttggcattctacccgtccgagggcaatgcggaactgaagacagctgaggacacaaagaaagaggtaaaaaaggccattgaccctaagtcaatggctattggaatacagagcgtaaggaaggttgggaatgcgggggtagtggtgcagaccacgtcccccgcggccgcagtcaagcttagaaatgctgtcccgccatcactgagagtcaccgaacccaggcgccgacagcccttagtagctgtcaatggcgtggagggcgacccctccttcgaggaggtaatcgagtgcctggctagccagaacctcgacccggaggagtggcccctcactagggtacgagcggagctcacgggggcgttcaaaaaggggaggcgacaatccaacaacactactgtggtgtttaacgcctcccctcgcatcagggacgccctcgtgaagattggcagagtgtatgtggggtgggtcgcctgtgaggtcacggactttgtccgggtgacctgctgcaataagtgtcagcaatatggtcacccggagaaattttgccgggccaaggaggccacctgtggccgatgtggagaggatggccaccgaatggaggcctgtaaggcagcctccgcgtgctgtgcgacctgccggcgattccgtcgcgaggctatgcacccgacggcctcgcgcgactgtccggcgcgccggcatgcggaggagcgcttcctaaatcaggtcgagtatggatattaggccccgacttcgtattggccaaatcaatctgggtggtgcagaggatgcgacgagggagctaccctccattgcacgggatctcggcctggatattgttcttgtacaggaacaatattccatggtcgggttcctagcccaatgtggagcacaccccaaggcgggtgtgtatatccgcaatagggtgctcccctgcgcggttctgcaccaccttagcagcacacatataacggtagtgcacattggggggtgggacttatatatggtgtctgcgtacttccagtatagtgaccctattgacccatacctgcaccggctcgggaatattcttgaccggctgcggggggctcgggtcgttatctgcgcagacactaatgcccactcgccattgtggcactcgctgcccaggcactacgtcggtcggggtcaggaagtggctgaccgccgcgccaagatggaggatttcattggggcgaggcggttggtcgtccataacgcggatggccacctgccgaccttcagtacggcgaacggagaatcttatgtcgatgtcacgctgtctacgcggggagtacgcgtgtctgaatggcgtgtaactaatgaatcatcgagcgatcaccggctcattgtgtttggggtggggggcggtacaacaggggagcgggacgaggacgaggaggcgcggagcgatttgaggccgggcgagccgtgcgcactgcgtcggtaccgggaccgtggggtggattgggacctcttcagatcgcgtatccacgagcgaatggggagtctggacctcgaggaacctgtggctgccctttgcgaaaaatttaccggggttataactcgcacagctgaagaatgcttaggatcactgaaagcagatagaactgacaggggttatgagtggtggaccccagtactcgataagcttagggtagcccagggtagggccaggcgtcgatggcaaaaggcccgccgaacggggggtgaggaagaggagcagtctgggagagtcttccgcgaccgcaggcgcgagtatcgaagagcgatgcatgacgctgagaccgccttttaccgggagatcgctgaagggggaaaccgtgacccgtggggactagcgtatcggacggcgagtggtaggcgacgcgcaccaactaatgtggttaacggggtggagtatgcggggcggtgctcggatgatgtgagtggggccatgcgcaccttgatgtgggcgctgtgtccggatgactatatgtctcgggacactccgtaccatgcgcgggtgcgtatcatggccgcgctccccccatccgggcgggacgcagacccgctgagcaaagactcccttcgtgccataattggctcactgaagaataccgcaccgggcatcgacggtttaacggcgcgcattatcaaaaaggcacttccggctgctgaggccgagttcgtggccgtatacgcacggtgcgttgtggaggggaccttcccgccggtgtggaaggatggccgcctacttgttctgccaaaggggaatggcaggcccttaacggaccctaaggcgtatcgcccggtcaccttgctgccggtcctgggaaagatcttggagaaggtattattgcagtgtgctcctggcctcacccatagtattagtccgcgccagcacgggttctctcctggacgctcaacggtgacggcgctgcgaactctgctggacgtgtcgcgcgcctcggagcagaggtacgtaatggccatattcttggacatcagtggagctttcgataacgcgtggtggcccatgataatggtgaaggccaagcggaactgtccgcccaacatctatcggatgctgacggactatttccgcggacgccgtattgccgttgtcgcgggggaatgtgcggaatggaaggtgtccacgatgggctgtccgcagggctcagtgctcgggccgacgctctggaacgttctgatggatgacctgctcgccttgccgcaggggatagagggaacagagatggtcgcctatgccgatgacgtgacggtactggttaggggtgactcacgggcgcagcttgagaggagagcgcacgccgtgctaggactcgcagaggggtgggcgagcaggaataagctcgattttgccccggcgaagtcccgatgcataatgctgaggggaaagtttcagcgtccccctatagtccggtacggcagtcatgtcattcggttcgagaaccaggtgacggtgttgggcgtcgtcttcgacgattgcctctctttcgcgccgcatgcggcggccattggcgagagggcgagcaggtgcttcggcaagatgtctagagtttcggcttcggcttgggggctgcgatatagggctttgcgtgtcttgtacatgggcacttatgttacaacccttacctatgcggcggccgtatggtatttgcgggctgctgtgcacgtcgtgcgcagcgtgctgcttaggacgcagcgcccgtcgttgacgctgctaacgaaggcctaccgttcgtgcagcacggctgctttgccggtgttggcgggcgtcctgccggcggacctggaggtgactcgtgctggacggaggatgcgggagtgcgaaggattggcgcgggagttggcggcggagagacgacgacggatcgacggcgatgtcttggtagtttggcagaacaggtgggtgtctgagggtaaggggagggaactgtacaagttctttcccgatgttgcggacaggaagaaggcaacgtggatggagccggactatcagacctcgcagatcctcacgggtcatgggatctttaataagcggttggcggatatgcgactgagggaggggcatgcttgcgactgcggggcggttgaggaggatagggaccatgtcctgtgggagtgtcctctctatgacgaaatccggggcaggatgctcgatggaatctcgcggtctgaggtaggcccagtttaccacgcggacctggtcagggacgagaaaaattttcggctcttgcgcgagttcgcgcatacatggcacacggcgcgcactgcgcgcgaatcacgaggactgcctggcgacgaagaatgtgggtgatgttagcagccccagaacggggagaatgctagtggagtgaaggggacggtgttagtttgtagaaccgatcggtaccttggtgccgtgaagttcatgcttcggtcctaataaccgcaaggttggtgggaccatgggaggtggtgggaa

SEQ ID NO: 75 - DNA, 5289 bp, Anopheles gambiae
gcccggcaaagtccgaccatcacctcctcgcggtgccgggcggggtaggagttcgtccttggacaggctctgagctaacgatggcggcacgctttggtagtggatgcagaccatgctatggatcaggctaatgtattggacgtaaaccatagatgaatgttatcgggctggcgaaaaactcaaactgatcccttagtaaggacgggtgaaactttcttgaaacggcgtgagggtcaatgagtgattcgttcccgtcctattaaaacctggcgagtcttcggtagcgctctaagtttgttgtcggcctagcaaaccgacaactataggtgcaggtgagcttcggccctgcttaaccctgcctggctctgagctcacacctcataagggtagtgagccaaccctcgcgtggagctccctgaaccaaagccaaccacggggcatcaacaaggggactatagtggcgaacaaggatagcggattgaagtttggacccaacagcaatggaagcaagaaaacaaaaacccaagaaaaatgttgaagatgaggagcacgagcggctcattgaagagtttatctcgaagctcaaaaagagttataagaaagcctcaaaggctgaggagaacgaagcaccgagaaaagtctcgcacaaagcacaactcgagcgcttcaagaattacgcgaacaacctggagattgaggaccttcgtgacggcatgatcgctcagatgattgagttcatggagtccatgattaaagaaatgagcgagttgaaaaagcagctcaaacagaagagcactcaagaaattgaagtgcaaacggctcagccaagtgaactggcagaagatgccccctttgtgccgcaaactagaaaaggccgagtcccaaaagaggcccgcaagcgagacaacaatgcgcgtcaaagatccgcgcagagagaaactccgaagagtagtgggggtcaaagcaaacagcccaagaaaaagaaaaagaagcgatcacttccaaaacccgaagcagtggtcattgagaagtgtgaaaacatagacctggcgaaagtactaaaaggactaacccatgacgatgccctcaaggatgttggcgaccaggttgccaaggtacgaagaactcaaaacggcgacatgctgctagttctgaagcgaggcaaggaagcggtgcgggttgaagcaggcatcaaaaatgccttgaaggacaaggcgaacgtccgaacgcttgctccctcggtgatgattgaaatcactcatcttgatgaaatcacccttgctgaggagatcgctgaagccctcaagcaacagctggagatagacgtcgatcataaggaaatcaaggtccgagaagcaagaactaagggtacacaaaaggctacgtttagagtgcccctgtcagcgaaagagcgtgtcctcaatccaggcaagttgaaagttggctggtgtgtatgcagcctgagagaggctacagtccaggttaaatgcttcaaatgctggaaactgggtcacaagggcttcgaatgtactggccaggatcgaagcaagctctgcattaaatgtggacaagagggacacaagatcagagagtgtccaaacgctatgacgtgcctcgactgccgtgaggatatggttgagccccacatcactggcagcctcagatgtcccaaccggatagctagacgacaacaacatggttaaattaatacagcataaccaaaaccattgcggagcggcctttaatcttatgtggcaaaccgctcgtgaacgagaagtagatttgtttattgttgctgatccggtaaaaaatcaacgacacaacaacaacatagtgtatagtgaggaccagttggcagcaatagtgacatgtggaaacctacccattcagaagatcgtcaacaaggcatcgagaggaatgttagccgtagaggtgggaggcatcctcatcgttagtgcttatgcccccccaagctggactgtgcaggaattcgaggaactgctcgataatattgttttgaccgtcagcggatcgtccaagtttgttgtggcaggggatttcaatgcatggtcttcaagctgggcaaacacccttggagcaagaggagagtcacagcgcttgagaggcgatacactattagcagccttcgccggattagagatggtgctaatgaacaacggtcaagacacattcgttacaccagagagaaagtcagcaattgacctaacgttcgtgagccaatctctaatggagacgacaggatgggaagtactgccggactatatgaattcagaccacattgggatacttatcacgattggcaaagaacaaacacctagtccccgagacaatgcgaagaagggatggaaaaccaccctttatcacaaggaactttttgctgcggcactagatagaatcctgcatgagatgagagttgacacgcccgatgacctggttaaagccctagataaagcatgtgatgctaccatgtccaggctgaagaaaacgtgcaggtggaggggcgtctactggtggacgtccgtgatagcagaccttcggaggaaaagtaaagccgcaagcagagttgcccaaagggcgtatgacactcctgaattcccagacaaaaggagggaatataagcttgccaggaatgcgcttaagagagaaatcaaaaggacaaaaaaagcgacctggtacagacttgtaaacatgtctgacatcattctattcggcgaggtctatgtaattttgaagcgaatggttggaggaaacagagtgcccaaagagttggaccccgagaaactcaacaccattattgacgaactatttccgagccatcctgtcacagactggccgacacatcaaccaacgacaagtcaagaaaacccggaaagtgtgacagacgaggaaatccgaaacatcggaaggtcgcttaaatccaggaaagtaccaggtccagatggaataccgaacgctgctttggcaacagcgatgattgaggagccgacaatcttcaagaaagtttaccaaagatgcctcgatactggtgtatttccagacaactggaagaaacagaggctcgtgctctcgattcccaaaccagggaaacgaccgggagaaagcggctcatcacgtccgatatgtttgattgatggagtagctaaaggtttagaacgtgtaatactccaccgactgaataaccacatcgagagagtacaagggttatccgaaaaccaatatggtttcaggaaaggaagagcaacgactgatgccatcgaaaaggtcttaagcatagcaagtgcatccagagctcgaaatcgaggtgctaatcgattctgtgcagtagtgacacttgacgtgaaaaatgcatttaatagcgcgagctggacggcgatagcgaggtctctacagagaatcaacatacccaaatacctctatgacatcatagggaattacttccggaaccgcgtgctgctctatgaaaccaacgaaggaaatcgagaacgagtcgtaacagctggagtgccccaagggtcagtgctgggacccaccttatggaatttaatgtacaacgaggtgctcggcttaacgctgtatgatggagcatcactcatcggattcgctgatgatatagttctagtagctgtcggaagccgaatagacgatctggagaacacgatcgaaacatccatcaacatcattcggcaatggatggagtcagtggagcttcaactaaatatatcgaagacggagtacatcctagtaagctcacacagaagtagacaagaatcacagatcatcgtcgaaggacacacaattagatcatcgcgccacttgaagtatctgggcatcatgattgatgatcgcctagaatacactcagcacatcaagtatgtcgctgagagagcggtgaccaacaccaacgccctagtgagaatgatgcccaaccgatcaggaccaagaagcagccgacgtcgaattatagcaaacaccatcattgcaggcatcagatatgcctcctcaatatgggctgagtcactgaaatttgagtgcaggaagcaatggctccggaggtgccatagaccattagtgaacagagtgataagcgcatttaggagcacctctcacgatgcagcctgtgtcatagcaggcatgatgccgctccacatactaatcgatgaagactaccgagttcgacaacgaagcatcacaacgggagtaagcagcaaactggcgaggatagctgaacgaccatactctgtagaagcttggcaaagggaatggtcgaccaccacttcaggctcctggacaagacgattgatacccaacatccaaccatggatcaccaggagacacggaaacatcgagttccatatgagccagttcctatcaggccatgggttcttcagatctcatcttcaccgaatggggtatgtaccatcacccgtatgtccggcctgcggcgacgagaatcagactgcagagcacaccatcttcatctgcggcatgtatcttctgacgaggttacgactggagcaagatcttcaagccgatttcgacgtcgaaaacgcaatcaacatcatgtgcagcgacgaagtaacgtggaatcgagtcgcagagtacgtccacgaagtgatggaaaatcagtacaatctccaatgcagctacagaggcaacagcgacagagaactccaaaaccaagaagcagcaagccaagagacttccccggaacgtgcgggaatcagcatgaatgaggataactgacatggccgatacatcgacgaagatccattcccctcggaacgtgcgggaatcagctgagatgccaaagaccatacgcacacatgtctctattctttggtcccccgacttacgagtagagggaccttgatggtgagcttgtctgcggttgtcagccccggtgtggccagctggtcaaacaccggactttgacattatacttaggtggatggcacactcactgagataccatgtgcggcgatgaggtgcctgacacctaggagagatggccctccgggtctcgggacctgggcgcggggtgtaatgttctatacgcctgacagacaccactgtcatagcattgcggcgccgtggtcgatgttgaccaaaggaatgctggttgaagtaatgctctagcgggcgatccggccagtatttcttgaggcacaagagagtttaagtggttaaaatccatctgcatacgtaggtactggtgctctgtctatcgtatgtcctataaaaggttctctcttgtctaaacgggaaaaa

SEQ ID NO: 76 - DNA, 4991 bp, Anopheles gambiae
gttcaaatcccatgggcccattgcaaaaagcaaaacaggagctcatgttgtttatcagggacaccgtgaagcacagggctattttagccaaaacgcctcaattctctaattgggaagagcgtattggctcagttttagccctgctgcacaatcttccagcaatttggctaggagaggcggggtcaggaatttatgtgggaacgggatccgaggatctcgtggtggaggacccggtgttggaacaagacttagggcctttggcaggccctaatcaggagccgcaaccgggatctttgcctttgaacgaaactgatgtcaccaaatttttcactgtttttgggggaattatgcgggagatgtacaacataatagtaagggagaatgaggccaagataggaagaaatggggaacagggacaacagttggtgggtcaggaagggaaaaagggcaagaagaagggaaagggtgggaaggggaaaaatgctaaagtagttgtggcagaggaacctcgcgaaggggaaagttgttcggcggaccagggatctggaccatcagaggggcaagagggggcgcaagaatggcggacggtaaagggaagaccgccgtgcgccgggagagacgaaagaggaagaagcagcgtgaagctgagcaagcagccagcctcgccgcaaacacgccaccttctgcctcccaacccaagcaaaagccggcacctgcttttaaccccagggccggccgaatgccaaatgccattgagcttgaatcaattgggagattcaagcacgcggaaatgatgcctatcctgagggaaacggtgaaaaaagaggatgtgcagagaattcgcacaaactttaagggtcatctactcctggaattagcacccatgtcgcaccaggagacgatgaccctttggagagaggtagccgcggcccttgatggcaaagcaaaatgccgaccgcggacaccctcaatgcgagtgaactgcactaacattccgcctgacacttcgtccgaagaaatttcttcggaaatgagtgccgcgctgggcgttgaaattttcagcgaccagatcacgaccgtaaaaacgcattacggtacgttggttgcatttttcgactgcccagcaataacggtgacagaccaggccctggcgaggcaatacacggttggttttagcaaatgctgcaggcttcggcttttggagcgccggcggcaatgctaccggtgctacgaatacgggcatactgctgcccgttgccacggcaaggaccgcagtagcaaatgccatcgttgcgcagaagataagcacgagggaccgtgcactagggagcggaagtgcttgggatgcgagggcccggacgcaatcgggcattcgctgggccagcgcagttgccgctactttggaaagataaccccacagcccagtcatgattagagtgttccaacagaacctcaatcatgaccaaacggcacaagacttgcttttgcaaagtgctcgtgccgagggttgtgatattctgattatctcggacccctattgggtgccgaataataacagcaattgggttaccgataccactggtcgggtagcagtggtatcagttggggattatccttttcagcgcatcattgacaaccaacgcgaggactttgttgtggtcgagatgcggggaatcgtcttctgctcggtctacctaccacccgtgggctccgatttgactgtcgaggagtacaaacgcaaatggaccgaaattgtgtctatgctcccacggaatcgggacaccgtgatcgggggttatgtaaacgtctggtcaggtgcatgggggatggagcggaggccaaacgatggggaaagggtatctagggggggagttgtgatggatgcggcggctgctctgggattggttctcctgaaccagggcaaccagagcacttggattggggcaaatggccgcaactccatagtggacgtatccttttgcagcccctccttggtaggggacaataattggcgcgtgtgtgacgaaaccccaagtgaccacaacactatcaagtttgtggtcggcagggttccgagacagcgcgccaattacgtgggacactcaccagtgaatgggggacggtggtccacaagattcttcgagaaggatttgttcgttgaaatcttgagggaccaggacatttttgggcatgttgctacgccagaggagctgacccaggccattacggtggcctgtgatggcaccatgcctaggcaacccccaaggcgacagggccggcggccagtttattggtggacgtctgagattgatcggttgcgcagccatttttatggaatgcaacggcggttcaaccgggcccggaccgaggagcagcgcgaggaaaggcgtcaaataaagtcggacgcacgcgctgccctgcaacaggccatcaagctcagcaaggaccaacacaagcaggatctgccggaacaattggaaccgcacggctttggccctgcgtaccaaatccgcaagcagcagtgggaaggagctcgggttccgatggaacgggatgccaataagctccagttcatcgtgaatgagctctttctcgagcgtcccccgatggagtggcccgagacggaagtaggtggggatccacaggatccggtctcggaggaggagttggcggaagagttgaaggagattgcccgctcactcaaccccaaaaaagctccaggggacgacaacattccgaacatggctgcagctgcggcaattctggcttttccggaagtttttgccaaaagctataagcagcttctggaggcaggcacttttcctgatgcatggaagcggcaacaactggtgctgcttaccaagtcggggaaaccacctggggagccctcgtcataccggcccatttgtctgctgagtgtgctggggaaaattttggagcggttgattcagcggaggctgacaacccatctggagtcgaccgggggactttcggacccccaatacggtttccgtaaagggcgttcaaccgttgacgccatcactcgggtgatgaacaacgggaaagtcgctctagacaagaagcgaaagggggatcgtctctgtgcggtggtaacggtggacgtccggaatgctttaaactcggcaaactggacagcgatcggccaagctctgcagcgtgaaaacactccgccttattttcaggcgttgctgcggaactatttcgttggccgaacgctccactatgacacggatgaaaaagtagtgtcgaggactgtatctgctggcgttccccagggttcggttctaggaccaacactatggaacgtcatgtacgacgacctactccgcttgccgctcgaaggactacgagcggacatcatcgggtttgctgacgacgtggccttcacttttctgggaaggaccacggaacaggtcagcgcattagcaacggctaacctggagaggatcgagcggtggctgcgaggagtcggtttggaacttgcccaccaaaagaccgggttcatgattttttgtacccatcatgtcccgcagctcgcagagctacaagcgggcggtcactcgatccaatccacggaaacgctgaagtacctgggagtggacctctgccgcaaacagcaccacagccggcatctggagagggtggccaataaggcttcacggattacgaacgccttgacctgcctgatgccgaacaagcgtggtcctaagagccgcagtaggagacagctcataaacgtcggcaacagtatcatccgatacggagttgccacctgggggcgatgggtgctcgataaggagacccatcgcaaatcggtccaaagggcgcatcgaccgggggctctccgagtcgccagcgccttccagaccgtgtcttatgatgccgcttgcgttgtcgccaacaccaccccgttagtcctcctcatgcaggaggatatccgctgccaagacgaaaaggtagcgagtggtggcgttcaatcggacatacggaagcggcaacgggaggagacgatgaggcgctggcaggaccagtggacaacgggtgcagggcaacctggagcaccaggactgaagacgaggaggctgattccagacattaatctctgggtcagccgcaagcatggggaagtcgactttttcctcacccagctcctcacggggcacgggttcttgcgctcctatttcgtcgagaaaggcatcctggaaggctcgcccaactgccctgaatgtggggacgccgtggaagacgttgaacacgtgctattccactgtccacggtccgatcggatccggaatgagatgcagcagcggtgccattcccgagtaacaatggataacatagtctcggaaatgtgcgctcgcagcgatacgtaggaggccgttcgcgtcgccgccaggacaatcttctccactctccaagcgagatgggatgttgagcgtccaccaacggcaaggcgacgcaggcgggccagacggcgggcgagggaagcaaatagtggtccctcaggccctgcgacacggcaaccacccgcaccgcaagggccaccgtaagctggaaagttactaatcttttatctcttttcttttcgtttctttccagctttctgttttctcttctctcctctattttcagctatttcttctatctctttctcttttactgtctcctctatcaaaatttcgtttcaggagaactgccttacgtgcttggagtggtgaccaacgaagcagaccccccattgcccacccgaagtgtgggcgataggaccaaagggaccgcgtcgcaccacggaaagcagcgtaataagcagaatcatcagaccagatcggcacagaagatgcgtcgtgacccagggtgcaaccgcacacacgactccgcatgaagtaatacgcaccacagcgtaccggccgggttgggtaagtcggagagggggatggaatacgctcactcttcgttaacaaaaaaaaaaa

SEQ ID NO: 77 - DNA, 5075 bp, Anopheles gambiae
gcccggcaaagtccgaccaccacctccacgcggtgccgggcggggtaggggcccgtcattaagttgacgaggccccgagctaacggtggcggtgaagacggcgttgagcatgacaacgtcgcaggggagggtgtggtgttaagtcgccacaccctacattctgtcaagtgggatactgaactcgagaggataatacctctgcgcggattagactagggtacggtttatggaataactaggatgtacacgggctggcggatgaacccgccgaacccttagtaaagcagggtgaaacctgcttgaaacgggggagggctaagggggattctgtcaccgctctattaaaacttagcaagtcttaggtagcgctccaagactgtcgccatacgatacgctctatggcaaatgcaggtgtgggtgggttcagccccactttgctccggttcggcactgagcccgtcgtctcataagggcgcgggccaacccttgcgtggagctccctgtttcatagccacccacggaaccaaataggagactgcataaacagacgcggatagcgggcctgagtttgagcccaatagaatgagtaacactaaaactaagaaggtcaaaaaggccaagggggttgacaagaaagatccggaccaagcgttcatggatcttcaagatcggatggaggctatgcgtttgggataagtaaactcgatgatgagtctycccattttacgctagtaacggtaatgatggacttcctcgatgaggtaatgtccgaatttcgaaggtacagagccgttaatcgcatgcagcaggtcctcgaccgtcaaacgcaaacgtcgtttgacggtaacgatggattcgggccgcaaacgcgaaaaggcagaagaccagtggctgatgaccaacagcctggtccaagtgggttgcaaaggttgcaacaacaacaacaacaaccatcgaggttgacccctgttagggaagcggtggaaaatattccaagtccgagaaacggaccgaatattaatgagggtagcattaataagaggaagaagaagaagagcaagaagaagcagaataagcccaggaagcggcctgaggctctgctgatatcggactgcacttccgaggagctggcgaaattgctcaaggaaatgaagcagtccgatgctcttaaatcggttggagagacaatctctaaggtccgacgggcccagaatggtggcatgttgctagaattgaagcagggtagttctgctagtgcaattgccccaaaggttaaggaagcggtgaagggcaaggcgtcagtgagaacgctagctccttctaaaatgattgagatcatgcatctcgatgaaattaccaccccagaggaggttgcggagtctgtcaaagcacagctcaacatcgagatcgaaatagatcgtatcaaaatgaagaaaggccgcgcggccggtacgcagtgggcacggatcaacgtatcgctgccagactttcaaagcttcctgaatttgggaaagctgaaagttggttggtcgatatgccatatccgtgaggtaatggaggagcagaaatgctataagtgttggaaggtaggccatacgagctaccattgtagggaaccagacagaagtaatctgtgctggaaatgcggtttgagtggacacaagaagcaagcttgtaccaattctgttaagtgtttggattgcggtacgaggtcacagaaccttcacgcaacgggcagttacatgtgtccccgtaggcgaacgattagatcttaatggttaggttgttacaacataaccagaatcatagttatgctgcatttcagttaatgtggcaaacgattagggaagaatctgcggatatagtgttgattgcagatccgtatctggcaacaacaaacgtcaaagtgttacgcaatgacgataacacagcagcggtagtggttaacgcggacttaccagttaaggtagtcagtaaggctctgaagggtttaatggtagttgacataggtgatatgcgagtggttagcgtttacgcgccacctagatttagtatggaagagttccagatcatgttggataacacggtaatggccgtaaccggtatccacaaattcgttatcgggggggacttcaacgcttggtcagcaagttggaacaaccaacttggcgagcgtggagaaacccagaaacgaagaggtgagttggtcttatcaacctttgcgcagattgacgcaattttattgaacgacggcagcaccccaacttatgttggaccagggcgcacgtcagtagttgatcttacttttgcgagcagaacagttgcaagatcatttaagtgggaggtgttatctagctatatgaactctgatcatcgtgcgatacgcatagatcttgagacgcaaagcgtgcgtaatctgtcccgacccataacgggatggagcatcaagtattttagcaaagatatatttgaagttatgatgcaagccgctgttgataccgaggtcacaacaagcgaagacttaatgcgtatacttgtcacggcgtgtaatgcgacgatgactaagcgtaagaggtacactcctaacaagagtgcattttggtggacgctcgagattgaggcacttcgcaaagagtgcaaacaccgcgatcgattagcgcaaagagcttttcatactgatctctattctacttttagggacgagttcaaggtggcaaggaatgccctcaagcgattgatcaagcatacccgacagaggaagtggaaagagttcctgggaacagcgaacaacgcatcatttggtatagtatatcatacgttcaagaaagtggccgagggttcgattggaccccgaactatgacattagacgagtttagggaagtggtgagcgagctttttcctactcacccaaacacggtgtggcctgattatcgtatcgatcagccacgagagtttgaaaggattactaatgatgagattcttgcggttgccaggagactacccaacaagaaggcgccgggaccagatggtatcccgaatgaggcgctgaaagttggtatgttgactgcaaccgatgcattttgcagggtttaccaaggctgtttagagaacgcgaagttccccgatgagtggaaaaggcagaggttggtgttaataccgaagccgaacaaaccaccaggggaaccgggttcggttcgccccatttgtctattagacggggcaggtaaaggtctagaacgcatcatagtgcaacggttaaatgcacacatcgaggaggtcaacggactgtctgacgaccaatttggtttcagaagtcgtcgatcaacagttgatgcgattcaacgggtagtggacattgtttcggtagctagaagcagaaaccgatacagtggacggtattgtgcagttgttacattagatgttactaatgcttttaacagtgcttcgtggttggcgattgcaaatgcattacagagaattaacactcctaaatatctttatgatatcattggtgattattttaggaatcgtgtgctgatgtatgataccacagatggaccggcagagattgcagtcacatcgggtgtacctcaaggctcggtactcggcccaacgttatggaatctcatgtacgacggtgtcctacgagttgcaatggtggaaggtgcacggattatcggctatgcagacgatatagtgttgttggtggaaggtaattgtgttgatgatattgaaattctcgtttccagccagattcgcatcatcgacagatggatgaccgacaacggattaaagatagccccgaccaagaccgagtttattatggtcagttcccatcagaggatacagcacggggctatcagggtaggtgatcacgtagtacattcgtcgcgcactttaaagtatttggggatggtcttagatgaccgcctcgaatacacttcacacatcaggtatgcggtggagagagcgacgaagctatggaccaccttggtaaggatgatgcctaataaggcaggtccaagtagtaatgttaggcgagtaattgctcttactgttgtggcgaaggtccggtatgcctcgcccatttggtgtcatacccttagatttgctaaccgtagacaatggctacgtcggttttaccggccagtagtccagcgagttatctcttctttcaggacaacttctcacgatgcagtctgcgtgcttgcgggaatgatcccgctgcatctcctcctggacgaggactccaggacttttcatcggagacgagcagagaacatcgccggatcggttgcacgtaacatggaacgtgtcacaactatggaacgatggcaacgagaatgggatgagagtgttcacggtcggtggacataccgtctcatacccgacgtcaacagatggataagtagaagatttggtggtgtagatttctttctttctcagtttctttccagccatggcttctacgcctaccagcttcatcggatgcagttaacgggctcgccgctatgcgatgcgtgcgaggaacctgaggacgccgaacacacgatattccattgtgtacgtcatcgtgaactgatcattagacttcagcatcaagtcgacgaggagttaacgccggagaacatcatcgaagttatgtctgctaacagatataactggagcatggttcatcaagcagtacggacgattatgattcgacaacaacatcggagacacgtcatcgaacgaggcgaacgacgtgctttgctcgccaacatccagttggccttgcagagcagcgacagtgacgacgagtaacgacaaggattcatcgtagttcatcgtagcttcatcgccgagggctagacagtggctaatcaccactgttggaagccattcgttgcctgggatgatggacatccaccgcccgagtgacgtcgataccctaacgggtgatccactcggggccggttgaaggcacggaggggttttagtgagtaagaatctcacactaccggggttgatcacccaggtgtcttatgcaagatttccccttcgataacaaaaaaaaaaaaaaaaaaaaaaaaaa

SEQ ID NO: 78 - DNA, 990 bp, Bacillus rossius
aacgactatcagttcgttgaataggcttgacattgcggttcggtccactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgtgacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggcactctgtcgataaagtgatcttcacctccctcatcatcagtgcgcgtggtgtggggggggggaagatcctttaagcatctatcaaagctgagactgcttgacatctctgatgccaaggtcctgtcaacccgggttctgctcggggggatgggggctg

SEQ ID NO: 79 - DNA, 1019 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccgctactctgtcgataaagtgatcttttcctccctcattatcagtgcgcgtggtgtgtggggaggaagatcctttaggcatctatcaaaactgagactgcttgacatctctgatgccaaggtcctgtcaacccgagttctgcttggggggatgggggctgtacgtgtgtttaatcgccgtacagctgtaa

SEQ ID NO: 80 - DNA, 457 bp, Chironomus circumdatus
acttagctcaataagcaaaatactggaaagagttctgctgagcagaatcaatgaatttctagaagacaacaacatcattccaaatcagcagtgtggtttccgaacaggaagatcaacatcgcatcagcttattaaagtaatcaaaacagccagggaaagcataaaaagcaaagaatcaactggaatgatctttcttgacgtggagaaagcatttgacagagtctggcataacggactcttgtacaaaatgatcaagctagggtttccactgccgcttataaaaactgtaagatctttcctcagtgaaagaaccttctcagtttttattaaaggccagttctcggaaatctacgaaatcaaatatggagttccacaaggagcagtgctttcaccaactctctacaacatcttcacgtacgatgttgtacgagaaacaactgaaaatatcgcacttttc

SEQ ID NO: 81 - DNA, 623 bp, Paraphimophis rusticus
tagacctctcagcggtttttggagtcaaccatcgactttggtatccttctgtgccaattgggggggttgggagtgggaggcactgttttatggtggttctcctcctacctctctggtcggtcgcagtcggtgttagtgggggtcagaggttgaccttaaggttactccctgtggggtgcctcaggggttcatcctctctcccctgctatttaatatctacatgaaaccactgggcgagatcatccaagggcatgaggtgaggtatcatcagtacactgatgattctcatctggacatctccaccccatgtccagtcaacgaagcagtggaagtgatgtgctggtgtctggaggatgttggggtctgaatgggtgtcaacagactcaaactcaaccctgataagatggagtgactgcggggtttgcctcccaaacacaattctactgtccatccatcttccagggggggaattattgacccccctcagagagggtccacaacttgggcgtccttcttgatccacagcttacattagagaaacatctttcagctgtggtgaggtgggcatttgtccaggtttgcctggtgcactagttgcgggccctacctggactactgcaata

SEQ ID NO: 82 - DNA, 6470 bp, Anopheles gambiae
cagtcgcaatcgagagctcgacccgaacggacgtgtttgcgcagtgctccgtgtggtgagagggtgttcgtgagagcgagagagtgggagcgattgatattcgtgtatcgaataatagtgagcgtgtgtatgcgaagcggaagcgagggtgaacttctggaactatctggaactttctcggctgttgccgtgcgtggcttccttttgcccgtgcgtttgtgtatgcgtttgtgagtgtgtccgcaagcgagtggaatattctcggctgttgacgcgcgtggcgcttcgttgtccgggcttgtgtttcgtgtaagcgagtgtgtgcgcaagaacgaggagagttttctggaactatctggaactttctcggctgttgccgtacgtggcttccttttgcccgcgcgggtgtgcatgcgtgtgtgagtgtgtgcgcaagcgagtggaacattctcggccgttgacgcgcgaggtgctccgttgcccgtgcgtgtgcttcgtgaaagcgtgagtgtgtgcgcgagcgagagtagaatattctggaactatctagaactttctcgacagttgccgcgcgtggcttccttttgcccgcgcggatgtgcatgcgtgtgtgagtgtgtgcgcaagcaagtggaacattctcggccgttgacgcgcgcggtgctccgttgcccgcgcgtgtgcttcgtgaaagcgtgagtgtgtgcgcgagcgagagtagaatattctggaactatctagaactttcttgacagttgccgcgcgtggcttccttttgcccgcgcgtgtgtgtatgtgtgtgtgagtgtgtgcgcaagcgagtggaacattctcggctgttgccgcgtgtggcgctccgttgctcgcgcgtagcgttccgtgtcactgtgtgtgcgcttctcatagcatcacagcgccggggacattcgtggtggcggggtggtagcaacccgccaccatggataagcaactgagaggaaggaccatatcggtcgatgagcgtcctgcggtcgttataaggaagctggggagcgagaaaaaactcgggaccatcgtcgaggaaccatcatcggcaggagtgccagcgaggaccatggcgacgggaggagtgaaatcggcgggaacggcgacgaaactggcgacttcaacaccggtttccaccggagaagtgcgtcggatgctggcggatgcaaaagctgacaatgagacgacggtcggcattgtcaagcggttggaggagcaaatccagttgctgcgcttgcaaatggaggcctccaacgagcagctgaaggaagcgcaaagggaggcaagagaggcgcgcgaagacgctcgggtacgcgaagcggaacaccgcgaagagcttcgcaaggagaaggagctgttcaacgctcttctagcgcaaacccttggtggaaccagcggagctcggctagagagccagcaggaactgcagcgagagcaggagctgcttcggaggatggaaagccagcaacgacaggaacagcggcaacagctggaagatcaacagcgccaaaggtggcgtcagcagcagcagaaacaacaacggcagcagcggctacctgcgcagcaatggccgacggtgcagcagagcgtgcgtgctcagcgtcagggcgtgacggagtcggcatcctcggcggtacctgacgaggcaggaacgtgggtggaggttgttcgcggcaatcagcgcgggaataagcagaacggagtgaatctgccccagcagtcagcccagcggcagccagcacaccggcagcatcagcagtggccgcaccagcaaaatgggcagcagcagcagcagcggatgggcattcatcagcaggagaagcggcgtccgcgacgaaaacgcccggatgaaattgtcgttgtgcccgccccaggagtgtccttcaaggaaatgtatgtgaagatacggaccaacccgcggattgccgatttccagcggcaaattggggttggcagaagaacgccgagggaccacctcctgctgcctttgtcccgcgacgtcgatagcgcggcgctgaaggacatcatccaggaggtcatcggggaacgtggatcggtaaccgtcagaacagagatggctgaggtcgtcctgactggaatcgacaacatgatcgacgaggaggcgatcaaaaaggcgctcatgaccactcttggaaagcagtcattggtggccaccgtgaacctttgggagcgccgagacatgacgaagcgggctcgcgtgcgcctcccacgagcagaagcggaacttgtcaaagatcgccgactggagctgggctacacgtattgttcggtacatgaagccccaaaagtatcgggtcagctgactcgctgcttccggtgtctggagcggggacacatcgccgcgacgtgcacgggtgaggatcggtccaagcgttgtctacggtgtggtgaccaaactcacaaggcgtcgggttgcaccaacgaggtcaagtgcatgctgtgtggcggcgcccaccgtattggtgccgcagcctgcggtggacaaccctcgaactgaaatggaagtgctacagatcaacgtcaatcgcagtaggagcgcgcaagacctggcgctcaacacgatgcgggtggagcgggcggatgtctgtctgatggtggaactgcacagtgtccccaggaacaatgggaactgggtggccgacagggacgggaaggtggccatcatagccagcagcgaaacgtacccggttcagcaagtggtctccgtgacgcagtctgggatcgcggctgcccggatcaatgacgttctcttcatatgttgctacgtgtcgccctcagcgggcgtctctgagttcgaggaggtaatgcagcgcatcgatgtgttggcgagaggtcacccgcgcgtcgtctttgcgggggatctcaatgcgtggcacaccgcttggggaagttgccgcaccaatgcaaagggagaggctgtggtccagctcgtcgacagcttggggctggaggtgttaaacaccggcaccgccccaaccttcctgggcaacggagtggctcgcccgagcgtggtggacgttgccttcgccagcagcagcatcgccggagtcaacaccattccggagcatcggtggaggattattagcatatactcgtacagcaaccacgtgtacattcggtttgctgtaggggagctgctccagcggccagcggcagatagtcgtcgacaggagggtccttccacgcgagaaagcggcacgagatggcgtacccgtcatttcgacgccgagcttttcggtgtagcgctcgacgtagcttcgttcacagagcgggttacaagtgccgaaagcttggagagagtcatgacggaagcttgtgacgcagccatggcgcgagtgttcccttcacaaggtcactcgggacgacctgcttattggtggacgccagcaatcgaggtcctgtgtgagaactgccgcctcgctaaggaacgccttgaagctgccatcgacgaggaagagcagatcgccgcagccagcgaccttctccaggtgcggaccgccctggactcatccatcaccaccagcaagaaggagcatttcgatgaaatactgcggggcctcgcggaagacgagacgggacaatggtaccgcaacgtacttagccgccttagtggaagctggacggcgagggagcgcgattcatcggtgctagaggtcatcgtttccactctgttcccccagcatcctccggttgactggccagcgtcaccaggccaagtcctggagaggggagaggaggaaccagttcgggacgttaatgaacaggagctgctggacatcgcgagctcgctgaacccgaggaaggctccaggactggatggtgtgccaaacgccgctttgacggccgccatccggaagcatacggacatcttcaagaagttgttccaggaatgcttggacaacgagcggttcccggatgagtggaagaagcagaaactggccctgatccccaagccgggcaagccaccggggctcgcttcatccttccgcccgattctgctgctgaacaacccgggcaaagtgtacgagcggttgctgttgtcgcgaataaacgatgtcatcgaggatcctgaatcaccgaggttggcagaaaaccagtacgggttcaggaggggccgttcgacagtgcaggcgattcagctggtggtggatgcaggcagtcacgcgatgtcatttggccgtacaaacaacagggataaacgctgccttctagttgtggcgctggatgtgcgtaatgcgtttaacactgccagctggcagtgcatcgctacggcgctggaggacaaaggcgtgccgaggcagctccgcaacatccttagagactactttgccaacagggagctcgtctatgacaccgcagacgggcccgttacacgccgagtgactgcaggtgttccacaggggtccattctgggcccgaccctgtggaacatcatgtacgacggcgtgttgcgggtcgagctccctgaaggggctagcgtcatcggctatgcggatgacatagtggtcatggcacggggttgcacaccacaggaggcggcattggtggctgaacaggcggtggacgcgattgcggcttggatggaggaccatcacctgcagctcgctccggagaagacggaaggagtaatgatctccagtctgcgaagaggtcaactgaaggtgccgttccgcgtaggggacaccatcatacacagcaaacagtcgatccggtatctgggggtccagatccatgaccacctgtcgtggaagccgcacgtggagctgtcgacggctaaagccctccgcgtggtaggtgtggtcaccgcagtaatgaggaaccacagtgggccccaggtggccaagcgtcggctgttggcggcagtggcggagtcgatcatccggtatgctgcccccgtgtggtccgaggcgacggatctgcagtggtgccagaggaagctggcccaggtgcagaggcccctggctcgcggtgtcaccagctcgttcgtgtcggtggcatatgagaccggagttgcactggcaggccttgtgccgttcaggctgctggtacgggaggacgcaaggtgccatcggaggctcctagctgccccgggcgccagccgcaaggacatccggctggaagagaggcaggggactttccaggagtggcagcgagcgtgggatgcggcggccgcagctccaacggccagtcggtacgcggtttgggcccaccgaatgatcccggacctgcacttgtggatgagtaggcgacatggagaggttgatttccacctctcacaggtgttaaccggacatggatatttccgggaatacctccatgtctgcggttttgccccatcggcggaatgtccacggtgcccggggtcggttgaatcagtggcgcatgtgctgttccagtgcgaggtcttccacgagatccgggtggagctgttgggctacggcaccagcgacccagtgaacgagaacaatctcggcatgaagctgctggagagccccgagcggtggaacagcatccaggaagctgcacgcaaaatcacgaaggtgttgcaacagctttggcgtgaggacgagctgcagctcaatctccaggcacaccttgcagcactaccgacgagagcagcagcggtagacgccggtccgctggatggtgagcaggtgtcggttgatggggtggctgaactctttcgttccaaccgaggtcgagccagacggaccagaagaggtcgtcggagggcggaagaacgggtggaagtgcgccttgcatccgcaatggcagcagccgaacgagaacgtgaggactctatcctgatggcggcggtgcgggcggaggaagcaggagaagcaccaccacccatccccatgagaagacgcggactgcctccatctccgagaacggtaagagcgcggcacgaacggagactgtatctgcaacgtctctaccgtcaacgcgccagggaagggactctaccaacagtcccacacggtagaaaccggaggagcaggtcggccccttcggaagccgataccatccgacggcggatgagaaggcgtgagatggagcggctacgccgaacagcgcgaagggtgccgtccaatcagggagtgcgtgaggtgctatccgccgacgccctggcagccatcacggaagcaacaacctccggccgttagaaggaggattatggggtaggaagtgcatgggacagcaaaagggtacggcgcaaaagaaaaataaaaaatgcgttggggttttaattccgtaaggaaaaaagaataaggaacgaaataaataagaaccaataaaggcgatgtcacaagtgacacatactcctggttccaagccccgctagggaacgggtccaggagcaggagtggggatttaacgttaagttaatcttgcaaataaatccttaagtattaaaaaaaaaa

SEQ ID NO: 83 - DNA, 6590 bp, Anopheles gambiae
agttgcaactgagagttcaaaccgaacagacgtgcctccacgcagttccgtgagcaagtgaaaaaattgcaagtaaaatgcaataaaaccgtatgaattgtgcatattcgtgtagatgaatgcaaagtgaaacactgtgtgtgaaatttggatcaaaaacagtggatagaaacgttagaaaagtgtttgtaatattctgtgacgtcacaccataagtttgtatggagaaaactttgtgcgtcaaataaacaggttactacatatatttccggaatcaaaagtgatcaggcgatagatctcgccgggatctttacagtgacggttttcctgtggaaaaatattaaatggaaagtggtaaaaagtgcatcagaaagttatttaattcggaatttatcgcgtgggtaaaatggcgtctgcccgtgaaaatttttattttcgggttgggccagtgtgtcaaaagtgacaaggcttggtaaccgcctgacaccgttcggccccgccattttcgccgtcgttgaagtgtcaaactgaattagtgaaacattacaagaacaaattcaaatggtccgttgaaagtgcagtaaaagaagaaagttttcgtgaaagttttcaaaaaaattcaaaaaaaaaggcgttgcgagtgaaattgtggtgaagtgtgtgaaatatttccgaccgttaatttcaaaaccaaccgttggtgaacttttcggggccagttttgaaattaacggccaagtgcgcggaaagtttcacggccaagacggaaagggccgtttatagtgtggtgtgtgagttgaactatacacggacatacgttccggccgaaatatagtgagtggttgaagtgttaaagcggtaggcacacgtgctgaaacaaatttgaaacgacggttggaagcagttcgacagcgttacatagcgagcggatttgcagcggtacgcccaagttgcagcggtacggcggaggtgatatgggcaacgacatctgttggcaataacaacagccgagacagaaaccagctccccgttcggttggctaacgcggtgccttctattgcccgcaagcagaaaaataaactgctgccacctgcggtagacgagtaaaatggttgcaaaactctaaaataaatggatcgcaacttaaggcctcggcagccgtctgtcgattgtagcttggaagcgattccaaagaagaccacagtttctgcgaaagtcgacactggacgcacgtccatgacggcgaagatgaacgaggagaaagaaatccgcctgcacctcatgctgcaggcggagaaggccgaaaaggcggaacttatgaagacggtggcaagtcttcaagccacaatagagggccttcagaagcagctggcggaggaacagcaggccaggctttccgccgatgcggagctaagaaggaacgggatgcaatgctggccgagatccgagacctggggcagtaaatgcgccgggagctatcctggaaactcggccaacagcaacagttgcagctgcaatcgcaacctggtccgtcagggacagcggcggtaaagctcccggaccaccaggcgccaacggcagaaggcattcggcaagcggagcagctcagcttcgctgaggtcgtccgccgcaaatttcgcggcatggctaaggggaaactccggcagccccctcagcagcatcagcagcagcagcaggaacagcagcagctgcaacaacagcagcagcagcggtacccacagcgacaggccggtcgctggcatgctgcagcaacaacagcagcagcagcggcagccacagcgacaggcggtcgtcggcacgcagcagcagcaacagcgtcggcagcagcaacaacaccagcagcggtcaaatgccacgcaggcgcagcgccgagaacagctgcggaacgaacaacgacgtccagcgcgccttcggcaggaccaaatcatcttcgagccagccgaaggtacatcctacaaggtgctgtacgagaagatacgcttgaacccgcgcctacaggaggaaaacaagggagtccaccagggctaccgtacgactcgggacttcctccgactcgagttgaagaaggatacagacgccgcttcgttgttgcagcggatccaacaggaagttggcgacttggccgctggccggatcgtaacagagatggccgaagtcttgatcacgggtatcgacatgctggccaagaaggaggatgtggaacgcggtctgcagcgggcgctggagcgcacagcagttgcagcaactacatctttgtgggagcgtcgcgacgggacgcagcgtgcccgtgtccgactgccacggagggacactgacctcctactggataagcgcatcgtggtcgggcattcggtgtgcctggtgcgcagtgccccgaaacagcagcaaagcgcggttcgctgtttccgctgcttggagcgcggccataccacagcagactgcgctggcgaggatcgatccagcttgtgcctgcactgcggagccgcggatcatcgcgcggcgtcatgcacttcggacccgaagtgcattgtctgcggcggcccacatcgcatcgccgcccccatgtgcaaaggaccgccatcacaatgttgaacatcctgcagttcaacgcaaatcactgtgagaacgcccaggacctggcgttgcacgtgataaccaccgagagtctcgacgttctgctcttgtccgagccctattgcgtaccgcgcaataacggcaattgggtgacggacgagagtaagacggttgccatcgtcgtcaacggcaaccggctgccgatacagcgtatcaggcaccgtcagaccctcggtgtggttgctgccgacgtgggaggaacaacaatcgtgagctgctacgtgtcgccgcagacgggagtcccggagttccggagcattatggagaagattgacttgatcgtccgcgggtgcagccgggttctcctggccggcgatttcaacgccatgcaccttgactggggaagcagcaggacttgcccgaagggcttggagcttctccagttggcggacaacctcgggctggtgctcctgaacaaggcggactgcctacctacgttcaaggggaaccgagcggacacaaatcggttcccgcccagccgaccggacgttacattcgccagcagtgtgatcagccgcctcgacccgcgcgatgacagcgcccgaggctggcgcgtgcctgacgtggcaacgctgagtgatcaccgatacgtccagtacgaggttggcgagagttcaccaccaacgagggatcgggcagcacggcgtggacagcgcccggcccgtgtaagcaaagccggtacgcgctggaagaccagtcagtttgactcccagcttttcgggaaagcgctggctatgactgggttcgcccgtcaagttaacagcgtcgaaagcttggtcgagtcgctgaccagcgtctgcgacgagacgatgtcgcgggtcttcccaacgcaggaccacacaggtcggccagcttactggtggactccggcgatccaggcaatgatagacaacctctccagaaaggagcagatgacgatgaggacaatcccgccggaagagcagctccaaacggaactcttagctgccagagagagccttcggaaggctattcgtttgagtaagaacgaggcgttcgaccggttcttgcggtcgatcagggaggacgtaactggaatttttttccggaaagtcttccactggttccagggagcccgctcagccccggaacgtgatccagcagaactgcggcgaattgtcgacgccttgttcccggttcatccgccggtcgagtggcctgatctcggagttggcaacatggcgccgcttcgatcgatcggcctgaccgagctggaccaaatagcagccagcatgcacccgcggaaggctcctgggcttgatggagtgccgaacgccgctcttacagtcgctctcaggcagcaaccggagcccttccggcgggtgtttcaggagtgcctggacatgtcctgctttccacagccgtggaaaaagcagcgactggtgctcctgccaaagccaggcaaatcaccgggcgagccgtcgtccttccgcccgatttgcctgctggacaacacgggcaaggctttggagcggctgctattaaaccggctcaacgagtacatcgaagatcctgagagtccgcaactgtctgagcagcagttcggattccggcgagggcgatcgactctgcaggccatccagcaggtcgtggacgcgggacggagggcgttgtccttaggcagaaccaacaaccgtgaccggcgctgcctcatggttgttgccttggacgtccgcaacgcgttcaatacggccagctggcagagcatcgccgaggcgctccaggcgaagggtgtcccagtgcagttgtgccgcatactgcaggactacttcgccgacagggagctcgagtacgacacggcggacgggccggttacccgccgagtatcggcaggtgttacacaggggtccatattgggccccacactgtggaacatcatgtacgacggcgtgctagccgtagagctccctgagggcgcctccatcgtgggattcgccgacgatcttgcgattctggcagcgggaacaatcccagaacacgccgctgcaatagcggaggaagcagtagcagcggtcaacaactggatggtgcagcataaactttctctggcgccggagaagacggagctgctgatgatctccagtaagcgcagcggatatcgtaacatcccggttaacatctgcggggtggaagtgcgctcgaagcgatcgatccgttacttgggggtcatgctacacgaccacctatcgtggcgcccacacgtcgagatggtcgcggacaaggccctccgtgtggtgcgagcattgcgcggtatcatgcgcaaccacagcggcccccaagtgagcaagcggaagctgctcgccgcagtggccgcatccattatccgctacggcgcacccgtctggacggaagccacggacttgcagtggtgcaggcggatattggatcgcgtgcagcgcctcctggcccagggcatcacgagcgccttccactccacgagctgcgaggtagcggtagttttagccggagaactgccctaccacctcctggcgaaggaagacgcccgctgctacaatcgacagcagtccagcccggacagcagtcgagaggcgattcgccaggaggagaaggagacatcgctgcagctgtggcagcaacagtgggacgacgtggcggcaaacaacaccagccgctacttacgttgggcccaccgacaagtgccagacgtgcgcctgtggacgggacggaagcacggagaggtagatttctacctctcgcaggtacttagtggacacgccttcgtccacgagttcctgcacgtgttcgggttcgctccgtccccggattgtcccaggtgcgcagggtcggtcgagtcggtggcccacgtaatgttcgagtgtccacgtttcgcggatgtccgggcggagttcctgcaaggcgtcggcgaacacaacctcggcagccgcctgttggagagtgcggagtggtgggaccgcatccagcaagcggctcggcggatcctctccgttctgcaggaggactggcgggaggagcagcaaaccttggcagcagctgaggctgctcagccagatcctgcatccagcctgcccgaggacatggcagaggcagaacggagactgctgcgacgtcgcgaggtgcgcaaccgcagcgcccagcggaggcggcaacagcaacggcagcagcgactcggcgactttgagctggtaccagccgtgttggcacgcgcagcggccaacgaagcagcggagccgacaggggaggtcgaggaggaggaggtcagccctccagtaccaccaatccctccgcgcagccggcgattgccaccctccccacgaacaacggagatgcggcgacgtcggcgcaactatatgcagctgcagtatcggaggaggcgtcgggacggagagctcggagatgtcccgcagggtcgccagcgacgtgggcgaataccaacatccgcagcggagctggagcgatgacggctcaacaggcgacagagggagagacaacggcggctggagcaacggcaagcggaggtcgaggctcagcctcccccgtggcgagctgccgaatgagctgccgagctctcagctggccgaaagaagaagcagcctcacagacgtcgagagagcggccataacatcggcaaatacttccgcacgttgaggaatattggaatatgatttggagacacctgctaggaaacggaaaacgttaaaggcttacggaacgacatttttgttttgcgaaaaaggatatcttcctctgatcatttggggaagtacaaaaactaagtgaactaaaatactatagtttaaataaagagaaaggcccaaatgagcgaaattcccggcggggtggagtccattagtggtaaccccccgctggtaggagcgggttttcttggaagcagttagtaacaccaataaagataacccaatgaattaaaaaaaaaa

SEQ ID NO: 84 - DNA, 1041 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctacggtggacagtcccccgggtccgtttccataggctgaaggcgttctctgtccttttggacgggggaagtcccgatgagatggttgcgtgggttggggatgagatcaagcgagtttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactccgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtgggggggaagatcctttaagcatctatcaaaactgagactgcttggcatctctgatgccaagatcctgtcaacccgagtccttcttggggggatgggggctgtgcgtgtgtttaatcgccgtacagctgtaggtgggagggtcaatggctggtga

SEQ ID NO: 85 - DNA, 881 bp, Bacillus rossius
aacgactatcagttcgttgaataggcttgacattgcggttcggtccactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtg

SEQ ID NO: 86 - DNA, 1015 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccggtactctgtcgataaagtgatcttctcctccctcattatcagtgcgcgtggtgtgtggggaggaagatcctttaggcatctatcaaaactgagactgcttgacatctctgatgccaaggtcctgtcaacccgagttctgcttggggggatgggggctgtacgtgtgtttaatcgccgtacagct

SEQ ID NO: 87 - DNA, 358 bp, Chironomus circumdatus
actcagctcaataagcaaaatactagaaagaattctgctgagcagaatcaatgattatttagaagataacaacatcattccaaatcagcagtgtggtttccgaacaggaagatcaacatcgcatcaacttatcaaagtaatcaaaacagccagggaaagcataaaaaggaagaaatcaactgaaatgatctgatcaatcctcagtgaaagagccttctcagtttttatttaaggccaattctcagaaatttacgaaattaaataaggaattccacaaggagcagtgctttcaccaactctctacaacatcttcacgtacgatgttgtgcgagaaacaactgaaaatatcgcacttttc

SEQ ID NO: 88 - DNA, 485 bp, Leptocheirus plumulosus
cacatccgccggcctacgccaaatgttggcgggttgcacatgtgacgcctctgcccaagggacctgtttcctcagtagtttctgagaacaggccaatttcgattactcctattctatctagggtgtacgagaagcttgtagccagtatgttgggtcgctatctggagaatggtggttttttgcctcccaaccaatatggttttaggcgtggcttggggacgtgcgatgccttgcttcacattactcacttgtcgcagcgcgcgcttgatagaggacacgaggccagacttgtgcagctcgacttcagcgcagcatttgatagtgtcaaccatcttggattgctccataagctgcgttctgttggtgttggtggctcagtcttgtcaattattgagaattttcttatcgtccggcgtcagtgatgttctagtcgatggttgtccaaagtcatcttatctgtgatagttgtcttcgggtggacccca

SEQ ID NO: 89 - DNA, 6733 bp, Anopheles gambiae
gagtgttcatcgagtagccgtcgagtgaagacggatgtaaacacgctccgacagagtttcggaaaaaagtgtgtaaaacggcctcggatcgctcggaaagtgttaaaaacgagtttagagcacccgttttacctttagacggtgttatttacccgaaaatcggtgattttttgtaaaagtgaaaaatcgtgtttttgtgtatacatttgcccccccccggtagcaccaaatttccgggtgtgggaattaagtgtaaaaatctgcgattttagtgccggaaacacttgtatttaactaaatggacgcttctgaagcgattccaagtgttttggaaacgatccgtgcagcaaaaagtgaaaaaaacgcgaaaaccaaaagtgtcgggggtgctaccgctggggcatgtgtccgcggtaaataacgaaaaaaacagtaaatcgtgaataactcggtgagttttggtcggattcgagtgcggttttcaccattgtgcgtgtctttgtgcaaacaataagaatcaaacaaaaaaacagtgaaaatcggtgaaaaaatttttgacatttgtgagtgacagttcagtaatacccacgggacaaatttggccggggcgcaattcccaagggcaaaatttgaattttcggcccggtggcggttggcggcggaaccgagggtgccgaaaaattgtcaaatttgcaggggtggtagagcaagtaacgccgactacgggaaaattattttcccccctcccccccctcccccctcccccccagaggtcagaatagagtagggcgcccgataagagtcggataaggtcgaggtcgcccgaaaattctcatttttggtagggtggtagagcgtgaccccagcagtccgggaaaattattttccccgctcccacccccccccccctcccagtgaaaaattttataagtgtcaaaaagtcggaaaagtggtccaaaaagggtggaattccgggtcgagccgtttggacgagtgaacgtgccgcgaaaatttgggagtggtgcggaataattccccacgtgtgtgacgcaccctcctgaattttttccccacccccttcccccctcccccccgcccaccagggggcacaaattggacctttttcgccctgaacaccggagttgaagcggaaaccgacatcatcgtgcagcagatcaccagctaggcggcgcagaatccagggtcattccgaccccctgggtcattcgacccccgggtcattcgacccccagggttattttaccccacccatcgcgaacgtcggttatcgcgatggaagcacccgggagatcgacccgctcggtgctagggcgacgtcggtggactgccgcaccagcttggctccttgctccaagctctttgcggccgagccacgtgttgcgcttcctaagctaagcgccacaggcgctagtaagcccattgccgagccaaaagctgcatcagcgacaccggctccggagctcgagttgctcagagctacaatacaacggctcgaggagcagaactgtgcgatgaaggagcaaaacgcaaaactcctggagcagataaccggcatgtgccaactgctgcaggaggaaaaggaggaggcaaagcgccgtgaggagaagctcgaggcgcagatggagaagttagccgccgcacatcaacgcgatcgagatgtgctcaactctctgctggcggcaaaggttggcggtggacaaccgtcagctagtccacgtcaacctccaactccgttgccgcgccgatcctctgcgcagccgcagcagcagcaacagcagcagcagcggaaccagcacgagcaggagcagccccgcgcgtcgacgtcgcgcgctgtcatgccgccgcgtagcgaggcattgacagccgtccgcggagacgtcgtgccggagttgacctacagcgaggtcgtgcggcgtagatatcgcggcaaagctacgggtaagccacgctcccagcagcagccgcaacagcagcagcagcagcgtcagctacagcgacaggcagtcggtatcgcgcagcatcaacagcagcagcagcaacgtcagccacagcgacaggcggtcgctggctcgcagcagcaacagcaggagcgtatgcagcagcagcagcagctacagcgtaagcgaaagccgaggcctgacatcatcgaggtgtctcccagcgaaggcgaaacctgggatggcatttacgacaaggtgcgcaaagccattcgtctggacgcggctcacagcgaaatgaaagggcatattaagcagggccgccgaactcatgctaggctgctacgtatggagctgagcaagacagcaaacgctccgcttatgctggaaggcgtccgcaaaatcatcggcgacgcaggcgtcagtcggcttgtcacagaaatgggtgagctgctggtagtcgatattgatccccttgctacggaggaagatatcattgctgccctcgatgctaagattggcgcaagtgctggagttgtttctgccagcatttgggaactaccggatggttcgaagcgagcacgcatccggctacctgtgaagtcggctcggcagttggaaggacttaaactgttcctgtgcgactgtgtgagcaaggttcgagcagccccaccaacgcctccagagcgacagcgctgttttcgctgtctggagatgggccacatcgcctcgaactgccgttccaccgcagatcggcagaatctgtgcatccgctgtgggcttaccggacacaaagcacgatcctgccagaatgaggcaaagtgcgcactgtgcggtggcgctcaccacataggccacagcgaatgtgctcgttcggcccaacgatgttcccggccctgaaagttctgcaggcgaacctggccatggccgtgatgcccagaacctggtgctgcaagctgccagagaggagaaagcagacgtgctcattctctctgatgttctgcgcccacctgaaaacaacggccggtgggcattcagcagctgcaaggcggtagcggtggtagctgtcggtgagctaccaatacagcgggtgtggtgcagtgaagctcaggggttggttgcagcgcagatcggcggagtggttttcatcagctgctatgctccaccaagccttaacctcgcagagttcgagcgcttcttggaagcaatagaactcgaaggcttctcccaccctcaagtcgtcgtcgccggcgattttaacgccagacatgaggagtggggcagcccgaggacttgcgaccgcggggaagagctgcacggaatggtggagcagcttggcctaatcgtgattaatcaaggtcgggaatacacgtttgttggcaacggggtggctctcccgagtatagtggatgtggcattcgcgagcccgtcgatcgctcgccctgacacctgggttgttagcacaagctacaccgcgtcagaccaccgctatgttctctacaccgtgggaggaacaccaccatcccccgaacaactgcagaaccatcagcagacagcgcagcagtcgtctcagcagcaacagcagcagcagcaacagcagtccttacaacagcagcagttatcacaacagcagcagcagcaacgacagcggcaaccatcgtcgcagcagggtgattcctcaagccagaggcgtgtgcgtcacgctggccgccgatggaaagcctcgcagttttctccttcctcattcctcgaggcgctgttcgctgcggactttgtccaacgcgcatcgacccaggagggtatgatcgcagccatgctgaaggcctgcgacgagacgatgcaacgggttacccgactgcaccaagacccgcatcggaacatcttttggtggtctcccctcctggctcgcctgaggaacaactgcgaggttgcccgtgaccggatgctgcagacggctgacttggaggagcgcagcatagcagcagctgagcacaggacagcaagggcggagctcagccgagcaattcgagctagcaagcggaacttgttccaggagctgatcgaaattgcagaagagaatgcgttcggggcaggataccgtgtcgtcatgtcccggctccggggcagtcggacgccttcagaagcggaccgggtcgtcctcgaacgcattatatccgacctcttccctgagcatccgccctgcgactggtcgcagctgagcaacgttggaagcgtcgagggagcaacaacaacggcgggaattgcaccggtaacggacgacgagctgctgctcatcgcgagccagatggcaaatcacaaagcaccagggctcgatggcatcccgaatgcggcagtgaagacggccatcatgttgttcccggagtcttccgggttcctgtaccaggattgcctcaaccgcgcttcgtttccggcgcagtggaagaggcaacgactggtgttgctgccgaagcaggggaagcctccgggagagagcagctcgtaccgacccctctgcatgctcgacgcactggggaaggtacttgagcgcctcatcctgaatcgcctcaatgaacatctcgaggagccgtcttcaccccgactgtcggaccggcagttcggatttcgtcgagggcggtcgacagtgagcgccatccagcgggttgttgaggccggccgtaccgccatgtcgttccggcgaacgaacggccgggataaccgtttcttgcttgtggtggcgttggacgtgaagaacgccttcaacacggccaactggcaatccattgccagccgccttcaggcaaaaggtgttcccgtcggcctccaacggatgcttcgaagctacttcgaggatcgtgtgctgtactttgacacgagcgaaggccccgtcgtacggcatgtaaccgccggtgttccacaggggtccatcctgggcccaactctgtggaacatcatgtatgacggggtgctggatgtgccgctacctcccgacgtcgaagtcatcggatacgcggacgatctggcgctgttggtacctgctaccaccacggacgaggttcgcgcgagagcagaggaggccgttgaccaggtccaacgttggatgcaacagcacggtctggagctggccccagccaagactgaagccgtcctgatctcaagcaagaagactccgccgcaggtgacatttcgcgtcggtgacgtggaagtccagtcttctaggagcatcaggtacttgggcgtgcagctccaagatcacctgaaatggcgagatcacgtcacgaaagtctccgaaaaggcgtcgcgcgtggtggcagctgtaacgcgcctcatgcaaaaccacagcggccccaggacggccaagtcaaggctgctggcgtatgtggcagaatcggtgttgcggtatgctgctcccgtctgggctgaggcaactcaggtgcgagagtgccgacggatgctgcaacgagttcagcgaaaagcagccatcagggtggcacgggcattccgtaccgtcaggtatgagacggccaccctactcgctggactcgtaccgatatgccacctcatcaacgaggatgctcgggttcaccaacaactccttgctccagaccgtgctgcaacgagggaggacatccgggcgacggagcggcagaacaccatcgactgctggcaggaggaatgggatgccgacgcactgcaacaggatgctagccggcacacgcggtggacgcaccgtgtaattccatcggtcggcgactggcagtctaggaaacatggagatatgactttccatctggcacaggttttgtccggacacggatttttccgtgactacttgtgccacaatggattcacgtcgtccccagactgccagttgtgcgtcggcgtcccagagacggcggacgacgccttcttcgagtgcccacgctttgcggcagttcgacaggagctactcggcgagggaggtccggaccctgtctgtccggacaccctccagcggcacttgttgcgcgacgccgatagctggagtcgtatttgcgaaggcgcgaagcgaataacggcccaactgcagcgagcgtgggacgaggagcgggcagcattggctgttaacgtcatcgagcgtcaggacgaagacgcagcagagctggaggcccaacgcgcggaagtgcggcgggcccgtaacgagcgacgcaacgccaaccggcgagcagcaacagcacgccggcgggaagaacgtcgagctggacttcccccaaccccaccagcttcaccacggaccgctcagcgacgtgcagcgcttcgtgagcgtcaagcgcggttcagggagaggagacgaaaccgtcgtcttctcgggatgtccggccaggcgataaacaatgacgatgacggccgagaacgcgcggatttagcagccggaccatctggtatgcgcaaccgcgcaatcgacgaggaaaacgaggccacggacggtggcctgaacgccgcggaagaagccgccgtggtcgaggcagaagttgcctcccgctaggcgtggtatgcacgtaaaaacagcgacgcatcgagcgtgaaaaagcgccctatttaggggaatgagtgaatttttcggttgaatttagaaatagaaataaaacatggaaggtgcttttcgcacggacaaaaggttggccattaagccatgaaaccccctgcagggtaagccctcgcgggtaaaatgtaggggagcgggagggtttaattttgaaacaaaataaaaaacccgtttataaaaaaaaaaaaaaaaa

SEQ ID NO: 90 - DNA, 7072 bp, Anopheles gambiae
aatagtgttattcaatcgaaattcggtgaatttttgcgaaattgaaaaatcgtgttttgtgtatacatttgcccccccggtagcaccaaatttctgggtgttaaaaaagtgcgcaaaaatttgtgtttcaggcgccggaaacacttgattttggataatgcttctaaagcgattaaaagtgttttcgagacgttttgtgaagttttaagtgcataaaagtgggtgtttatatccccatacaatttgtatgggggactttgaacgtttatatcggagtgaaaaacgcacggatctgtgccggatgtgtcttggaaggtgcgcgcaatgacgcttaaggttaagtgacaaaaatcagaaccgaaatcggtgaagaaaccagtgaaaaaagtgaatttaaagtgtggaacaagccgggtgacaggttacatttgctacccaagggacaaacccgcggtgacagccgttacccaaggagcaatttttaaattttcggccgagtgacggttggccgaaaaactgttagcggcggaaaattatgaaattcttaagggtggtagaggacgtgtccctgatcacgggaaaaattatttcccccccctctccccctcccaccgctcccccctggggctagaatagagtagggcgcccgataagcgtcagataaggtcgagatcgcccgaaaattctggctttcggcagggcggtaaagttggacccccgcagtccgggaaaattattttccccactcccaccctcccccctcccggtgaaaaatttttgaagtggcaagtcaaaaagaggtccaaaaaggttggaattcggggttcgagctgtttggacgtataaacgcaccggggaaattcgggactggatcggaataattccccacgcgtgagacgcaccatcccgaattttaccccaccccctcccaggggggcttaaattggaccttcttcacattaacggcagagttgaagcggaaatcgacagaaacgggtagcagaacaccagctaggcggcgaagcatcccaggggtcatcccgacaccctggatcattcgagccccggggtcatttcgacccccagggttatttcgacccccaatgcaacttgccaaagcaggtgtgagcaataacaaggcaggggatgagtgacgaggcccaaccccagcaagtgagtgcgccgtaccagctgtggcccaggaaagggtcagtggttgtgatgcagccacaacccatcgagcgcccggccacaccgatgatggagctgtgctactcaagcgacgacgatgagctgaacagcaccatcatcgcgatgccagaacccgcgtcggagtgtgaggcagcggaggcggccatggacttggagccaccagcagcagcacagccaacaccaacggcatcccctgtcccgggcaacatggtagttgctgggcccatagacgcgggaagttgcgccctgctgatggcacagcttcaaaacatcggcgcccagctaacgacggcgctggaggagctgcgactttgccgcgaggaaaacgcggcacttcgtcgcgagaatgagttgctgctcacgggcactcgttcggtgctcgagctgcagactgcagcgaacgcaaccctgcagcagtcgtcgggacaaggtggaaaccgggagacggcccggaagcgccagcaacggctgaggcggcgagagcgggaacggcagcagcaacagcagcagcagcagcagcagcagcagcagcagcagcagcagcagcagcagcaacgccagcagcagcagcagtgtcagcagcagcgtcagcagcagccgcagcaacaacagctgcagcagccgcagcagcagctttggacaacggtggtaagaggccgcccgtcccagcggcatcgtcaaccgcagcagcagcagcagcagcaacagcagcaaggtgaacgctatgttccaccacagctccggcagcagcgacagcagcagcagcgcccgaggcagcagcagcagcagcagcaacagcagcagcagcagcaaggtgagcgctatgtcccaccacagctccggcagcaacgacagcagcagcagcatcagcagcagcagcagcagcagcagcagcagcgtcagcagcagcagcgtcagcagcagcgtcagcagcagcagcgtcagcagcagcagcagcagcagcagcagcagcgtcagcagcagcagcgtcagcagcagcagcagcagcagcagcagcaccaacagcagcagcagcaatggcagcagcagcagcagcaacagcagcagccgcggcaaagtttgcctcatcgcaaacagacgcagctgcagctttctccacgactgcagcagcaacagcagcaacagcagcagtcgcagcaacaacagcagcagcagccgcagcagctgctctggacaacggtggtaagaagctgcccgtcccagcggcaacgccaactgcagcagcaacagcagcaacagcagcagcagcagcaaggtgagcgctatgtcccaccacagctccggcagcaacgacagcagcagcagccgcagcagcagcagcaacagcgtccgcagcaacagcgaccgcagcaacagcgacctcagcagcagcgatcacagcagcgaaagccggccaagcccgagcttatcgaggtatcacccaatgaaggtcaggattgggagagccttctgctgcttgtgcaaacggcagttaggactgacgagcgttacaagccgcttaaggaccacgtcgtcctgggccgccgcaccagtaaggcgttgctgcgactcacgctcagccgcaaggcgaatgcgcagtatatgctgcagcaggtccctgccatcgtgggcagtgctggagtgtgtcggcacgtcacggaaatggcgtcactggtcattcatgacgtcgacccgctagcccgagaggacgatctcacttcgctgattgacagcaagttcgagtcgggagcgggaattgtgtcgaccacaatgacaaagatggccgatggtacacagcgtgcgtacgtgcgattgcctgcaatgtttgtgagtgaactcgacggcaccaagataaagttgggattttgcgtcagtaaagtcagagccgcgccaccgacccctcgagagcgtgtgcgctgctatcgctgtctcgagctgggtcattgggcccatgactgccgttcacccgacgaccggcagaacatgtgcatacgctgcggcgttgtggggcacatggcaaaggtatgcacttctcagccaaagtgcctcaagtgcggtggtccacacacaattggacaccccgactgcgcccggtcggccttgcaatgaccccacaactgcgagtaatgcaggtgaacttgggcagaggagagagggcccaggacatcgccctccaaactgcccaagagaagagagtggacgtgctgctgctgttggagctgtatcgaccgcctgccaacaacggtagatgggccttcgactgttcgaagaaggttgccatcgtcgcaactgggtctcttcctctccagaggatttggtgcagcaacacaccgggactcgtcgctgccgagataggcggcaccactttcctcagctgttacgctccacctcgtcagcccaccgacgagttcgagcgcttcattgaagcagtacagctcgagacgcttacccattcacaagtcgtcattgccggcgacttcaacgcctggcatgtggaatggggaagcgagcgtaacagcgagaagggagaagagctgctcagtgccatccagcagctagacctggttgtgctaaatcagggcacgacgagcaccttcgacggcaacggagcggcaacagcgagtatcgttgacgtggcgtttgcgacaccaaccatcgcgcagccgggaacgtggaacgtgtgcggtgattactcgtactccgaccaccggtacatcacgtacactgttggcaccatagttcccgtcgtaaacgagccctcatcaccacggatgagacatcaggggcgcattcgacacgcggatcggcggtataaggcgacgcagttctcgcagcgagccttccgagcgcggttctcagaacgggcggtcagtcacgaacgcatggttgagatcatgctcgccacgtgtgacaaaacgatgcagcgggttacaacgtcgcatagtgacccccatcgtgacctgttctggtggacgccgctgctcaggctgctgcgagagaactgcgatcgcgcccgcgatcggatgcggcagaccagcgatcttcaagagcggagcattgccgcagcggaacatcgcacagcgagggcggagctggggaaggcgataaaggccagcaagaggaactcgttccaggagctgatcgatatcgccgaagaaaatgtgtttggagccggatatctcgtcgttctgtcccacctccgtggtggacggacgccacccgagacggagcgggacaggctcgaacacatcgtgtccgatctcttcccccagcacccgcccctcgtctggccagaagcggcagacatcgagggagaggagcagccaggagcagtagcagatgtttcggacgatgagctcaaactcatcgcacgtcgcatggccaataaaaaggccccgggactcgatggtatcccgaatgcggcggtgaaagcagccatcctcgagcacacgggggttttcacagcgttgtaccaggactgcctcgttaacggcacgtttcctgcagcgtggaagaggcagcgccttgtactcatcccgaagccaggaaaaccctccggagtgagctgctcgtaccggcccctgtgtatgttagatgcactgggcaaggtgcttgaacgcttgatcctgaacaggctgcacgagttcctagaagatccggaatcaccgcgactgtcggaccggcagtatggtttccgcagagggtgctcgaccatcggtctcattcagagggttgttgaggccggccagcgtgcgatgtcgttcggtcgagcgaaccgacgcgacaaacggttccttctagttgctgcgctagatgtgaggaacgcgtttaacacggccagctggcaggccatcgccactgcgctgcggacgaaacgtgttcccgccggcctccaacgtatcatacacagctatttccaggaccgggagctggtgtatgaaacctccgaaggcccggtagtgcggtccgtcacggcaggggttccacaggggtctatcttgggccccaccctgtggaacacgatgtacgacggtgtgttggacatcgccctgccacccgatgcggagatcctggggtatgccgacgacctggtgctgctggtcccaggcacaaccccagacaacgtgaaagctgctgcggaagaggcgataatatcagtgatggagtggatggctcgacaccacctcgagctggcgccggcgaaaacggagatggtcgtgatctccagcaccaaagccccaacgcggatcaccgtccgagtaggtgacgtggacgtcacctcgtcccgctcgatccgctatctcggtgtgaccctccaggacaagttgtcatggctgccgcacgtcaaggaggtcaccgagagggctgggaagatcgccgacgccacatccagactgctgcgaaaccatagcgaaccaagggcatcgaaagcgaagctgctagcttcggtgtccgagtccgttatgcgttatgcagcaccggtatggagcaaggagctgcaaaaacgtgagcctggtcgcctgctggagcgtgttcagcgaaagatggcactgagggtggcacgagcattccgtaccgtgaggtatgagactgccaccctcctagctggtctgacccccatctgcctgctgttggatgaggacgcccgggtctatcagcgactaagtgccgtcaaccgcaccgacacgagggcgaacatccggaagcaggagcgacaggccacgatcgaacaatggcagcaacagtgggacgcggaagccgacaccagccggcacacgcgttgggcgcaccgtgtgctacccaacatcggcagctggcagtcaaggaaacacggagatgtgtcgttccatctgtgccaggtactctcgggacatggcttcttccgggactacctgtgtcgcaatggcttcacatcgtcccctgactgtcagcggtgcagcggcgtccctgagaccgcggagcacgcgatgttcgagtgcccgaggtttgctgaagttcgtcagcagctactcggcgagggaattacggacccggtccgtccggaaaacctccagcagcacctgttgcgcgatgccgaaagctggagccgtatctgtgaagctgctaagcggataacggcttcacttcagcaagcctgggacgacgagagagcagccctagcagcccatggcaacgagcagcacttcgaagaagttgccgatctggaggcacggcgagcagaaatccgtcgagcacggaacgaccggcgaaatgcgagccgccgagcagccagggcacggcaacgagagttgcagcgagcaggacgtcccccatctccaccaccatcgcccagaactgcggcacgtcgtgcagatcttcggctgcggcaagcgcggtttagagcgagaaggcgtcaagcgatataggacgcgagacgcctgtatggggagcacagtcctgcatcaacatcgtcatcaagcagcagcgacgacgattcagacggccgaggaagcgcggatatcgcagccggaccgtctggaatgcgcaaccgcgcacatgaacgcgaaaacgaagccacggacggtggcctgagtgctgcagaagaagccgcagcggtcgaggcggaagttgcctcccgctagacgttctgccttctttagaaaagaagcgtctactagcaagaacgagtgctctactaagggagaatagaagttgaactgaattgaacaataaaaaaaacggaaggtgcatcttgcacggaataggttgaggcaattaagtctagcatccccctgcagggtacgccctcgcgggtaataatgtaggggtgagggagggtctgaattccactgaataaagaaacccgctttgaaaaaaaaaa

SEQ ID NO: 91 - DNA, 7850 bp, Bombyx mori
  modified_base (1555)..(1556): a, c, g, or t
cgagttccccctcagctctcgtggcggtcggatcgttttgcgtgcgctccgcgtttaaaaaaatcgaacgaacgggttattttacgcaaaatataaagtgttatatatcaaaaggtgcgcgttcgcgaatactatccgtgtgtgaaaaaagtgcgaaaatcgaactactctgtgagacaccaggtccaaaaaacggattctaacctgcaaattagatattccagacgcaacgctgcctgattttcagcgacaacttacgtttcttgaactgcagttcgaagcgcaccaggggcagctacaatcaggtgaagtctcggatttttccgggtaaaactcaccgagccacaaaggaaaaaccgaaaaccacgtggccacgtgctcctagttcccgacgtcttggagaaatttcaccaactcgaaatcgtgaactatgtcgagacacgtcatttgacacttcgaacttcgaaatcggagcatccccctggaagttggaagactttgaaggcactacgaacttagatctcatccagagctgaaacaagatctatgacgtcaccttttctggacccctagatattgcccaccacttggacaataattgtacaaaatttcaggaatttttgacaggtagttttcgagttacagaggacataaaaaacctgtgacgtcacgcagagccgaaagtacctatgacatcctgctcccggcagcaccctaaagaaaacctcctacaaggaaggaaactcctcgggaccaaccccctgagacgcgaagtttctgcactagaagctatttgcagaaaattgtcagccacctccagcttcggcagcttcctgagggtggtgtggactacggaggacctccggacaggcgggacatcagggaccggttcacctcctgtggaacaaaatttttagattgtaagtaggactaaggatagattttatatagaatttaaggtggaacaagggtaccggccggcattaccgcttaagtttgtacaccccctggagcctcaggggacgagatatcgcaaaaataacaaaaaatcggttgtcttggggacaacgatcatagggtcgactaacatattggcaccccaaaaaaccacccccaacgagattttttggaaaaacgggaaaaatttcggttttcccgatttccaaagcagaaaacaagggacttgacggtaaatttgggccgcgaccaataccccagtatttttccccgtctcgatatcccgttcctaaggccaaaaccaggcaaacgaagctggcaaaaaactacccctaagtttgagggcgaataaaaaatcgaccgagtgacctatccctttgtgatctcgggaccggacggcccaaattaaaatactgcaccccggtacttttcccggcgaaatcgaaaaattggaactaaattaacaggctgtttaaaatacttattcaagcagttcgacggcagagggataaagttgtttaggtatttaaaaattccaaaaatacctcatatctcgtaaaccgtgcgtcctagcccaaaaataacgaaaaatttctanncccctccctaacccaccccccctgctccgcaaaccctaacccttaaacctcccctccccccgcacccaacccctagggtcccaaccccctacccctaaaattaacttatgaccattattacttggactctgaaaaatttttagtagcaaattttataattataaaatattaaaaaattattgactattattttggcatactcataaataggtagtataaggacactttaggggtagcaacccccaaattaaataaactgccttatctcgcgaacgggaagagctacagtaacggggttttttgcatgcaatagggcttggtctcgagcagttttttttggacagaggtggagactctacgtagagtcgaaacttaaaaaaaaaaaaaaaaaaaaaaaaaaaaaaaaaaaattttacattatacgatcgaaatcgaattgattgaccgtgtatcttttaagttgtaaaaatacctacctagttacattctcatactgactctaggtagagaaaaattttgtgcgatccaataacaaaattttttgcatacattcctacacacacacacacacacgcactcacacacatatacacatacacacacatacacacatacacacacacacacacacacacacaagtatataaataaaaaaaccttcttaccgacactcgacgagtctagaactcgtatagcctgacggaatctgtaacaaaaaacaaaaaacagagatataattttttatttattttattttgcttatttgtaccgtcccttatataacttatacaaaccttttgtgacgtcctgtttatataattatattacgtgacattgacgcgtcctcactgcaaggaaaataaaaattaaattaacgatgtacgcaaatattagaaccccagtgaccaaaaacctaaactctcctccgaaaaacgcagatcatgctggatcatccaatacagatgacccaaatattacaagaagcgtaagacgaagtgtgggagaatgggaatcagccaaggccgaccaagccataaaattgaaaacaccaacatctcccacaaaaaagccatctgaagccccccaaaaacaaaaaatacaaggctttccaagcaagactgcggaagctagagcctgtcttagtaaggccaaattaaatcttgaaaattcgagaaatttgaagactgatataaaaatggcagtcttacaagcagtagaaaggctttatgagcttgtaaaagaggcggaaggaaaagttacaagggggcagaaaatagaggaaaagggaacgcataaagagaaagaagcagagaccaaggaaaaggataaaggtcaggatgagaccttaaatgcattaaagaaaaaactggaagaaaattgcagtctcctaagagaaaactccgagaagatggaagagctaaaacaaatgttcaggagtcaaaaagcgacttatgcggatgtggtggtatcacagccggggaggcaacccccaaaatgcaccacattacattcaataatggtctcatctaaagacgaaaacgaaacaggcgatggtattctcacggaactccggaaaacagccagtgaagatgaagggtgggtgagagtggaaagagtgagaaagattaaagacaggaaaattataatgagttatagaacagaagaagagagaacaaaggcaacacagagattaaaaaagtcagagggggaactcgtcgttgaagagataaaaaataaggatcccttattgatactctataatgttttaaagatgcattccgacgaggacctccaaaaagccttaagaagcaaaaataaagacctcttccgtaacctcaacaaagaggatgacaggatagaggtaaaatataaaaagagtgcccgtaaccctcacacccaccacgtagtgctaaaagtgtccccaaccatctggaaccgagccctgagcatggggtcgctgcacattgatatacaaccagttagagtggcggaccaaacgccactggtgcagtgtaccctttgtctggggttcggacatagcaggaaattctgtaaagaagctttaccgagctgcagccattgcggcggaccacatatgagggccgactgtcccgacagactgacaggcatagagcctacctgctgtaactgccggaaggcaaatatgacaaccacagcacacaacgcttttagtagggagtgccccgtaatggcaaaatgggacaatatagcacggcgagcagtggaataccactgctaaagttagaccaaagaatggacccccatcacccccctacagagttttgcaagcaaacctccaaaggaaaaaattagcaaccgctgagttggccattgaagccgctactcggaaagctgcaatagccttaattcaagagccatacgtgggcggggcaaagagtatgaaaggattccggggcgtaagggtcttccaaagcactgcacaaggagatgggactgtcaaagctgcgatagctgtctttgatcacgacttggacgtgatacagtacccgcaactcaccaccaataacatcgtggtggtggggatccggaccagggcctgggagatcacgctggtgtcctattacttcgagccagacaagcccatagagtcttatcttgaacagatcaaaagggtagagagaaaaatgggacccaaaaggctaatctttggaggtgacgcgaatgccaagagtacctggtgggggtgcaaggaagatgatgcacgaggagatcaattgatggggactctcggagagttgggcctacatattctaaacgagggagatgtcccgacatttgatacgatcagaggaggtaagaggtaccaaagccgcgtggatgtgacgttctgtaccgaagacatgctggacctgatagatggatggcgagtcgatgaagacctagtgagctcggatcacaacggtatggtattcaatattagactccaaaaatcaaaaagcatcaaaattgaaagaactactaggatatttaacactaaaaaagccaattggagcctatttcatgagaagatggcccaattactgctagataacaatatgacaactttgatagatacaatagacaataaaacaaaagtagaatctgcaatcaatacatatacaaacataataacaaaaacttgtgaacaatcaattccaaaaaagacaagcagagaaatacttaccataccgtggtggtcggagaagctcgcagagatgaggaaggagacgaacacgatgagacgccgcatcaggaacgcagcgcaggatcgaagacaacacgtggttgatgagtacctgaaacaaaaagaaaaatatgagtcggaagttagagaggcccaagccgggagctggaaggagttctgtgggaagcaggatagggaaggggtctgggagggaatatatagggtgatgagtagagctcggacaagggaggaagattgccctttaacagatgtgaatggagccccgctggaccctgaaaagtcagcaaagctcctggcagagaccttctacccggaggaccgggaagaggaggataatgatgagcatgccgaaatcagaaggagggctaaaataagcgaaggtgtgcatgatgagtatgtaccctcgtttactgttaatgaactcaagcatgctctaaaaagttttaacccaaagaaggcaccaggagcagacggactcacgtccgacatatgcactcatgcagtggacctggaccaaaaactctttctcggcctaatcaataagtgcttagagcatagatactttccgaaaatctggaaagcggcaacagtggtgatactgaggaagtcgggaaaggactcgtacactgaaccgaagtcgcacaggccgattggtcttttgcctgtactgggaaagctgtacgagaagatgctggtggcccgactcaagtaccatctattaccgaggatgagtactcgccaattcggcttcatgccccaaaggagcaccgaggactccctttatacactaatgcagcatgtaaaagagaaactaaaggaaaaacgcattattaccatagtgtcattggatatagagggagccttcgatagcgcgtggtggccggctttggaggtccgattggctgaggaaaagtgtccggagtacttgagacgggtcatcagcagctatctcagcgatagaagagtctcagtgcgctacgcaggcgctgaatatgaaagggctaccagcaagggttgcgtgcagggatccatcggaggcccaattttgtggaacttgctcctcgacccattaattcaccaacttcaagccagaggtgaatacatacaagcatttgctgatgatgtggtcctggtcttcgatggagactctgcactgcaaatagaaagacaggcaaacacctccctcgaacatgttcaagcgtggggcgtccgaaataagctcaaattcgcgccgcacaaaacttgtgcgatgacaataacgcggaggctaaagtacgacacaccacgcttgaacatgggcggaacggagatcgccacctataaagagctccggatcttggggctcactatcgacgataagctcacattcaacacacacgttaggaatgtatgtaaaaaagctatcggaatgtataaaatcctcgcgcgtacagccagagttggttgggggttgagtcctgaggttatcagggtgatatatgtggcggtagtagagcctacagtgctgtacgcggctgcagtgtggcacgaatcggtatataagctgggagtccaaaaacagctaaacgttattcaaaggggcttcgctcaaaaactttgcagggcatatcgcacggtctccctgaactcggcactgttaatggctgggatactccctttggatcttcgagttcgagaggcagcctctctatttgaggccaagaagggggtatgccagtcatggcttggggacagagagatcgagcgaatgtcatcagcgatggatgcccctcatcccgcagagcaacagagtctggagtttggcaatctggtagacgaagaacaatacaacaatctcaaccaccttgacgtgagaattttcacggacgggagcaagattgagggccgagtcggggccgctttatccatttgggatggtgaggtcgagataaggtccctcaagcttgctctcgcaccctactgtaccgtctatcaggccgaactcctggctctgagctatgcggttaaggaagcccagctccgaaacgggtctacttttggggtctttagcgacagcaaagcggcactcctcacagtcataaatcacggttccctccatccactagccgtagacataagaaaaatgttaaaacaatgcgcactgcaaaataagaccgttgccttatactggattaaggcacacgcgggattggagggaaacgagcgagcagatcaactcgctaaggaagccgctctgctgtcgaaaaagagcccaaattacgacctgtgccccgtttcatacgtcaagcgaatcatccggagtggttcgcttgacgaatggaacaggcgatatcgggatagcgacagagcatcagtcactaaaatgttttttccggatgcagtagcggcgtacagcactgtaagaaagatgaggataactgggcacattacccagttcactacggggcacggagggttctccgaatacttggctaggttcaagtgtaagggggacccctcgtgtgcctgtgaacctggcatgccggaaacggttgaacacctgctgaccagttgtcccatttttgggaagcagaggtttgagcttgaaaataaaataaacaaaatcgtaaataaggaaaatttgtgtaaattgattgttgaaaagtatactaaggaattgtttatagttatgctgtacaaatagtaaaagtagtgaataagaaaaacaaagaatgaaattatgttatcacaatatcgtgagtatattgtagagtagcattaatggaagaagttaaaataaatagtagttaagtatagcgtaagatatagtcagtaagaaaaattgtaagtaaattattatgtagattaagaaattgtaataaaagtaaactgcccataacatcctagaccccaagttaagattagaattaaagtatgaatgagaagaacgaagtacgagagggataaatgatagaactggaataatagaggacggaatgcctgagaagaccctagactaagcaacaaaaatgaaagaccttatgtccagccttcaaagctttgcacccttgcagagaaaagagtgactt

SEQ ID NO: 92 - DNA, 7762 bp, Acyrthosiphon pisum
gaggaaggactgcgaccatgatcatcggaggggtgtccaagacggtcagggtcaccaagggttgtccgcagggctccatcctgggcccagtgttgtggaacgtgaccatggaggcgttactgaggatggagtcacaagaatatgtgaatatccaagcgtatgccgatgacatcgcagtcagcgtggcggggtccacaaggaccgccatcatcaatcgagcggaacaggcgctccagccgattttagcctgggcggactccagaggcctaagcttttcagcgcaaaagtcagcggccatgatgacgaagggattcctggctccagggtttacactggcattcgggcaggaaagaattgtatccgtgcatcacacgaaatacctgggcctcacactcgactgtgagcgaaagtgggatgtacacatcgacctcctctcggcaaagtcagatgatatgttctccagactacggggcaccatgggtgcaggatggggaatcaggagggttaacctcatgaccctgtacagaggcgttttcctacccagagttggatatggtgttagcttctgggcacacgcagcgagctctaaaacaagcagacagaaactgggcaaactacaacgcagaatcttggtgggtctgaccagcgcgtaccggaccacctcaaccgatgcgctgcaggttctagcaggggtcttaccattggaccttgagctgaaaatgatggccacaaaggaagactcaaggccacttccagagcatgtcaaacgtgccaccacaaacgcggcctacgaacaagtagtcgatgaatggcaggagaggtggtccaactcacagaagggtagatggacacacagctgttttccggatgttaggatcagaatgaacagtccactggccatggggcacgaagtggcgcagtttcttacagggcatggtaacttcagagctaaattggcgtacttcggaaaacagcccacagcgttatgccgatgtgggacagaagacgaagatgtcgagcacgtattgttcaggtgcataaggcacacagcacatagggcacacctggagttggcagtccttaggtcaggacatctctggccatgcaccatgaccgtactcgtctccacaaggagcctctacagtgcactagtcaggtttgcaaagacagcggcctattatgaagaggacgattgagagcaggacggacacgacactctgcgcgccagagtgccaaaccccacatgtgttctgaacgagtgtcaaggagcgagaaggcagaagcggttcacatgtggggccgtcctgaggggacactcgtgcgtcggggacgcgggcggcgctgacgcggacaacagtggttcgcggacaaccggaggcgccgcggtgaccgaaagccttggcgagtaggtcacacctacatcgggccctgtgtctggggccatggaagaatacagacacagtgtaccccgcttgtcgtacgaggcgactaaaggggtggggttgcgacctacgcaccgtgggcgagcgcccacggtaaaggcccaccaagagcctgctgagcccaacgattaacatgatgataacaattttattttatcacagcttcgacgaaatatttggtaacgaaccgtatgttaatatgaccgagtctctgatagaagagaagctgcagtgttccgatgagatggcttcaaatagtggagcagagataacagcgtctttcgtaaaatctttaaaaacaaggtatgacaatttagtcgaagacgggagaatcaacattttgtacgaattggcgatacaagagtacgaccacaccaatataacaaaacatgccatagttcaaatttcaaaagataatagaatacacaagtgcgcgtacggaccggtgtcggtgttgagtcggtccgataaaaccccccctcgtggggcccgtttttgtgtgcttccataaggaatacacggccgcccgccggtattgccgagcgatttttggataatcgtcagcttcgagaccaggcgtcaagagcctgacgacgtgagttcggacttattatataacgtaattacgtaataccacgcaaacgtgaccccccaccaagtggctggtataggtagtataccacccctccctaaaattttaattggcgataactaccaagggaaaaagggtacagaccccggacccagggggaactcaatttttgagcacaccgcttgatttcccgtatacgggaacaaagcccccaccccccccccccccgatttgagttaagtataactccgtgggtaatcaccgcaaaaccctaggggcaacggttatcggttaccctaggtcagggccgcaattcgacccaatagggaacggggtacccccccaccccccattttggttttcgttttttgggcagaaatctttcagttagaccttcagtacccatacccccgaggggaaactcggggttttgagttccctcccctccagagggatgtcaacacacagtaccatggatgaggatgaagggttgcaggacgcccaacaaggcacgagtcaaccacaaaggacgcagagatcgccgaacaccccgggctcttctccgcaacataagaagaaacgaggctcagcagacccggtacctatagcccgcgaggccatcaagtggatcagatatacactagaaatagcgtcaacaaagaaaacgaacattactgctgagacgcagcgcagcctgttcgccaagcttgaggcgttagaggggtcgatccacgacatggtcattgcaaatttaacgctgcagagtcaactcgaagagtcccacaggggggcggagatttgtatgagcgcctgcgcggctcaatttggaactgagctacggttgagggaagctgctcatgagcaaacgctggaggctgttgtggccagatatgcagccagagaggtagccagggaggaggatgctgcaagagttggaaataccgctcaacagcctgtggaacacgaggagcatacgttcgcccaggtaacggaacatggacggaggagaaacaggggcgataggccaccagccgtccgggctgctgagaggtcgaaatcaagaacggccaagagaacaaaacttctagctgagagcagaaatgaggagcacagacctgcgttcattattcaatcgatagatggcgctaaggctagcgacaccagcacaggtatctggaaaaaggtgatgtcgaagaaggtcatgccgagatgccaaacgatcaccacgaagcaggggaaagttatcatcaagccgttgaacaaggaaacggcggacgtgcttaaatcgctttccttggaatccgacgaactccaagaggaaccattgatgtggcctagatttattgtcaggggggtcccatcctgcatgccggaaagcacaatccaggaggctatcctagaccaaaacccagagctaggaatcgagccagggtgtatcgacagagtcttcaaaccggtcttcaaacgaggcccacgggacagagaggacacgaactgggtaatggaagtaaaccccccctattacgaaaacgtaaggaaagtagaacacctatacattggcttcacgaggtgtaggatagctgaatatgatgaggtcacccaatgtcatgtatgcctgagacatgggcatccagcggccaagtgcaacgaaaagcaaccaacctgtgcccactgtggccgcaagggccatttggctgatgtctgtccggctgcggaggctgaaccgtcctgtgcaaattgtcatggcaagcacaacgccagagagagatcctgctcggcaaggaccaatcacctggtgggaagagctaggaggaccaattacgggaaaacacaatgagcatctcttccctcagcgtcgtgcagttgaatatgggcagggcatcctccgtcagtgaccaactgctagagtactgccaaacgcacaacattgacattgctatggtccaggagccatacacgaacaggggtaggctgacgggcttcgaagttgcccctatcagaagtttcctgtccatggggacgaggcgtagaggcaggccagagtacctggactacggagctgccatcattgtcttcaacccggacctgattgtcgtgccgcgggaggccggcaccgtcgaaaattttgtcagcgttgacttggattgtggggaggaaggcaacgtcacgctcataagcggttactttaaatacagggtgcctacaccggttcacgtggtggctttggacggactaatccgtgatgccaatgagaaaaccatcattgctctggacgccaacgctttctcaaaaagatggtttagtaggatcaacgatgccaggggcgaggcactcgtgtcgtgcatagacgaacacggcctagtagttatgaatacaaggtgccaacacactactttcaatggtccgagaggccgtaccaacatagatgtaaccctcgcagatcaggtcctgcaacggagagttgccaactggtcgatagatccgggagccacatcaagtgatcaccaacttataaagttcaccgtagcgatgcgaacgaggacttttgaacatagggaaaccaggttcatccttcgcaaagcagcgtatcagcagtttcggctcgcatacgaagaactagcagctcgcagacagcacagggaaccaaaccttgatcataacgcatccagtataagcgaggacgtcaccgctgcagccatggctcacgcccccagagccagacgccgcaaaagagtcaagcccccatggtggacgaacgaattgcacgaggcgaggaaagccgtcagagccgcggcaagagcgatgacgactacggatggacgtcagttgttcaaccaaaaacgcaacgtctacacatctattttgcgcagaaataaaatcaactcgtggagggcgttctgtactgaggagggcaaacagccgtggggcaaactataccgttggctaagaaatggtagcaaaaggtattgctccataggcctaatgacgcgaccagacgggaccagatgcgacaccatcgacgaatcagttgaactgctattaaactcgttaattccgaatgacccgggtcagcagaggccagccccagcagaggaaactctctgtgatatacatccaatatccagcagcaccctcagggatttcgcttgggccatatcaccaaacagagcaccgggaaacgatggtataacaggcagaatgttaagagtgctttggccatgcttggaaagcagattcttgtccctgacaaatgcctgtatggagaaggcgcactttccaggctcgtggaagtccgcaattgtagtacctataagcaaaggtgaagacagagaccccggactgccgaagtcttacaggccggtgagccttttgccgaccatgggcaagatcctggagaaggtgataaaccacaggctacaggagcagatccagcctaattatactggcaaacagtatgggtttaccagtggcaaatccaccatggacgcggtgggcaatctcctgctgtggaacacccagagggcggagaaatacgccatgactgtgttcctagatatatcgggagcctttgacaaccttgcgtggccagccttacagtcagatctggagtccattggagcaacaccacacatgaggagatggatagcggattacctctcaggccgcaccgccacaatgactgtgggtggaatcactaaggatgtcagagtaacaaagggctgccctcaagggtcaatcttgggccccatcttgtggaacgttacgatggaagccctactgagaacaacatacccggagcacgtagcgatccaggcgtatgctgatgatatcgccatcagcattgcggcacaaaccagggtgtcactcattcagcgggcagaagaagcgctaaggccagcactggaatgggcacaccacaggggtcttacgttctccgcacagaagtcccaggccatgatcactaagggcagccttgcagcagggttcacaattgcatttggaaccgacagaattgccacagtggactgtataaaatacctaggcatctggctggatgaagagaggtcattcaagcgtcacgtagagaagctcctgggtaccgagcatacgctcttcacccgtctccgtggaacaatgggtgacggctggggcaccaagcgaaccaaccttatgacactatacagatgtgtgtttctgcccaaggtggcatacggtgttcggttctgggcacatgctatcgtttcgaaggcggctatcgccaaacttggatcgctccagaggagagcattaataggaatgacgggagcctatagatccacgtccacgttcgcgctccagatcctcgcaggtgtacctcctctagacctggagttaggttggattgccatcaaagaggaagcgaagctccttccggaccatctcagaaccgcaaccatcggagcggctgctgacgagcttctggatacttggcaagagcgctggtcggacactcagaagggaaggtggacctatgaatgtttccctgatgtcaggtgcaggctaaaactcccacttgcgttaggtcacgaaatctcgcaattcctaactggccatgggaacttcaacagcaaactcacggagttagggttaaagcaatccccgcgctgtgcatgtgatacgggcgatgaggacgttaggcatgttgtatacgactgccccacccatgaaccacacagggcccgtctcgagctggcagctcacagagccggatacgtatggccatgcgaaatggcaacactgacttcaaacaaggcaacttacattgcgctcgtaaagtttgcgaaggtagccgcatactttgagaggccacaacctcgtggttagcaggacgggtaagacactctgcgtgccagagtgccaaaccccgcatgtgaactgaacgagtgtcaaggtgtgagaaggcagaagcggctcatatgcggggccgtcctgaggggacactcgtgcgtcggggacgcgggcggcgctgacgcggacaacagtggttcgcggacaaccggaggcgccgcggtggccgaaagcttaggcgagtaggccacacctacatcgagccctgtgtctggggccatggaagaatacagacacagtctaccccgcttgtcgtacaaggcgacttaaggggtggggttgcgacctacgcatcgtgggcgagcgcccgtcgtaaaggcccatcaagagcctgctgagccagcgaatcctgggagaccgggcgtgccctgtcgaacatcccacaggtaatggcctacctaacgggggcgagaccggtaccacgggaaggggggagccccactgccccgagtcatgcccgggttagtgcccccctactttgggcgcgtgtcagcttgctggcgggcgcccagagccggtttggtttcgtggtggctgtagcgggagctactgacatggttcggccaaagctggcaggcgaaggtcttcagtgaacggctgtaccgtctcggggacgcgagcccctgagtcgttgcagttcctcttggatgtcgtggcgaccccgcccgaccgagcatgctcggcgctaagagatcttcacggcctccacaatgtatgcaactcgcgaaatcccgccgcgagccagagggtccagggcctagaaccagcacctggcggtaggtaaaaaacgcaaaggagtaaacctcaaatcaaaacatgaacggaacaacaaacaaaacaa

SEQ ID NO: 93 - DNA, 6108 bp, Tetraodon nigroviridis
  modified_base (480)..(480): a, c, g, or t
  modified_base (594)..(594): a, c, g, or t
  modified_base (1964)..(1964): a, c, g, or t
  modified_base (2319)..(2319): a, c, g, or t
  modified_base (3202)..(3202): a, c, g, or t
  modified_base (4007)..(4007): a, c, g, or t
  modified_base (6092)..(6092): a, c, g, or t
cttcttcttcttcttcttcttcgtgtgggaggagtgtgagtggaagagcagagtggagagtgaaagtctttggcttgttttctcctttttattacacttttttcgcggtgaattgtgtcagtgttttgtgtttcacttggtgatatttggggttagtttgtgtttgttttttgtgtgttctggtggtgggagcgctgttcgggagccgtaatggcaaccgacagcctcaccaagctgtcgcggaagcacggcgtcaaggtgggcgccggctccccctgcagcgtggaggaggtagcgctggcggtgggggagataatcgggcacagctctgtcaagtctgctgcccgcatgaacaaggcggtggtgctgttcctggagaaggtggaacaggtgaacaagctggtggaaatgggaatcactgttaacgggctgtttgagccggtggctgccctgacgcagccggcaacgaggatcaccctntcgaacgtgcctccgttcatcagtgacgagttcctcgttaatgagctgtcccgtcatggaaaagtagtctctcccatgaagaaaatcctgtccgggtgtaaatcaccgttgctnaagcacgtcgtgtcacaccggcggcaggttttcatgatcctgaacaacagatccgaggagttcgactaccgattcatggtgaaggtggacggctatgattaccagctgttcgccacctcctcgctgctgaaatgttttggctgtggggaggaagggcacattgtcagggcctgtccgaatcgggccggttcggccgggcggagcccgccccggcgggtccgccgccggcagatacgggaaaaacggcgcccgcggccgccgccgagaggcccgttcctgcggcgcgccggcggaccgtcggccccgcacagcggagggagctgcggcagagcagcagatggagcacggggatcacacggaggtgaccagcggtggaggtgtggaagaaatggtagtggagggagcaggtgaggtaggtgaggtggtgggcaacactggtgagaaggtgggtgagacaggkgaggtgcagggtgagacaggtaagagggtgggtgagacaggggaggtgcagggtgagacaggtgaggtgcggggggggacagatgaaaaggtggaggtggccggtgagagggtgggtggtaggagtgactcgggtgctccggggggtttagtgggtgaactaagtactgcaggtgaaacacctgacctgctaggtgaggtggtggagatcaggagtgagacgggtggcaggagtgagatggagacgggtgaggcagcaggcacacagagggagagcgctgccaccgcgtgtgccagtgccgtggaccccagggtgttagagagtgtgtttgtgtgtgcgtcggcgtctgctcctgcaaagcagcgcgccaagcgcaagaacgtgctgtcaggagtggtggaggggcgtaaggccgggcggctggaaggcccggcagccatcgctgctgtcagcgacagcgaggcagaggcagacatgtcagactgcagcgacatgtccaacgtcaccactgccagtcaggaaaataaatattatccagaaaatatgatcaaaatgttcctgcagcaaactaaaggcctcaaaggcctgaacatagaaaaatattttccggacaagctcctgtttttaaactcggccaagcacattgtgaaaaacaaaatcacgaccgagctcacaaaccaagaggtttttagactaaaaaaacatatggtaaaagtgaggaaggagcttgatttttaaaacaaaatgatggatacattgattttagttctttttttcatcgccagtgattttaacctctcccacaacatggagtcttttagagtggggacgttaaacgtcaacggcgccagggtggcagaaaagagggctttggtgtttgacacagcacggaggaaacgagtagaggtantgtttttacaagaaacgcacagcgatgagcacaaccaggcagactgggccaaggagtgggagggacaggtggtcctgagccacctgagcacggccagtggcggggtggggctgctgtttttaaggtcttttactcccacctcagtggaagtggagcacgttgtaaaagggagatgtcttttagtcacagcatgttttaatgagcgcaccgttgtttttatcaatgtgtacgctccaacaaacggcacagagaggaagagctttttagagaaggtcagcgccaggctgaaccgctgtggcccggaggattttttaatcatgggcggggattttaactgtacagartgtgagtttgnagaccgcaaccacgcagagcctcatccaggatcccaacacgctctgaagcagctggtccactcccacggcctcgtggatgcgtggaggaggatgcacgcagactgccgtcagtacacgtggtcccgcctaggtgaggacaggatttctatggccaggcttgaccgtttttatgttttcaagcaccattttaatgctcttaaaagctgtagcatcacgccagccggttttactgatcattctttggttttatgtcatgttttcattaagaatgttttaccgaagagcgcgtactggcattttaattctgtcttaactagcgacaaaggttttagggaagcgcttatttatttttggactgcttttagacgcagaaaaagtgattttacgtgtcttaggcagtggtgggaccacggcaagacagaaatcaggctcctgtgtcagcagtacacgctcaacgtcacacgcgacgcctgcagatctatcagagagctggagagccagatcgtggacttggaaatattaagtgcgtccacagaaaatcgagggcacattgaagccctcaagtcaaaaaaaatggccttgaaagacctgctgggcaccaaagtgcaaggtgcactggtccggtcgcgggtccagaacatcgcggagatggatgccccttctagcttcttcttcggcctggaaaagcgacacggtcagaggaaggccatccactgcctgctgtctgacacggggcaggaactgaccgaacctggccagctccggaagcgggccacggagttctactccgccctgtactcaagcgagtacagggagagggaggacctgttcgaggagttctgtggtgggctgcctcaagtctccgaggcaacaaacgttcgnctggacgggccgctctcggtgtcggagctgcacgccgctctgcagagaatgcagggacggcgggctcccggcatcgacggcctcacagtcgaattttacaaagcctattgggacattgtggcgcccgacctcctggaggtctttaatgagagcttgagttcaggttccctgccagtgtcctgccgcagggccgtcatggccctcctgcctaagaaaggcaacctgcaggacatcaggaactggcgccccgtgtcgctcctctgcaccgactataagatcttgtccaaggtgttggctaccaggctgagggaggcgatggaggaggtcatccaccgcgaccagacctactgcgtacctggcaggtctatcgtggacaacgtccacctcattcgagacgttttgaaaacctccagccttttggggcttaacactggtctgatttctctagatcaggaaaaggcatttgaccgtgttgagcaccgcttcctgtggaaaaccatggagaggtttgggttccgcacgagcttcattgccaagatccaggcgttgtacggaggcattgagtctgtactcaagtttaacggcagtctgtgtgctcccttcagggcgtgcagaggtgtccggcagggctggcccctgtcgggcatgctctatgcgctctccctcgaacccctcctctgcaaaatacgctcgagcatcgctggctttgttttaccgggttttaataagaacatcgttttatccgcctacgccgacgacgtcgtcattttaacacaaaaccagagcgacgtagacgttttatctngactaacagactcttttaacgttctgtcttcagcaagggtaaactggagaaaaagcgaggccctcgccgtcggcgagtggcgagacggtctcccagttttaccccagagtctgtgctggaaaagagacggttttaagtacctgggagtcttcctgggagatgaagacacagaaaaaaagaactgggaagacatcccaggaaaggtagaaggaaaactgaaaaaatggagatggcttaagtcccagatgtcctacagaggtcgcgtcctggtggtcaacaacctcgtggcgtcgatgctgtggcatcgattagcgtgcctacagccgccaccagggctgctagaccagatccaaaagaaaatagtggactttttctgggacaagaagcactgggttccccagggggttttattcctgccgagagaggagggggggcagggcctcatccacgtggccagcagaaccgccaccttcaggttgcagtttgtccaaaggtttctgacaggtccagcggatctggtgtggagagaaacggccagctgcttgttcagacgtgtgagtaacctgggactggatgctgctctgtttttaattgattctaaatctctaaaggtaaatgggctacctcctttttatcaaagtgttcttaagtcgtgggctctttttaaaaacactcttaaaaaaagctctaactctctgttttggcttttaaaccaaccgctcctgtacaacgccaaaatggacatctcccgcgaggccacgccgggtctgaaggcggccttgcttcgctccaggacactggtttttaaacaagtggtcgacgcagctgggccggcgctgacggatgccggggcgctgaggtcgcggctgggagtcaggaccaccgcaacggcagaccgagccctcaccctgtggaggaagagactcacaggcacagaaatactcctcctggccatgcacagcggagggatcgaaccgaacccggaggaccccttcccggacctgtacctgaccccacggctcggcgacacctcgggcccgctgctggagaaggcccgagaactgaacctccacacaggtgacaagaaagccatctacctaaactgtgtgagagtaacccacagggcgagactgaaccacagaccgccgaccgtgtggagcagcaggctgggcggggacgggggcactccgtgctggagagtcctctacaagccccccatccagaaaagaactgccgaccttcaatggcgaattttacatggtgccatcgcgtgcaacccgtcgtgagtgcttttagcagtgctgtgtcaaacacctgcccattctgtggccaccctgagactgtgtttcatttttttagcgagtgtgagagactcacgggtttcttcactcttttagcacaagtttttaatttatttaatgttgggttttgcgagaggacttttatttatggagcaggctataaaaagaccagccagaagaaatggcagcycctcaactttgtgtctggcacagccaagctggccatctacataaccaggagaaacaaagttgaggggcgtgcaggtcaggatgcagcctcagtctggcgctgctgcgtcaggtgcagactgaggctggagtttggtttttataaaatracggacgacctgcaaacgtttatagacacatggtgctttggccagattttatgctctgttgacaacaacattctacacctctcgaagattttaaactactaatttattgtatttgtgaataaagtgtgtttgtaaaaatcaaaaatcttcttcttcttcttcttcttcttcttcttcttcttcttcttcttcttcttcttcttcttcttcttcttcttcttcgtgtgggaggagtgtgagtggaagagcagagtggagagtgaaagtctttggcttgttttctcctttttattacacttttttcgcggtgaattgtgtcagtgttttgtgtttcacttggtgatatttggggttagtttgtgtttgttttttgtgtgttctggtggtgggagcgctgttcgggagccgtaatggcaaccgacagcctcaccaggctgtcgcggaanacggcgtcaaggtggg

SEQ ID NO: 94 - DNA, 2342 bp, Tetraodon nigroviridis
cgccagtgtgctggaaaggggatttcaattgtattttaagtaggaaggacagaagaggagcaggggaagattttaaggtagataaaacgtcggttttattacagggcatttgtagagattttaagctacaagactgttttaagaccatgcatccaagagaggagggcttcacactggttcagtggtgatggcaccagagcctctcgcattgattacatttttacccgtgattgcccgataaatgatgctagattaacccctgtgtttttctctgatcacctcatgctctcctgcaccctttcactctcttcaggtgtgacttcaggaagaggtctgtggaaactcaactgctcccttttagaggatagggagttagctgaacagtatagggagcagtacaaagagtggcagacccttcaagacatgtacgacacaagagcacattggtgggaaatggtgaagggaaggactcagactttttttaggcaggcaggaaagattaaaaagaaaaaagagactgcgcacatgttgggactgcaaaaaagattacagagatattttaaattgaatcaaaatggcattgattttattgaagaaattaaacaggtgaaaaatgaaatgtcggttttagcaaaaactaaaagcaaaggtgtcatcattaggagcagggagcgtgaaactgaggaaggggaaaagtgcacaagatacttttttaggaaaatcatgagcaagggggggactataacaaaactcaaaaaacaaaatgggtgcacagctgaaacaatgaatgagataaaagaaacgattgagaccttctatacaaagctttatgaagaaaaacctgtcaatactgccaccatagatgaccttttaaaatccatcagtaaaacagtgaaggacagtgtgcttttatcccaagattttactatttcagagttaaataaatgcatcactagttttaagaaagggaagtccccaggagaggatgggctccctgtggagttttatttaaccttctgggatattttagcacaagatttgatgactgtttttaaggattttgaacaacttgaccgacttcccgacagttttagagtagggatagtgactctcctttacaaacacaaggacaagacggacctgaagaactggagacctatcacacttttaaatcttgactgtaagctttttagcaagcttttagcaacacgtatgtccatgtttttagaggaagtgattcacccggatcaagcctgcgctatccccggtaggaagatcacggacagcctggtactgatcagagacaccatctgttatgcgagagacaggaacatgcggcttgtagtcctaaatctagatttcgagaaagcatttgatcgagtctcgcaccagtacctcttccgggtactggaaaaaatgggattcccagcacggtttatagcttgggtgggattgctgtacaaggatatcaccagcaaaattctagttaatgggcacttgacaaaagcagtagacatcaactgcggtgtccgtcaggggtgtccgttatcggcccttctctacgttgcctgcatagaaccgctggcacaggttttgagaagggaccaacgaatcaccggggtacgactgccagggagcgggggactagagacgaggtgtgttttatacatggacgacgtgaacattttatgcactgaccttttatctgttaacagagcgttggacttgactgactggtttggacgggcctctgggtcgaaactcaacagagagaagacacaagcccagtttcatggagcatggacaacgactgagttgacaggactccccctgactgtgaccaggactgaccttaaaatactgggagtgaaattcgacacggaggggggaggggaaacaaattggccagacttggtagggaaagttagacagaaactagggtactggggactccgggaactgacaatggaaggcaaggttttaatcattaaatcagtgattttacctttgcttttattgatcagttctgtttttatccctcccagactggtgcttttaaacttggagagagcagttttttacttcctgtggggatccaaatgggaaaaactaaagagagccgcgatgaaaaagcccagggaaaaaggagggaagggggtgcctgacctccaccttttcctgggaagcagatacacagcactgcacatcgcggctgttacgaccccttccagaaacccaaagacagcagccgtggcacgcttctggatggggtcgtacctcagaagactcgggggcctcaagggagacctcagagcaccagtttcttttgacctgccaagagc

SEQ ID NO: 95 - DNA, 4309 bp, Tetraodon nigroviridis
  modified_base (2507)..(2507): a, c, g, or t
  modified_base (4278)..(4278): a, c, g, or t
accccagccagccagccgggcagccaaggggggaggggatactcggcaaagatgataaaaaccttcctccaggagaccaaaaacatgaagggggtcgtcctggaaaattacttccccagcaaagaaaccttttataggtcagcaaaaaaccatctaaaaaacagaacagaggccgacctcacggaccaggaggtcttcagactaaaaaagctggttctgaaggtgaagaggcagatgggtctgcagtgagacctgagaaacgagcactttgcttttatccggattttataccgcttttaggctaacttatttttaaactctccgatggctaattttaaagtggggagtttgaacgtaaacggggccagagacgcccggaaaagaacagcaatttacgaactggcgaggctaaagaacatagacgttctcttcctgcaggaaacccacagcagtgaggagaacgaagcctggtgggacagagagtggcaggggcgcgtgttcctcagccaccacacggctggcagcgctggagtggccatcctggtctccagggccttcgctccggcctccgtcagggtggaacacgtggtcccggggaggtgtctgctggtggaggccggctttgagggcttctccgtggtttttatgaacgtgtacgctcccaatggcggtgcagagaggaagctgtttttagaagaagtcagtaacaagctaaagagccacaggacctccagctacttgtttttaggtggtgattttaactgcactgaagacggcgcagtagaccgcaatcacgcagagcctcatccagcctcccagcacgccatgaggcagctggtctcctgccacggcctggtggacgtgtggaggaggatgcacgcaggctgccggcagtacacatggtcccactacagggagaactccgtagcgttagcccgcctcgaccggttttactgtcttaagcaccattttagcacttttaaattgtgtaacattttaccggttgggttctcagaccactccttggtggtctgcagcgcttttatcaggaatattttaccgaaaagcgcatactggcattttaactcgactttagtatctgaccacagttttaaagaggctttaacgttcttctggtgcggttttaggaagaggaaggatgattttacctgtctcagacagtggtgggaccatgggaagaccaggatcaaacagttgtgtcagcagcacactctcaacgtcactcgtcacatcaccaggtccatcaaagatctggaggatgtcatcgtggaaattgaaagtctaggtgagtccacgggaaaccgagggtgctttgagaccctcaagaccaaaaagaaggcgctagccgacctgctgggcacgaaggcacagggtgcactggtcaggtcccggttccagaacatcaatgacatggatgctccctctagcttctttttcagcctggagaggaagagcgggcagaggaggtccatccacgccctgctctcggacaccgggcagcagctgacggagccggaccagataagggccagagctgtggaattctactcagcactattccggagcgaacacaaggacagcggggacctcttcaacgtcttctgcgatggactgccgaaggtgtctgaggagaccaacatcagtctccagcgtccgctgtccctgcaggagctgcacgccgccctccggacgatgcagagccggaaggccccggggatagacggactgactgtagaattctacaaggccttctgggacattctggctccggacctgctggaggtgttaaacgagagcctggcctccggaacgctgcccgtgtcctgcaggagggccgtcatcgccctcctacccaagaagggcaacctgcaggacatcaagaactggcgcccggtgtccctcctctgcacggactacaagatcctctccaagacgctggcgatcaggctgagggaagctatggagcaggtcatccaccgggaccagacctactgcgtgcccagcaggaccatggcagacaacgtctgcttcattcgggacgtcctgagcctctccagttcattgggagtgaacgtcggcttggtcgcactagaccaggaaaaggcttttgaccgtgttgaacaccggttcctctggaggctcctggaggggttcggcttcagcacgggcttcatcgccaggatccaggtactgtacagtgaaattgagagtgtcctgaaggtcaacggcagcttgtgtgctccttttagggtgcagagaggtgtccggcagggctgtgccctgtcggggatgctctacgcactctccctggaacccctcctacataggctacggtcaacggtccaagggctggttttacctggttttaacaagagcgtggttttatcggcttacgccgacgacctggtggtcttcgtcagacaccagggagatgcggacgcactatcagacgccaccaaccagttttatagaatatcggccgcaanagtgaactgggcgaagagcgaggccctcgcgctaggcgagtggtcaggtggccccccagtactccccgacaggctgacctggaggacggacggactaaaatacctgggcatccacctgggcagcgagaacactgaaaagaaaaactgggagaacataatagaaaagataaaagggaaactggagaaatggaggtggatccactcccagatgtcgtacagggggagagtgctggttttaaacaatctggtggcctcactgctctggcaccggctcacctgcgtggaacccccatccgggctgcttgaccagatccaagcagaaatggtcaacttcttttgggatgggctccactgggttccgcgggcggtgctgtttttacctcgtgatgaggggggccagggcctggtccacctggccagcagagctgccacgctgaggatccggttcgcccagcggtttttaacgggacctccagatctggtctggagggaggcggccaagtgtgtttttaggcaggtcgacgggctgggactggatgaggctctgtttttaaccgattttaggtctttatcaacaggcggcttgacccctttttaccgtagtgtttttaggtcctgtgcgtggctgaaatgggcccacagtaaggcgacctctctgcactggctgctggaggagcctctggtctgcggagggaggctggacattggctgtgccgccctgccgggactgacgggggcgctgaggcgctcaggagtggtcacgctccggaagctgctggaggtggcggggcccacgctgagcgacgcccaagccctgagcgtcgcaatggccatccgctccagccgttgggcccagaggtgcctggaatgctggaaacagcggctgtcgggcacggaaaggcacctcctgggaagatggtccaggggagaggagaggccggagcccacggacagcttccccgaccttcagctgagccctgcacccgcgcagccaggtggactcccacagggaccaggggaggagggaaggctgggcctgcatggagccgacggccgggccatctactccatgtgcaccaagatggccagcacccgagacctgggccagcgcccccccaccgtgtggactaccaggctgggaggccggcctccccagtggaggaccctgtacaagcctccactgaataagaggaccggggacctgcagtggagggtcctccatggtgccatcgccacaaacgcgttcgtggcgatgatcaacaggaacgccgcgagcagatgcccgttctgcagcctccaggagaacatcttccacatgttcacggagtgcagcagactggcctccttttttagccttttaaacgcggtttttaacacgtttaacgttcaattcacggtcccggtttttattggtggtgtaacctatgtaaaaaaggagaaagcaaagtgccagattttaaacttcttaagcggagaagccaaaatggcgatctacctgacccgcagggacaaaatggtagaccagagagtgtgtgaaccagccctgatgtggaaacagaacgtccgcgcaaggataaggctggagttctgtttctacaaggaaacaaagaacttagaaccttttaaagaactttggggatgggaggagagactctgcagagtcacagaggaggagaagctggaactgtcgagtcacctcctgtaaagactggctagcttttaatctttgataacatgtaaataaagtgtgattttaaaaagtcaaaaactntctctctctctctctctctctctctctctct

SEQ ID NO: 96 - DNA, 975 bp, Tetraodon nigroviridis
ctgccggtggagttctacaagtccttctgggacgtcatcggcactgacctgctggaggtagtctcagacagcctgaggacaggcagactacctctgagctgcaggagagcggtcatcaccctgctgcccaagaagggagaccctcaggagctaaagaactggaggccggtgtccttgctgtgcacggattacaaaatcctgtccaaggctctggccctcagactgagggaggtgatgtcgtccatcatccaccctgaccagacctactgcgtgcccggcaggctcattagtgacaacgtcactctaattagggacatcctggaactctccagctcattggccagacagactggtctcatttccatagaccaggaaaaggcttttgaccgggttgaacaccagtacctgtggcagaccctagctggtttcgggttcaaccctggcttcgtagccatggtccgagcgctctatagcgacatcgcgagtgtcctaaagatcaatggggggctaagcgcccccattgagattcaaagaggagtgaggcagggctgctctctctctgggatgttgtacacgatagccatcgagcctctgctccacagactaagacaaaaactggtcggtatctgctttccccagtgccccgtgtcttttaaactgtccgtctacgctgatgatcttattgttttaaccaactcgcaacaggacattgatgttttagcgaacactgttaatgattttggttttatctcatcagcgaaagtcaactggggaaaaagcgaggctctgatggctggaggggggctgggagaaggcctcacactgcccgggggtctccagtggaagtcaggaggattacgttatcttggagtcttcctaggggaggagtccttcatgagaagaaactgggaagattccctcgaaaagaccagagggaaactagaaaagtggaagtggctcctcccaaagatgtcc

SEQ ID NO: 97 - DNA, 581 bp, Acipenser ruthenus
catccccactgaattttatagagaattctgggatgagctggggaaagacctgctggccatatataaagaaagtttggcccagggagagctgccactcagctgcaggagggcagtagtaacgctgctgccaaaaaagggggacctgtgcgagataaagaactggagacctgtctcactgttatttgtggactacaagttgctgtcgaagaccctggccagtctgctgagggatgtcctgggctcagtaatacactcagaccagacctactgtgtgcccggcaggtcaatctttgacaacatatttttgattcgggacattttggaagtttccaagatatttggcttaaatactggtctgatttcactggatcaggaaaaggcttttgaccgggttgagcaccagtgtttgtggaggaccatgcaggccttcgggttcggccctgtcttcatagccatgactcaggtgctctatcgtgacattcacagtgtactgaagataaacggtgggctaagtgctcctttcagagtacagaggggggttagacagggctgcacactgtcaggcatgttgtactccgtgg

SEQ ID NO: 98 - DNA, 5570 bp, Takifugu rubripes
gtgagagaggagtgcaagcggaagggagagagagagagtgaaaaaaacggtgtgaaagcgcttttttttcctattcttttcttgtatgtgtgtgaatgctggatatatagtttgatttattgtggtgagtttcgagtttatattgttttaaggagtgtgtgtgagagtttgtgtggcggccgaccgcgtgcggccgtcatggcggccaacgccgggttgaccggcttgagcaggaagcacggagtcaaggtgggtgcgggctccgtgcttagtgtggaggaggtggctctggctgtgggccagaaaattggccacaattcaattaaatctgccgcccgtatgaatagggcggtagtgctgttcctaggtaaggtggaacaggttaatacgttagtggagacggggatcacggtgggcggacagttcgtacaggttactccgctaacacagccggcggcacggatcaccctatccaacatgccgccgtttattagtgatgagttcctggtacgggagctgtctcggcatgggaaggtggtctctcccatccgcaaaatgttatcagggtgtaagtcaccgctgctgagacacgtagtgtctcaccgcaggcaggtacatatgatcctcaataataaggcggacgagttcaactatcggttcatcgtcagggtagatgacttcgattacaccctttttgcctccgccctttttgcctccgccctgaaatgtttcaattgtagagaggagggacatctggcaagggcttgtccgagccgtgtggccccggacacgccggcggcggagcccgccacccccgcgcccgcggggccggtggcgccgcagcccgttccggcggcgaggcgtcggtggctcagtgcggaggaaagctccgctgccccagacggagcggtagcggagttgcggggggggggaagcgggacaagtgtgagtggagggagcgagattgttgaaatggtggtggaaatgaatggtgagagtggtgagtcaagggggaaggtggacttaactgtggtggtgagtgatttgagtggcgtgatgattgatggtgtgtgtgatttgaatgaactggaaaaaaatggtgaggtgatgggtgaaacagaaaaaatgggtgaagcaggagagactggggacacgatccaaacaggtaagctaggtggagtgagtcaagtgatgggtgaacttggggtgccagggatagcggctggtgagttgggagaggaagcagtgagcacaggtgagttgggtgaggaagcagtgagcacaggggagcgaggtgagggagcagtgagcacatgtgagggaggtgagggagtagtgagcacaggtgatggagcagtgagcgcaggtgagggcgctagtggtatgtctgagtggtggcttgttcccgcgaagcgacgcaacaagcataaatgtgcgatgaaggataagggagatactaaaaccgggcagctggaggatgcaaccgatggcacagacaccagcgactgcgagtccatgtcggactgcagttcgctgtccggcacaatgccagatgggcacgaaaacaatttgtaccctcccagcatgctaaaaaacttcctgacacagaccaagggcatgaagggccttaatctggaaaaacattttcccgacatgctcctcttcgtccattcggcgagtcatttgatcaaacatagggctacatcagacctcaccaaccctgaaatcttcaggcttaaaaaacatatgggcaaagcgaggaaacagctcaaaatataaaaagggcttgctatgtttccttgttttttttactgtccttgatttttaacttcacctcactatgcacactttcagagtgggaacgttaaatataaacggcgccagggacgaaaggaaacgggcactagtgttcgacacaacaaaaataaaacgagttgatgtcatgttcctccaggagacccacagcaaccggaacaatgaagcagactgggagaaggagtgggaagggcaggcgttgctgagccacaacaccaccctcagtggtggagtgggcctccttttctctaggggcttcactccatcgtccctggaggtggagcatgtggtgaggggacggtgtttgatggtgaaagcacgcctccaaaaccactccttggtttttattaatatttatgctcccaccaacggtacagagaaagagctttctagaaaaaaagtcggcactgttttaaatggttgtggggacgatttattattcttggttggggattttaattgcaccgagtcgtttttagaccgggaccatgcagatccccatctagcctcgtttttgtcattgactgagacagctggctattctcatggtctggtggatgtgtggaggaggatgcacacggacagcaggcaatacacatggttccgcctgagtgaagataggatctcctcggccagactcgaccgatttttattacttcaaacatcagtgttttcaggctgtaaaattatgccagttggtttcacggatcactcgttggttttaagcaaactcggtataaagaacattttgcccaagagtgcgcactggcattttaattccagcctcacacaggacactagttttagagaggttttacgccatttctggtctgggtttcggggtagaaaatccgattttatgtgcttaggacagtggtgggaccgtggtaaaacagagaaacagctcctgtgccagcagtatactctcaatgccacgcaggacacacgcagatcgattagagaccttgagacagagatagtggagctagagtcgattggtagctccacaggagagcgaggatatattgaaatcctcaagtccaagaaaatggtcttaagcaacctgctggacggtcaggtacagggtgcacttgtcaggccccggattcaagacttcactgagatggagactcccgctagcttcttttttgggctggaaaagaagcgcgggcagaacagagtgatacacccactgtttttgggcacagggcatgaactcgtagagccgggccagataaaaaagcgtgcagtggagttcttttcctccctctatgagagtgaatactgcgaggatgacgttgatgagttctgcagggagcttcctcgggtctccgatgaaacaaactcatggctggacaggccgctgcagctggatgagctcaacgctgacctgcatggcatgcaaggtcggagagctccaggtgtcgatgggctgactgtagagttctacagagccttttgggacattgtggcccacgacatgctggaggtatttaacgagagcctggcctcgggttccctgccattgtccaaccggaggacagtggttactcttctgccaaaaaaggttttagaggtctctagctcattgggtgttgatactggtatcatttcgctagaccaggaaaagacttttgaccgagttgagcacaagttcctctggaaggtgatggagaggtttgggttcaaccctggcttcatagcaatgatccgtgtcttgtacagtgacattgtgagtatgctaaagtttaacggcagtctgtgtgctcctttcagggtgcacagaggcgtctggcagggctgcgccctgtctggaatgctctacggcctttcccttgaacccctcctctccaagattcgtgcatgcattgatggcctgattttaccatcttttagcaaaaaaatagttttagctgcttatgaagatgatgtcatggtaatgctgtttagccaaaaggatttggatgttttagttaatttaatggtcttatttaattgcctgtctgcggcaaaggtcaattggcagaaaagcgaagccctggccgttggcagatggaccaatggtctgccggtcctcccccaaaatctagcctggcggcaggacggcttaaagtaccttggtgtttttattggagatgaggccacaatgaaaagaaattggctggacacaattgaaagagttgaaggcaaaattgaaaaatggaagtggcttctcccccgcatgtcatacagaggcagaactcttgtccccaacaacctggtggtctctgtgctgtggcaccgacttaattgcctggagcccccctcaggtttgttggctcaagttcaaagagttctgaacttcttctggaacggcatatattgggtccatcagggggtgctgtacctgcctcgagaggagggagggcaggatctcatccacccggccagcaggaccgccacctttagaattcagtttgtccagaggtttttaacagggctaacagatctaacatggagagatgtggccaggtgtgtcttcagacaggtgaataacttggtaatggatgacgctctgtttttaaccaactttaaattcgtcaaagtgaatgggctacctcttttttataaaagtgttgttaaggcacgggtcctaagggaacctgtagtgcacagagccatgctgaatgtctccaacaaagccacgcctagactgatggcagcactgtggacccggatggtggttctggagcacatagtggcctcggctggtccggacctcacgggctcagaggccgtggctctctgttggttatccgctctgtccaagcagccgaaggtgtgctgcaactgtggaggaacaggctcagtgcaagggagaggcatcttctcgtggactacagccgggggaccggaccagatggcgacgatctcttcccagagatcgagctggctgcccatctttggggatctgggtggtcctctccttaggccaacaaaggtattcttcctgcacgcagtggacaaggaaccctggaactgtgtcaaggtactgaacaggagaggactgtccaaaagaagcgccagtgcgtggcctgaccggttgggaggggatggagcccatccctgctggaaggtgctgtacaacccacccctgagggaaaggacgggggacctccagtggaggatcttgcatggggccgttgccatgaacatttttatctctagaatgaatcctgctgtctcagaccagtgcccattctgctccgtccaagagacagcgtttcacgcttacagtgagtgtgagagactccctgtgctttttaatgttttaaagggtgttttaaatggctttaatgaaacgttttctattagaaacggagcagggtacaagaaaactgttcggaataagtggcagctccttaattttatttggggtgaggccaagatggcaatttacatttctagaaaaaacaaaatagaaaaaaaaggagattgcgaagccgcctctgtgtggcgctgtaacatccggtgcaggctgaggctagaggtggggttttatgaaatgatgaatgacctaggtcaattctgtgacacatggtgtcacaagagtgtactttgcacggttgccaaagaccaattgcacatctccttcaggagtaactgcattgctgcttttattcatgtgtatatgtgttatcattattgtgttttaaacagggtgtttgtgtccctgtgtaattgtaaataaagtgttttttgtaaaaatccaaaaa

SEQ ID NO: 99 - DNA, 5660 bp, Anopheles gambiae
ggaagctgttggatgctgtcaggagttgtttacaaggacgaacgtcaaaatacgagctcctatataatagcggaaaatcgtgtgaaagcgtcaataagttgtgcggaatagtgcggaacgtgcttagtaagcctagggcgcttgcccgtgaagtggagattgccagctaggtatagagaagtgcaagagaacagcatcgtacggattcggcgccggcgaccccggctggggcggtctcaagccggtgacagttcaggacggcgacagcccaatcaccaatcatcaacaattcccaagcagaaaatttgaattggccgttggtggtgtaagatcggagaatcatcttaatacgttcctcgtatcacggcctagaagttaaatctggtggatgaggaaaattggcacgttcaccaaaaatactcccactatcccccatcacaccccccccataatcccctttactcggtgtgccttaacacggtcttaacaggggcggtaaagaccttcctcgatctcggtgaggcaaacacagatagtacttgagaaaaaaaaaagaaaaacccaaaacaaagctggaagggtaagaataatgccgtcggcactccgctccgggggtttaccggctcaccggctgtccagttcgttggaattaaaacaaaaaaagagtgccacgggaaccaacctcccttcatcacccgagatgttgatattgcggcagaatctggaagagaccaggaagaaaaatgagtctcttcaggaacagctaactcagttgagatggctcatggaggagaagctccgcgagcagcgagaagatgcacagcgtagagaggaagaagcgcgtcgcagggaagaggccgcaaaagccgacaatgagaagctgcgggtggaacagcaggagactcacactacattaattgcaatatcggcacagttgagagacctgcaacagaagaaccagatgaaaaggcagcagcaacatcagcctccccagcaaccagggccatcgacgtcagccgtctcattgcggaacgtagaggtgcaggctcaaccagaggaagacattgaccacagctcgtttgttgaggtagtgcgccgcaagccccgcgggataaacagcggcaagtcctctagtcagcaacgtgagcagcagcagagatcgcttcagcagcagcaacagcagcagcaacagcagcagcaacagcagcaagaacagcagcagcaacagcaacagcagcggaagatacgtcggccaaaggcagacctcatagaagttgttccccaggagggccttacatgggatagtgtgtaccgcaaggtacgcgacacagtgcgagatgacccagcacacaagaatctcgaagaacatattgggatgggtaagcgcacgcgagcggacctccttcgtatagagctcagccggtcggcagactccactctagtgctacaggaagtgcaggaaataatcggagggtctggagttgctcgtgtcgtaacggagatgacggaactactagttacccacattgacccacttgccgaggagcaggaattaaaagcagctctcaaagaagagctgcaggttaacgctggcgtgacagctgtaagcatgtggcaactctttgatggaatgaagcgggcaagactttgtttgccgaccaaagcagccaaacagcttgccggacgaaagttgagactgtgcggttgcatcagcagtataatggaagccatgcccgtctcggtagatcgacagcgatgctaccgctgtctggaaagaggccatctggcgcgcgattgtcaatctcccgtggatcgccaacaggcgtgtattcggtgcggcgcagatggtcactatgccaaaagctgcacttccgagatcaagtgtgctgcgtgcaacggtccccaccgcattggccatatctcttgtgctcgtcctgcagcgcgatgcctgcactaaaaattctacaactcaacgtagaccactgtcgggagggccaggccttagcactacaagcagcgcgagagcaccgtgctgacatattgcttctgtctgatatgcacaggccgcctgagaacaacgggagatgggcgtatgatgtatccaagaaagtagcggtagtagccaccggctcgtaccctatacagcgagtgtggggcagcgagctacgcggactagtcgctgctcaggtagccggtatcacattcatcagtgtatacgcccctccaagcctatcagcacatgagtttgagcgactattgggggccattgagttggaagccgcgtctcattcccgcgtcgtagttgcgggggacttcaatgcctggcacgaagagtggggcagcgggagaaacgggcagcgtgggatcgagctactgcaaactgtggaaacactgggactgtcgatcctcaatcaaggtcgcaaaccaaccttcatcggacgaggtttcgcggctagtagtgtcattgatgtctcgtttgcgagtcgggagattgttcgccccgacacctggtcagtgatccccttctcgaggtcggatcatgaattaatagcgttcgaggtcaaacaaccagatgagaacccggccggggcgcaacagcacctgtcgcaccgaccacaaaggtcgacacgcaagaatccagcaggccgacagcatgaccgttgcgatagtaggcgatggaaaacgacccaattcaaccgacagtcatttcgagtagcactacgcgccaacaacttccaggagagagcggtgagccatattggcatgatcgaggcacttgtcgacgcctgcagtgaaactatgcaacggatctctgggctgcacaagagcccacatcacgacatgtattggtggaccccagcgatcaagcgcctacgtgatgattgccttgccgcgcgagagagagtacaactgtctcacgatttggaggagaggagcatggcggcagcagctcaccgtacagcgaaaagtctgctcgagaaggccatccgtaccagcaagcgccaacagttccaagagctgatagacattgccgagaccaacgattacggaaccggttatagggtggtgatgtcccgactgcggggtagccctgggccgcctgaaacggatcgcgccgaactggagaggattgtctctgacctgttccccacgcacccacccgtatcatggcctgtctcttcagatgctccaacgaccgtcccatcagacagcagagtagaaccgcaagaactactatctattgctgccgggatggtaacgaggaaggccccaggtttggacgggattccgaacgctgcggtgaaagtggcgatagaggaatacacggaggagttttgtcgcctgtaccaggactgtctctctcgcggcaccttcccgccgcagtggaaaagacagcgactggtactactcccgaagcctggcaaacccccaggagagagcagctcgtatcgaccgctgtgcatgcttgacgcacttggaaaggtactggagcggctcattctcaatcgcctgaatcgtcacatcgagcaacaagactcaccgcagctgtctgatgcccagtatggattccgccgaggacgttctaccatcagcgcgatccagcgtgttgttgacgcgggcacagcggccaagttgttccgccgcacgaacacccgcgataaacgctgcctgatggtggtggcactggacatccgcaatgcattcaacactgccaactggcaggcaatcgccgacgcgctgcaaagtaagaatgtcccgtcatacctgatgaagatcataggagcctactttgaaggacgcaagctgctgtttgacactagcgaaggccctgtcgaacgtcacatcagcgcaggagttccacaggggtccatactgggccctacactgtggaatatgatgtatgacggggttttcggagttgggctgccgctgggggcagagatcattggctatgctgatgacctggtgctattagtcccaggcacaactccgacaacagcagcagcagcagcggaggaagcagtggcagcagtgaaacagtggcttctcgagcaccgcttggaactggctcattctaagacggagatgacggtgatctctagcctcaagcagcctccagaggaagtttttatcactttcggcggagtgaacgtgccgttctcgcgctccataaagtacttgggggtgcgtgtacatgcccacctatcatgggtaccccacgttaaggagataactctgaaggccacgcggattgtgcacgccgtcaatcgactcatgccaaacctccatgggccaaggacctcgatgtctcgcttgctggcaaatgtggccgactcgaccatgcgctacgcagcacctgtatggcacgaagcgattggcaatcaagagtgctgcagattacttcgtcgggtgcaacgtaagtcggcaattggcttggccagaacgttccgaacggttcgttacgagactgcagtgttgcttgcgggactcttgccgatctgcctggcaatcaaggaggacacccgagtgcacagtcgccgtggaacaggtttaaactgtgcaatacggagggaggagcgccagcggtccatggaagagtggcaagcaacgtggggcgcagacgccgccaacgaaagagccagcagatacgtcagatgggcacaccgcgtaattccggacgtgggatcctggcagtcacggaaacacggagacgtcacgttccacctatcccaggttctttccggccacggttttttccgggagcacctgtgcggtatgcagctcacgtcgtccccggactgtacgcgatgccccggcgttgcggagagcgcagaacatgctatgtttgagtgtccgcgattcgactcgacccgaacagagctgctgcacggagtcgtcccggaaacgctgcttgaacacatgctccagagcccagagaactggagtaatgtatgtgaggccaccaagcggataacatcagcgctacagcaggattgggacgaaacccggcgagagctggccgaacaaggcgccccacgtgtggccgataatcaacataatcaagataatgaccgcacctcgttgtacagtgcgaggaacaccagcgaagagcaacggggtagacgtcacccaacaccatcacctccacccagagcggtagggaggcgggcagaagtccgatctcttggggagcgctatcgcaggcagctactggtagttgaagagcgtcggcaaatatccggccacagtgtcggtggagttacctcgcaggaggatggaacattggtcgaggcgtctcgacaaggcatgaacggtgcagaaaagactgcagcgactgaggcagacgtggcatcacgctagatgatgttggtgatctgtggaggatcttgggaggaccaaagtatggtcaaaagggcgatctccgcatcctgagcggcagggaggacaaaacgaatatgaaagggaaagaaggggggaaataaacatgtgttaggtgcctggcgcacgggaaagagaggctccgaggagcagtaaaagccctccctcatagacccctcgcggggcaagagggaagggagtgggcgaggacaggggatataatgtgtaaatcaataagaacaataaaacctgtccgtgatctaaaaaaaaaaaaaaaaaaa

SEQ ID NO: 100 - DNA, 6448 bp, Anopheles gambiae
gtgtacgccccccccccacctccggttgcgctagaattccgggtgtggaaatttggggaaaaatttgtgttttcggccccggaaacactcaattttagtgaaattggtggtgctgaatcgttttatcgtgtttttgagacgatctgagcagtgcaaagtgtcaaaaagtgtttgtgtttttttccccatacattttgtatgggaaactttgtatacacatatttcagtgaaaactgcacggattttgtccggatgtgtcttgatagttgcgcgtagtgacgttccaagtgttgtgcgagaaaacggacgcgaaatcggcggaaaaacgcaaaaataaaaaagtgtcgggggtgctaccgccggagcacgtgttttcgtaaaaacggaataaatagttaatcgtgaataactccgtgagttttggtccgaatcgagtacggttttcaccgttgtgctagttttaacgcgtacaaaaagatccaatcaaaaaactagtgaaaatcattaaaaaaaatttgacatttctgggtgacagttcagcgatacccgtaaagcaaatttggtttgggaagcagttcccgaacagcaaaatttgaatttaccgttagtgctcgaaaactgctcaaatcctggaaagtgtgcgtgaaattcagtgaagtggtgtagcgtcagcgggagctcgaatctgctcgattcgaggcactcaaaaactgctcgaatttttcgaatctgctcgaaaaattcggaaaattcggagaagctgtagggtggtagagggcgacataacaaacacgggaaaactattttccaccctttccccctccctccctcccggtgaaaagtccctaaagcaaaaaactaggtccaaaaaagggtcgaaaaagcgggcagcgcagtttggacgtaaaaacgtgccgggaaatttcgggattggtgcggatccattccttacgtaagcgacgcaccctctcgtaattttctccacccggcacccctcccccccagcccaccaggggggttgcaagtcggaccgtagtggaaaaaccggcgtggaagaaggattctacagcagcgagtgagcggcagaacatcagctagacggcgctgcatacctggggtcatcccgaccccccggggtcaaccgacccccggggtcacatcgacccccagggttatctaacccaccaacttgtacgtcggcaaagatgatggcatcatccgggatgtcaacccgcgcgagtgcgaggtcggcctctgtggattgccgtagcagcttggcatccggttcgaagctgtttgcgcccgagcctcgagtggcactgccaagggttagcgtcacaggcatcaacaagcccaccgtagcaaccaaggccgcctcgaccacaccggagctcgagttgcttaaggcaacaattcagcaactggaggagcagaacttggaaatgaaggagcaaaattttcgcctcgcggagcagataactcgcatgtgccaactgctgcaagaggagaaggaggaggcaaaacgtcgagaggagaagttgaaggcacagatggagaagctcgctgccgcacatcagcgcgaccgaaacttgctcaactcgctactggcagcaaaggttgccggcggacaaccgtcagctagttcgcgtcaacctccaactccgttgccacgccgatcctctgcgcagccgcagcagcaacaacaacagcagcagcggaaccagcaagagcaggagcagccccgcgcgtcgacgtcgcatgcagtcatgctgccgcgtagcgaggcatcgacagccgtccgcggagacgtcgtgccggagctcacattcagtgaggtggtgcgtcgcaggtaccgtggcaaggccactggcaagccacgctcccagcagcagccacaacagcagcagcagccgcaacagaagcagcagcagcttcagcgtagacagcagcagcagcagcaacatcagggacagcggtatgttccgccgcaactccggcagcaagcacatcagcagcagcagcggcagcagcaaaaggttcggccaaggccggacaagatagaggtggtcccgagtgccggacactcctggtacactttgtacaaaacagttcgggatgcggttaaacaagacccgcacaagggccttgcagaccaccttaaaatgggcaagcgcagccacgccgcaaatttccgaatggagttaagtaattcggccaacgccagcctggtccgcgcagaaggtcaggagatcgtcggtgacgccggacttgcccgggtgatcaccgacatggccgatgtcctgataacgaacatcgatcctctggcaacagaagaggacatcaaaaaggccattgagagagaacaccaagagccgatcgaaatcgtccgagtgagcgtgtgggagcttcaagatggcactcagcgagctcgagtccacctgcccgctaaggctgccgctgctttcgaggggtcgaagctccgactgtgtggctgcattagcaaaatcagaggcgttgaaaaagcagcacctgagcgccagcgctgctatcgctgcctggagcgcggccaccttgcccacgcatgccgttcctcgacagaccgtcagcaactctgcatccggtgtggcagtgaaggtcacaaagcccgggactgctccagctacgttaaatgtgcggcctgcggtggacctcatcgcatcgggcacatgagctgcgaacatccggcttcgcgttcaacttaaaagtgatgcaaatcaacgtggatcactgtcaagcagggcaggacttggcgctccaagcagcgcgtgaacaccgtgctgacgtcctgctcctgtcggacatctaccgaccaccggcgaacaatgggcgttgggcgtatgatgccgccaaatcggtagcagttgtggctacaagttcctacccaatccagcgggtgttgcgcagtgctgtgcctggaattgtagccgcacagattggcggtatcgtcttcataagctgctacgcgcgaccgagacgcccagaggaggactatgaaggctttctggccgcagttcagctggaggcatcaacccactcccaggtcgtcatcgacggcgattttaacgcctggcacacggagtggggtagtgccaggaacagccagagaggtgaagatctgctgcagcttatccagagcgttcagctacaggtaatcaactccgggaatgaacccacattcattggcagaggagcggccaccagcagcgtcattgacgtctgcttcgccactccgtccatcgctcggccagaaacgtgggaggtgcacgagtttgcccggtccgatcatcaattgattacatacagcgttggggaagcggaacaacagtcccgcgggttgtcgactggtggtccgtcagccggccggcagcgcgttatctgcgctggtaggcgatggattaccacgcagttccacgtagacagcttccgttctgctctcgaggacgtgaacttcgcggaacaagcgacgacacacgctggcctagtcgacgctatggtcgacgcgtgcgacattgtcatgcagcgggcccccaacgtgttgcagcatcaacatcgcgacgtctattggtgggcaccggtaattgaagagctgcggaatgagtgcattgcggcgcgtgagcggatgcgcctaaccaccgatctgcaagagaggagtctcgccgcagccgagcaccggactgcgaagactcggctagaaaaagccatcaaagtaggcaaacgtgcagagttcgccaagcttatagacatcgccgaggagaacgagcttggagtggggtatcaggttgtcctgtctcatctgcgcggcagtcgtgtaccgcctgagacagacccggtcgagctgggacggatcgttaccgatctgttccccacccacccaccggtctattggccggaaaccgacgatgtcgattccggagcgtccgattttgatcgcgtgacccccgaagagctgcaggagatcgcggctcatatggctatcaggaaagcgccaggactggacgggatccccaatgctgcggtgaaggtcgcgattgagaagtacccgggggttttctgccgcgtgtaccaggactgcctcaacactggtacgtttccgcaacagtggaaacggcagcgcttggtactgctgcccaagccaggcaaagcccccggagaaagcagctcctacaggccactgtgcatgctggatgcactaggcaaagtgttggagcggcttatcctcaacagacacctcgaggacccggattcaccgcagctctcggacgcgcagtacggctttcgtcgcggacgatccaccatcagtgccatccaaagcctggtggacgcaggcaaggcgtcccgatcgttcggccagactaataatcgcgacaagcgatgcctgatggtggttgcgctggatgtccgcaacgcatttaatactgccagctggcagtcgatcgccaatgcgttgcgagaaaagggggtcccttcagggctgctgcggatactgcagtcctacttcacggatcgggagctcatctttaacaccagcgagggacccgtcgtacgttgcgtcagcgcgggagttccacaagggtccatactgggcccgacattgtggaacgtaatgtacgacggggtgctgcggattcccctacccgacgaggccaaggtcattggctacgccgatgatcttgtcgtcctggccccgggtaggacaccggaggagtctgcagcagtggcggaggcagcggtgtcagcagtcgaccagtggatgcagcagcaccacttggagctggcaccagctaagacggagatgacgattatctcaagtctgaagcatcctccaagccacatctccatcgacgtgagaggaactgctgtcccatattcgaggagcatcaagcacttgggtgtactggtacacgaccatctatcgtggatacctcacgtgactgcagtgacgcagcgggcggtccagattgcgcaggcggttggtcgactcatgccgaaccaccgggggccgaagatgtcaaagtcccgacttttggcagcggtggctgactcggtgatgcgttacgccgcacctgtatggcacgaggcgctgaacactcgcgagtgccgcaggctgctagagcgagtccagcgcaaatcagctatcgccgtggcccggacgttccggacggttcggtacgagaccgcagtgctgctcgcgggacttctgccgatctgcagagcaatctgtgaggacaccagggtgcacagccgccgtgggactgcagccggtgcacaactgaggaaggaggaacgtgagacgaccatcgccgagtggcaagcaacatgggacagcgatgcagctggtcatcaagccagtggttacgtccggtgggcgcaccgccttatcccggacatcggcgcatggcagtcgcggaagcatggagaggtgaactttcatctgtcgcagatcatctccggtcatggattcttccgtaagtatcttgcggatatgaaattcacctcgtccccggactgcccaaattgccctggcgtaagagagagcgccgaacacgcgatgttcgcttgtctgcgcttcgccgaggttcgcgaaaggctgatggacggcgtcaaccccgacacgctgctgacccacatgctccagagccagcagaattggagcaacgtctgcgaggcagccaagcagataacaaccatcctgcagcgcgaatgggacgacttccgcacgtcgttgtttgagcagggcgtactagctgacaacgcccagctccgcaatgcagatgtccttcgtcaggaaaggctgcggcgttacaacgaaacccggaatgcagcgagaagagccgcaacgcagcagcgacaggcagaacgcctgcccccaccaccgccctcaccaagaactgagcggagacgggaggtgaaccgtcttgcggtggcgagactaagggaacgtcagcgagcagctcgtgccgaaatgcacggcgcataccaaccagctccatctaacgatagcgatgacgacgatgacgacgttgaaaaccgtcaagcaaccaatgcagcttcaacgtcagaagcagcgcgaacggcagctgaagagtcccgcgtagggctgacagaagccgaggccgcagcagcggttgaggctgagttgtcctcccgctaggatgggtgatagaacaagcaggaagccttgagagggagtccttataaaacaaaatgggaagaaatagaacgaggaagggaaaaaaataaataaaaataaatgagttaggtgcgctttgcacggatgtaggccgctcgaaagagcagaaaaaccccctttagacccttcgcggggcaaaagtgtggcttaggtgagggttgggtctagacagtaaaatgaaatgaactgaataaacaacccgaatacttaaaaaaaaaa

SEQ ID NO: 101 - DNA, 909 bp, Drosophila melanogaster
  modified_base (532)..(631): a, c, g, or t
aatattttaatgtgtctttcaaacttgaagattctgattatttcttctatcttatcgtctttggcgattgccagcgactgcaatatccgtttatttaaatgaagccgatacactatcaatctaattgctttcacacttgaactgtgttggtaattccggccgcacacacacacacacacacacacacatacacacatacagtatggggacgaagtctacatcgccgtgaagacggacgtcttaaatcagcgctgcgcgaaatactcgaaaccatagtagttgtgtcggccggtgtgcgcggcaatctagcaaaaccacacggtggagtcgcgccatagttctgcgctgcaatcacgcgagttaattgttaattgtgcgcctgtttcaggcaaataggtaatttattatcttgcgattgttgcagcggataaaacagctgatagcgctgccaacttggcggagcgggcgatctggagagggaggcgttgcaagatcaaccgtgtgatcagtgttgtgttgcgacagtagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgtgactggcagtcccggtgagcgagcaaggactgtagagcacgcggaggtttttgttttagtacgtaggcataattccaatagggcttatgaatcgtgcatgccacctacggacggtaggtggtatctttagaagattttaattttcctaccgtaagtcaaataataaatacacacatacagtatgcatgtgtgctcacaatacggacaggtgcatctggtggtgccacatttgcatagctcacaattagttttctcattatcgcagataatatt

SEQ ID NO: 102 - DNA, 773 bp, Drosophila melanogaster
  modified_base (408)..(507): a, c, g, or t
catttacacatttacacatttacacatttacacatttacacatttacacatttacacatttacacatttacacattacacattttttggagacgaagtctacatcgccgtgaagacggacgtcttaaattaacgctgcgcgaaatactcgaaaccatagtagttgtgtcggccggtgtgcgcggcaaactggcaaaaccacacggcggactcgcgccatagttctgcgctgcgatcacgcgagttaattgtgcgcctgtttcgggtaaataggtaatttattatcttgcgattgttgcagcggataaaacagctgatagcgctgccaacttggcgcagcgggcgatctggagagggaggcgttgccagatcaaccgtgtgatcagtgttgtgttgcgacagtagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttgactggcagtcccggtgagcgagcaaggactgtagagcacgcggaggtttttgttttagtacgtaggcataatcccagtagggcttatgaatcgtgcatgccacctacggacggtaggtggtatccttagaagattttaattttcctaccgtaagtcaaataataaaaaaaaaaaaaaaacatttacacatttacacatttacacatttacacatttacacatttacacatttacacatttacacatttacacattacaca

SEQ ID NO: 103 - DNA, 1457 bp, Drosophila melanogaster
  modified_base (736)..(835): a, c, g, or t
cccacgaaggcagctttattgaacggcattccaccttgcttaccctttctggttgtcaaattctaaaaaggacttccccaatacgataaacttcattgcgcagcaagcgtcttttatgtgtgtgcgcgtggttggttaggggaaggggtggtgtttggtaccaatgggtcgaaactcccgtggccaaattgccgcagtgtgtgtggttgtggcaatttacgcataattttttattttaagttattgtgagcttgattacttttcttaatttgttttacttgttttttgcacccagccgtttgcactcgcaaatagggcccgtggccaaattgccgcagtttgtagttgttgcaatttaacacataattcactttacacattacacatcacacattacactttacaatgttcgggaggggacgaagtctacatcgccgtgaagacggacgtcttaaattaacgctgcgcgaaatactcaaaaccatagtagttgtgtcggccggtgtgcgcggcaatctggcaaaaccacacggtggagtcgcgccatagttctgcgctgcaatcacgcgagttaattgtgcgcctgtttcgggtaaataggtaatttattatcttgcgattattgcagcggataaagcagctgatagcgctgccaacttggcgcagcgggcgatctggagagggaggcgttgccagatcaaccgtgtgatcagtgttgtgttgcgacagtagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttgactggcagtcccggtgagcgaacaaggactgtagagcacgcggaggtttttgttttagtacgtaggcataattccaatagggcttatgaatcgtgcatgccacctacggacggtaggtggtatctttagaagattttaattttcctaccgtaagtcaaataataaaaaaaaaaaaaaaacaatgttcgggaggcagttaaggcagtccgaaggactccctgagggaaagttccaatagaacttccagaaggtttgggttgggtgaaatagctttattgctacgttgtagtgagaatgaaatagctttattcaaacaatatttatcaaataacatcattttcgggataccctgcaactcagtcttaataggaatattattctaggttcgtacaatgtacgtgtgccaaaggtgccattatatcacgtctcggtgctcactgtgctctctcattatcttattattttattattaattgggactttaacattcagcactgggtgcagtgcgcgttgcgcatacgcctactaaggtatggattgttacacaacccacgaggcagctttattgaacgcattccaccttgcttaccctttattggttgcaaaattataaaaa

SEQ ID NO: 104 - DNA, 960 bp, Drosophila melanogaster
  modified_base (529)..(628): a, c, g, or t
atccgccatgtgtttggtaatttttatcacagccttggagtaacatttcgttttctattttatagatttgtcccctcttaacgtgatttaaataatacctattacaaaacctttataaatgcaataatttaaaagatatttgaatagaggtgctccaggtgctccaacattcaattgaacaatagaatccagatagacaattttcagctgggacgaagtctacatcgccgtgaagacggacgtcttaaatcaacgctgcgcgaaatactcgaaaccatagtagttgtgtcggccggtgtgcgcggcaatctagcaataccacacggtggagtcgcgccatagttctgcgctgcaatcacgcgagttaattgtgcgcctgtttcgggtaaataggtaatttattatcttgcgattattgcagcggataaagcagctgatagcgctgccaacttggcgcagcgggcgatctggagagggaggcgttgccagatcaaccgtgtgatcagtgttgtgttgcgacagtagagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttgactggcagtcccggtgagcgagcaaggactgtagagcacgcggaggtttttgttttagtacgtaggcataattccaatagggcttatgaatcgtgcatgccacctacggacggtaggtggtatctttagaagattttaattttcctaccgtaagtcaaataataaaaaaaaaaaaaaaaaaaaaaaaagacaattctcagctgtcgtcttaattgaacaattagtatagcctctcacgttgctcatacgccatgtatgctcaaacggccacaatatatgcttatgtgactgcttgttatggaagcaatttcctgtccccgaacttc

SEQ ID NO: 105 - DNA, 1534 bp, Drosophila melanogaster
  modified_base (698)..(797): a, c, g, or t
aatattacgaatggggaatcaatctttaactcattaaatccaatttaaaaatgttttaatttgattgactataaatttcatcacctttaatatatatcagaattttaacttggtttataacttttaaattccctttaaattcagattttctgtttgctctaatttttgtcaccattcgctttataaattgaaataaatttaaaaagctgaaatatgaacattgtaggaacttatatacatagctgcgatgctataattgacattagacatataaagtaattcaattattcttctttggttaccttagccttccaattttggcaaaatttcttgccttcataaacatttatgtggttatgttgtccagcccccaataagcacccaactcacaccgcagccacaacgttaatgacaaatgtgtggggtgtgaatgtaattactggctcgatgttgtgtagtatgaactcatctacgacggcgtcacacgcagttggccaaacgtccgaatgtcctaccttcagcgaaatatgtacggttagcaattgcttcgaccagacgcacaaccactcacacacacacacacacgcgcacacacgctgtgcagtggggagatgtcgagttcccgcgtatttcgcacgtctttttgctgcgctgcgcgaatttcgtcatatacgagtccggtcagccgtaaactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgactggcagtcctggtgagcttgacaaggacaggagagagagcggaggtttttgtttagtacgtaggcataagccctcagctgagggttatgaatcgtgcatgccatccaaggacattagatggtatctttagaagatttcattttcctgccgtatataataaacacgctgtgcagtcacattaatctcgtaattaattaaaccaaagtccgggcataagcacaaaaagtgactacttaagccattttgtctcggaagccaacacatggcccgcaacgcacacaaaggcagcctctaactgacacatggacaagcacgttggacattaacttggcctacacccacacccacacctacacccgcactcacacaaccacacacactcgagttgagtgacaggcggcggttcttggttttggtgagtaacagcaacaaaatgaaacattaagtgagcggaaacggaaacggcggcctaagtgcgcgtgtgtatgtgtgtttcggccgtaaagtgttacccaaaaagccaacatccgctgaccgttggtacacttggtcctcggaattttatgcctttttagccctttgttcccagaacagcgacctgttgatcttgagcaaaaagacaaaggtttatattaagtttatattctttagggactgtagtgattaaataaaataaaattattaatgaaagaatcttgaaaaccacctaaatttagggtataagtaatatt

SEQ ID NO: 106 - DNA, 740 bp, Drosophila melanogaster
  modified_base (228)..(327): a, c, g, or t
aatattttttttttttttgaaacacttttaatgttaatgttacatcaaattaagtcaaattatttaataaatatactaaataattaaatatgataactgtttattgcaaaagtcatatcaaagacactagaattattctagtgttcgagttcccgcgtatttcgcacgtctttttgctgcgctgcgcgaatttcgtcatatacgagtccggtcagccgtaaactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgactggcagtcccggtgagcttgacaaggacaggagagagagcggaggtttttgtttagtacgtaggcataagccctcagctgagggttatgattagtgcatgccatccaaggacgttagatggtatctttagaagatttcattttcctgccgtatataataaaagcaagcatatatgagagcttatgtacgctcaatatgaagaagtaaataagctctgccaagggcttgctaagcgttcgctttgcaaattagatatagattttattcatacttcaattgtgtaagacgtgaatttgcctccgacattcgcttaagtttttttgatcaataaactttttttttataaaccaatacgccgcgaagttataattatatataaatactttttcgttttgaacttaatatt

SEQ ID NO: 107 - DNA, 740 bp, Drosophila melanogaster
  modified_base (227)..(326): a, c, g, or t
aatatttttttttttttgaaacacttttaatgttaatgttacatcaaattaagtcaaattatttaataaatatactaaataattaaatatgataactgtttattgcaaaagtcatatcaaagacactagaattattctagtgttcgagttcccgcgtatttcgcacgtctttttgctgcgctgcgcgaatttcgtcatatacgagtccggtcagccgtaaactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttgactggcagtcccggtgagcttgacaaggacaggggagagagcggaggtttttgtttagtacgtaggcataagccctcagctgagggttatgaatcgtgcatgccatccaaggacgttagatggtatctttagaagatttcattttcctgccgtatataataaaagcaagcatatatgagagcttatgtacgctcaatatgaagaagtaaataagctcagccaagggcttgctaagcgttcgctttgcaaattagatttagattttattcatacttcaattgtgtaagacgtgaatttgcctccgacattcgcttaagtttttttgatcaataaactttttttttataaaccaatacgccgcgaagttataattatatataaatactttttcgttttgaacttaatatt

SEQ ID NO: 108 - DNA, 4895 bp, Anopheles gambiae
ctggtattatcagtgttgcgtgagttacagtgcaaaggcccttcattcgtttgtgttgtgtgagtgtctgcaaattaagtgattatacactaggctcgctaggtgagttcctcgtaaattgattttcttcatgtgggattcggttgagcaaaaccaccaatgagcgggaacgaatcgctacctccccgtcctctggggtctgccttgaaggatataggcgcgttttttggccgtagtagcaagacgcctagatctcctccgtcggatctcggagagtgttcagcttctcctacggttgaagtggttgccagtacgtcggtcgattctgctgttgttgaagcggtaaccggcgaggaaaatgtgatggcagcagaggattccgtgacctcacaaccagtggaatcgttttcttcatcgaaagagccagcgcttgttgtcggtggaagcaagctgcaggaagctttaaaggtggctggagaacttcatgcctatacgaaagatcggaataacgttcaccatccgatcaagaagatggcagtgagcatcttatcggcgttagcctgtgttgaacgtgagctcatgacgacacggctgcgagcggaaaggactgaaaagtccctaaaagaggcgctagaaggctgctcccaaaccgagacgccagtgaatggtaaacggggcagaaatttgaggtcgactgaggaagcggacgatgctaagagagcaaaaaatgatgccccctctggcagctcgctggtcgcgagtgccggttgtggccccgaaatgaacgagacaaaggggtcgtggagcacggtcgtgcggaaaaatcgccggaagccgaaggaaagtgtcattccggataacaccggcgaaaagcaagttcaccctgcatctactcgggaggcgcttccgccgaggcgtccaaaaaccgaagccgtactagtggcgcccggcgaaaatattacccatgtggaaatcctccgcaagctaaaagcagatcctgagcttcaagctttcggtaagaaagtagtgcgaattcgaggaacaaaaaatggaggcttgctattcgaactgggcaaaagcgatgatgattgcggagtcgactacgccaaggtggttcagaattccattggcaacaatgggacagtaaagaccttaggccaaatggaaacggtggaaattcgatacttcgacgcagagacgcagaccagcgacgttgaaaaagatcttcgggatttgttcaccgagctggacggggtaactttcgagaccaagatgaccaaatccttcaacggaatgcagaccgcttcagtgaagctcccgacgaaactagcaacgctagtggcagcacgtggcaagattaggattggatggtcaatctgcccggtaaaaatacaaataccgaaaaggaggtgtttcaaatgctgggagacgggccatttctcccgcgattgcaaaggcccagataggaccgactgcgatgcggtgaaacagggcattttgccaaaacatgcgtcaaacctcccagatgtgtcctttgtccaccgggtacaaacatgtatcataccagcggcgttttctgtccagcgagcaagcagaaatcgacatggagatagttcagttgaacctgaaccactgtgaagaggtccaagacatgcttgggcaattgcttatagaggagaagggagatgtggcaatgctgtccgagccgtatcgctgtcctagcggcgtaaacaattgggtttctgactctacagggaccgctgctatttgggcttctggtagatttccgatccagcagatcatttcaaggcacggcgaggggtatgtgattgcagtcatcaacaaaataaccttctgcagctgctacgctccgccaagatgggatctagagaaattcgaagaaatgcttaagaggatttcagatgaggtgtacgatgttaatcctatcatcatttcaggagattttaacgcttgggccacggaatggggcagtaaaagcacaaacgccagaggaaacgccgtgttggagcacttttctagactgaacttagtactggtaaatgttggcttctgtcccacatttgtaaggaatagcagaacttccattatagaccttacgttctgtagtccagcattggcttcttccatgaactggagggtaagcaacgcctacaccctcagcgaccaccgagtgatacgctacacggcaggaagcaagtgccacagggttgcccagggctccggttttccagcctggaaaacacaatgcttcaacgaagaactgtttattgaggcattgaggtttggtgatttctcaaatacctcgtcagcattgaagctagcgtcagcgatcgccaacgcctgtgacacctctttgccacgaaggaaagggggaccttacccacgacggagagcttactggtggaccaccgaaatagcccagtgccgaagccattgcatcgaagcacgcagaaagatgaatcgagccaaatcctcggaacaaagggaggatctgagacgtttgtacatcctggcacgatcaaatctaaaacggaagatcaaggcaagtaaaaggagatgctttttagccctatgcgatgaggttgaaaacaacccgtttggtgcttaccgaacgctaatgggtaagatggtcggccaagacctacctagggaaaggaacccaaccgcgctcaagactatcattgaacagttgtttcctaaccatgagccacaaactccacgtgatatatcccgcaatcctgatgttgaacctgtgtcaatatccgctgatgaaatacagaaagcagcagaccatctcaaactggggaaggcacctggtccggacggtattcccattgaagcgatcaaagcagctatcaaagcgtacctggaagcttttttatcagtgttccagaactgcttcgatactggcttttttccgataccctggaagcgacaaaaactcgttcttctaccaaagcctggaaagccccccgacgacgcatcagcactaaggcctttagcattgatagataatttcgcaaagatactagaaatcctaatactcaaccgattagttgtctatacggaaggcgaacacggactgtcggacagacagtttggctttagaaagggacggtctactggtgaagcgatcgcagctgttctaaagaaacgacgaagcgccttgctaaaaaagaggacaggaaacagatactgcgcgatcgttacgattgacgtaaagaatgctttcaacagtgccaactgggaggccatacatgcagctctttccaagatgatgattccaccgtacctctgtaggctgctgagaagctatttagatcaccgtgtgtttttatacgacacagctctgggaatcaaaaaaatgagcctcaccgctggcgttcctcaaggttcgattttgggtccaactctctggaatgttatgtacaacggagttttgaccctagggcttcctccaggacctgaagtgataggttttgctgatgatattgctcttactgtccttggtgagtcaatagaagagattgaactcctcacatccgactccgtaagcagaatcgagtcgtggatgcaacaaatgaggctagaaatcgcccataaaaagacggaattcctcatcataagtagtcacaagacagtgcagtcaggtagcatccgggtcggtgatgaacgtattgagtcgatacgtcacctaaaatatcttggtgtgatcatcgatgaccgcttaagtttccggaagcatgtcgagtacgcctgtaacaacgtctttaaggcagcaatctcgttgatacaaataatgccgaacattggagggcccaagagtagctggaggcgacttctagctgacgtggccttctctcggttgcgttataacgctgcgatctgggcacatgttttggtgctaaaggaaaaccgacagttggcgaacagagtgcaccgattgctagctatgagagttgttcgtgcctacaaaacaatatcgcacgtggcagtttgtgttatcgcaagcatggttcccatctgcctcatattagcagaggattctgagtgttgcagtttctccggagtttcaaacgcgggattatccagatcctcagcaaagcagctctctatgagaaagtggcagtctgaatgggattgttcaacaaaggggcgtacgacacatgcactgatccccaacatcgctgcatggacgagcagaaaacacggcgaagtgaacttctacatgactcagttcctctccgaccatgggtgtttccggagttatcttcacaagtaccgtcacgcaagctcgccagactgcccagcgtgtgtgagcatcgtggagtcaacagaacacgtgctttttcattgtcctcgttttgctgaggaacgtcatgaaatcaccgtgaagtgcggaacaacaatcaacggaacaaacctgaccgagttgatgttaaagaatgcgggaacatgggaagtcatagcaaacggcatgcgatcaatactgttgaagctgtaagccttatggaaagcggatcaacgacttgggcgttcgtaaatagtgttgtgcgtattgtgaaagtgtttagtgtatctatgcacgaattgaagtgagcctgtaactcaagtgaatgcgtactttctgtgcttttgcgtggtattatgagtgtctccaggtttatcattctgtctcgcgaatgtggtccaagttgcaatagcgagatgtaatgctaatgcatagccctgccccaagaagcataccgaaaggtgaacccatggggaagggtagatggcccaaggagggggtttactgggtaaaaatcatatgtcaacacccgtgcgacaacgggagtctttcgaagattccccctccttgtaaaacaaaaaaa

SEQ ID NO: 109 - DNA, 5580 bp, Anopheles gambiae
gttgagtgatgagttggagttgagtcatgaaggacgtgcttttgctgtcgcttctgatcgaagctgtttttatagtgttttagtgcgattcgctggtgcttttcctggacaaggaatttggttctgcctgtggtttccgtgcgtgtagcgggttctggccgcgggcctttttctgctgaggggctgaagcgcggaacgtgctaatcttgtgcaacgcgggtgaagccgccactatagaacaaggtcgtgttagaaggaagtgcggttgtttgtagtggtgttgccgtggaaagtatctcgtgcatttaggatacacactgtaccacttaaatattgattgtgcgcgtgaagtatagttcggtattacgggtgcccctacgcacacttgagtttagcgagtagtgtaattgtgctggtgaagctagcagcacccagtgcgtgagtgactcgaacgtaagttctgtgagtttcagtgacttatcgttgcgttcgttgcgttgtgtgtggtatccaaacaccaccggtatactgtgtgcgtagtgagtgaattacgatcatcgagtgcgtgagtgcctttgagtttacgtgcggaagaagcattaagatgcgcatacacgtaccgtgcgcggttagcgtcttagggtgcgcatacactcaaagaactaaatgcgctgcgtgtctggattcgcctgacggaatgaacggaaacgaatcgcttcatcctcgtccgctagggtctgcccttaaggacataggcgccttttttggtcgtagcagcaagacgccaagatcgcccccgaatgataatgtgcagggttctgtttcaccggcggtggatgtcgttgaagttatgccggaagagcagacttcagccagcatggagtgccaggaaacttcccatcctatcaaggaacagggtttcgaggttagtgccagcaaactgcaagaagctctgatggtagcaagggagctgcatacgtatacgaaggatcggaacaatgtacatgctccgataaaaaagatgtcagtgagcatcctctcggcgttatcgtgtatcgaacgggagctgctgactatgaagttgcgagcggagagggctgaaaaggcgcttcgcgaggtccaatcggaacctccagaaacacctatgactgggaagagaagtaggaaagcgagaacgccagaggaagcagaggacgctaaacgagcaaaaaacgatgctccctcttgtaaccgtccagatgcagagtacagcgaaggggttaaaaactcagagaacggtgagctatggagcacagttgtcagcaaaaaggcccaacgcaagaagaagatgggaaccatggcggagggtaagcaaacaagagcgggtgaacacaacggcccagttaaacccgtaccgcgacgaccaaaaacggaggcaatcctagttgagacaactgaagtatcaacgcacaaagacatcctccgcaagcttaaagctgaccctgagctacagtcgttcggcaaacaagttgttcgaataagaagcacaaaaaatggaggattgctatttgagcttaagaaaagtgatcaaacggaatgcgaaagcttttccggaaagattcaacaagccattggtgaagctggcaacgtaaagtctttgggacaaatggagacagtagaaattcgtttcatcgacgaagaaacggaagcagctgacgtagagagggatctgagaaaccagataactggcctcgaaggctataaggtggaggtaacgatgaagacttccttctctggtatgcagaccgctctagtgaaactcccggtaaagctggtgtcggtggttacaggagcaggaaaagtgcaaatcggttggtcagtctgcccggtgcgtataaatataccgagcagaagatgttatcgctgctggcaaaccgaccacatttctcaggactgttgtggaccagacagaagggactgctgcctgcgtggcggggaaaaagggcacttcgctgctacgtgtcgtctgccaccacgatgtgtgctttgtccagatggatccaacgcgcatcactctagcggagcattctgtccggcggctaagaaaacagcaccatggaagtagcccagataaacctaaaccattgtgaagaggcacaggcactactgagccaggtgatggtggaggagataggagatattgccatagtctctgagccatacagcgctccaacaggctctagtagctgggtggcagataagactgggaacgctgcaatatgggtgacaggcacaatacaacgggtagtatctaacaccttcgagggtttctgcatagccgaagtaaatggagtgtttttctgcagctgttatgctcccccaagttgggagctagagaggttccatgttatgttagacaacctcgtagcagagctggatgggcatagaccacttgtaattgccggtgatttcaatgcctgggctgttgaatgggggagcaagcgaactaatagcagaggtgatgctgttctcgaaagcttcgcccggctgggagtaacgctgggaaatgccggcacaacccccacgttcaacagaaacaagaggacatcaatcgttgatattacgttctgcagtaccaccctctcggagagattgaactggcgagttagtgatgcactcactctcagcgaccataatgttgtcagatacgccatcatccaagggcataggctaacatcatcatcagcgcatgggtcccgagttggtggtagaggctggaaaaccgaatccttcaatgaggatttctttaaggagcttttagctttcggagatttcggcgaagccgtgagcgcctctcaaatcgtgatagcccttaccaaagcctctgatggcgctatgccaagaagaaaacctcctaacggggcgacaagccgtcggcagcctgtgtactggtggaacgcgtcgattaaaatacaacgggctgaatgcgtagcagcacggcgcaaaatgcagcgagaaagatgccctgaagtaaaacaacaactcaggatcgtatacattgcggctaggtcagaacttcaaagagcgattaaagccagtaaaaggcaacacttcctcaagctatgcgacgaaatcgctcggaagccctggggacttgccttcaatacactcatgaataaggtaaagtcttcggaacctgtagaacagtgtcctgtaaagctgaagagcattattgaaactctgtttccaacacatcctacgatcaacacgccagagactgaccctgtgcctataacgagacaggagattattaacctggccaatcgtttaaaatgtggcaatgctcctgggatagatggcatccccaatatggcgatcaaggctgctatgttggcataccctgatgtgttcaaaaaacgtgcaccaccgaacctcagtcctacgatcaacacgccagagactgaccctgtgcctataacgagacaggagattattaacctggccaatcgtttaaaatgtggcaaagctcctggaatagatggcatccccaatatggcgatcaaggctgctatgttggcataccctgatgtgttcaaaaacgtgctaatgaacaccctgactaccggccagtttccgtcaatgtggaaaatacagaaattagtcttgataccgaagccaggtaagccgccaggccacccgtcagctttcaggcccttgggacttgtggataacctggccaaagtgcaagagatggtgattttggaccggcttacaaaatacactgagggaccacacggtctgtctgatcgccaattcggcttccggaaaaaacgatctacagtggacgcgatactggcggtgctggaaaaaggtattgcggcgtttcaacggaagcgatgtggagctcgatactgtgcgctcatcaccattgacgtgaagaatgccttcaacagtgctagttgggaggaaattgcggcagcggtagagcgcatgaagattcccccgcacttgtgcaggctgtcgaggaattatcttgacggtcgcgtgctgcagtatgatacggcggaaggagtgaaaaccaatgccatccccgcaggcgtaccccagggatcagtgcttggtctcaccctgtggaacgtcatatatgatggagtactgaccctcgccctccctcatggtgtcgagatcactggttttgcagacgacatcgctatcactgtctcagctgtgtctattgaggaggtagagatgctcgccaccgacgcagtcggtcggattgaccggtcgatgcgggacgcaaagctagtgattgcgcatgcgaagactgagttcatcgtcatcagcagtcacaaggtgcaccaaaaagcatcgataatggcaggaactgtacaagtcgagtctaccagatcgctgaagtatcttggggtagtcattgatgaccgactgaaatttaagagccacctcgaggaagcctgcaagaaggtcatgaaagcaataaatgcactagcggcattcactccaaacattggcggaccgtgtagcagcattaggcgccttcatgctaactgcgccatctcggtgttgaggtacggagcgccggtttgggcgcatatactaaaggagaagcagcaccagaacaccgtgaataaggtgcacaggaagttggccatgcgtgttactagcgcgtaccgtaccatttcgtacgaagcggtatgcgttattgcgagcatgatgcctctttgcatcaccctcgaggaggactcgaagaacttccggaaatcgcgtgcgggtgaatctttcactgagactgccaagaaagcctcaaggcaagcatcgatgcggcaatggcagaacgagtggagtaactcgttgaacggaagatggacctacttgctgatccccgacgttggagcatggctagacaggaaacatggtgatgtggactactttgtcacccaggttctttccggccatggctgttttagaagctatctgcacaggttcaatcgcgcctcttcatctcggtgccctgcgtgcaaggatgaagacgagacggtggaccacgtcatgttccactgccctcgattcgccgaggaacgcctgcagttgaacgagagttgcagagtagaagtgggctgttctaacctggtacaagtcatgctgcagcacaccgactcatgggaggcagcggcaacaacaatgcgtctgatcctgaccaagctgcaccaaaaatggaagcaagaccagcagctcggcgatatttaaattcgtcgtgagtgtatgtgttagtgaacgcgtgagtgcgcggcggaaaaagtgtcgtttagtgtctagtgtttcgcgtcgtcgtcatgaccgtcttgtgttcgcgtgataactgtcaaatctgtctcgcgaactttggctcatcgtgcagtagcgaggatgaaatgctaatgcataagcccttccccaagaagcataccgaaaggtgaacccatggggaagggtatatggcccaaggagggggtttactgggtaagaatcccatgtcaacacccgtgcgacaacgggagtctttcgaagattccccctccttgtagaacaaaaaaaaaaaaaaaa

SEQ ID NO: 110 - DNA, 3185 bp, Forficula scudderi
cagtagccagcacatagcggggagtagtaaatgcccgatttttcaaagtgctctccaggtagcaaaaaaaaaaaggagatgagggtattgcagctcaatctcaatcattgtgaagctgcgcaagacttattgacacaatccgtgcgcgaaatgaatatagctgttgccatcttgagtgaacattacagagatcgtgacgatgaagtatgggttactgacaccgggagagtggctgcagtgtgggcctgtggtatgcatcctatccaggtaaggatgaaagggcggactaatggttttgtgtgggtcaaaataaataacatttatatataaagtgtttatgcctcaccaaatacgtcaatagatgaatttgagaatttgttgggtcggatgatcttgaatatccgtacaaaaaaccccatcattgttgctggagactttaacgcttgggctctagagtggggcagtacatttactaacaaaaggggtaggttggtgctagatgccttttcgtcactgaatctggttctgatgaatactggcaacaggagtacattccgagggggtggtggatgctcgatagttgatctgactttcatgagtcggggcttgatgtccgcgggagtgtcgtgggaggtcagtgagcactatactcaaagtgatcatcaagctatcctatgtgtgttacatgagcataagaaataacaaatgccgaaggctgcaaatatgaatgggtggagggccaaggtatttgagaaagatactttcatggtatcactagaagatgctagggtggtggccacatcagatgtgaaagtcaacataataatgagtagagtggcactggcttgcgatgcagtcatgcctaggagactagggaataaacctcgacaactggtctactggtggaatgctgaaattgcggaacagcgcatgacactgtcttcgagctcgacgactataccagcgagccagaggaagaagtacgtttgaggttctcagagagctgaagcccgcagagccttaaagctggctataaaaaccagcaaaagaagatgtgcggaagagttgtgtgggggggtggatagagacccgtgggggagaccctataagttggtcatggataagcttaaaagtgcgtatggaacacctatcatttgccaagaagtgttgcgtaggatagttagtgatctattcccttttcaaccaaatggtggccttgctgaggtagaatgtgacttgagctgtataccacctgtcactaaagaagaactaattagagcctgtcgcagattgggtgacaacaaggcgccgggtcctgacggcatcccgaacatagctctaaaaactgctattcgggcttgccctgaaatgttcatagacatgtacaactcgtgtcttagtgagggagtgtttcctaaatgttggaaggagcaacgattggtgctcattcctaaaggggggggtccaccggataagtcatcgtcatatcgtccgctatgcatgttagactcagcggggaaaatattagaacgtgtcatttgtgacagattggatgaagcaatagagcatgctggaggactggccgagtatggttttagaaaggctcgctcaacgattgatgctgccacgttggtggtggacctagctcgtgaagcaatcgctggcaagagatggaatagggggtctaagaactattgtctaattgtctcactagacatcaaaaatgccttcaattcagcagggtggggatttatcagtgaatcattggtgagaatgagtgtcccaggatatctcagaagaatcatgtcttcatatcttaacgacagaatactgaagtacaatactgatgccggacctaggatgtataaagtgactggaggggttccgcagggttctgtgttgggtccgcttttgtggaatattatgtatgatgaagtcttcagattaaaaattcccgaaaatgccaaagtgatgggctttgcggacgacatcgcagtggttggggccgcgaagtttacggaggagatcgtacagacttgtaatgagaccattgatatcatccagcggtagctcgagagtgtcaacttacaattggcggaacacaagacagaagcagtacttgtgtcgagcagagagaaaaaggagaaagttactctaagggtagcaagctacgaaatcgaktctggagattccgtcaaatacctaggcatcttgatagattctagactaagctttagggaacatctgctgtatgcaagtaccaaagcggcaagaatcaacgtgactctctccaggataatgccgaattggggagaatcgagatctagtcgaagatttctgttggctggggtaataagatcggtgttgctctatggagcgccaatctgggctgaggcactccttatcaaaagttataggcggatgctggcctcggtgtatcgcctaagtgctctgagagtagtgtctgcgtaccgcacagtatctgatgatgtggtttgtgtgacagcaggaatagttccaattgacatcctagctagggatcgtcagaacctataccgtggtggtgcaggacagaccccaaacgcgaaaaccgactctataaaagaatggcaactgcggtgggatcagtcggagaagggaagatggacatacagggtcattcgtaatattgagacatgggtggggaggagctatggagaaatagattttttcctcacacagtttttgtctgggcacgggtgcttcagatcatacctgcatcgctttaagctgctggattcacctttttgctcgacttgtagtttggaggaggaggatgtgaagcatgtcttctttcattgccctcgctttcttggcgaacgcgaagagcttcgtctccagtttggtgaaccaccgacgccggaaacaatggttggcttcatgcttaagtcccaagacaactgggaaacagtttgtagtgttacagctaggattattaaagaactacgtcggatagagatggaatctcgaatattggagtaggagctggtacagctaaggcctcttcccacgaagttatgcttgacggcggtcccgtgggaagaacaaaggctgaagagagggtgggtaggtttagtggttaaaaatcccacactaccctgtagtacgggctacagggtgtctttagaagattccccccatccgcg

SEQ ID NO: 111 - DNA, 1105 bp, Forficula scudderi
  modified_base (123)..(124): a, c, g, or t
cagtagccagcacatagcggggagtagcaaatgcccgatttttcaaagtgctctccaggtagcaaaaaaaaaaaaggagatgagggtattgcagctcattctcaatcattgggaagctgcccnngacttattgacacaatccgtgcgcgaaatgaatatagctgttgccatcttgagtgaacattacagagatcgtgacgatgaagtatgggttactgacaccgggagagtggctgcagtgtgggcctgtggtatgcatcctatccaggtaaggatgaaagggcggactaatggttttgtgtgggtcaaaataaataacatttatatataaagtgtttatgcctcaccaaatacgtcaatagatgaatttgagaatttgttggatcggatgatcttgaatatccgtacaaaaaaccccatcattgttgctggagactttaacgcttgagctgaagtgtggggcagtacatttactaacaaaaggggtaggttggtgctagatgccttttcgtcactgaatctggttctgatgaatactggcaacaggagtacattccgagagggtggtggatgctcgatagttaacctggctttaatgagtcggggcttaatgtccgcgggagtgtcgtgggaggtcagtgagcactatactcaaagtgatcatcagatcatacctccatcgctttaagctgctggattcacctttttgctcgacttgtagtttggaagaggaggatgtgaagcatgtcttctttcattgccctcggtttcttagcgaacgtgtagagcttcgtctacagtttggtgaacctctgacgccggaaacaatggtaggcttcatgcttaagtcccaagataactgggaaacagtttgtagtgttacagctaggattattaaagaactgcgtcggatagagatggaatctcgaatattggagtaggagctggaacagctaaggcctcttcccacgaagttatgcttgacggctgtcccgtgggaagaacaaatgctgaagagagagtgggtaggtttagtggttaaaaatcccacactaccctgtagtacgggctacagggtgtctttagaagattccccccatccgcg

SEQ ID NO: 112 - DNA, 1103 bp, Forficula scudderi
cagtagccagcacatagcggggagtagtaaatgcccgatttttcaaagtgctctccaggtagcaaaaaaaaaaggagatgagggtattgcagctcaatctcaatcattgtgaagctgcgcaagacttattgacacaatccgtgcgcgaaatgaatatagctgttgccatcttgagtgaacattacagagatcgtgacgatgaagtatgggttactgacaccgggagagtggctgcagtgtgggcctgtggtatgcatcctatccaggtaaggatgaaagggcggactaatggttttgtgtgggtcaaaataaataacatttatatataaagtgtttatgcctcaccaaatacgtcaatagatgaatttgagaatttgttggatcggatgatcttgaatatccgtacaaaaaaccccatcattgttgctggagactttaacgcttgagctgaagtgtggggcagtacatttactaacaaaaggggtaggttggtgctagatgccttttcgtcactgaatctggttctgatgaatactggcaacaggagtacattccgagagggtggtggatgctcgatagttaacctggctttaatgagtcggggcttaatgtccgcgggagtgtcgtgggaggtcagtgagcactctactcaaagtgatcatcagatcatacctccatcgctttaagctgctggattcacctttttgctcgacttgtagtttggaagaggaggatgtgaagcatgtcttctttcattgccctcggtttcttagcgaacgtgtagagcttcgtctacaatttggtgaacctctgacgccggaaacaatggtaggcttcatgcttaagtcccaagataactgggaaacagtttgtagtgttacagctaggattattaaagaactgcgtcggatagagatggaatctcgaatattggagtaggagctggaacagctaaggcctcttcccacgaagttatgcttgacggctgtcccgtgggaagaacaaatgctgaagagagagcgggtaggtttagtggttaaaaatcccacactaccctgtagtacgggctacagggtgtctttagaagattccccccatccgcg

SEQ ID NO: 113 - DNA, 1556 bp, Colletotrichum cereale
ccaacgtatggcgaaagcaagcattgattttctgctaggctctgcacagggagcctcccttctatgcgaatggatggaggcgaccaatttcttttctgaaatctgccagactaattgaacaggaacgttaggtgaagacggcagcctgtaaaatagtttagattagcatcgaccatgtcggcatcgcccggcacgtccctcttcactctggacgttaaatatatcatcatcatcatcatctcacatttcgagatataaccaacagctgtctggcacaccaaattaactcccatattttcacagccaatttcgtgttaactccgatgttaacaaatggatggacactctacttcaccctttgccgacggagcgtggctcgtttggtttgtgaggttggcgagcataacaaggaatcactccatggtccaacagttagcctccgcggtggtggcggcggcgaacttgtcatgagtctggtttgcagatataacttactcggaatggcgcgcgagatgcaagcccgtctgactatgatggagacctcctctggtgcatgaacgaaggctcgaagatgatccaacgagcagaacctcagagttcccaggacatgcctggttgtggctggcactttgggtcaactgatactgcacagcagtttttctgctttccaccgccccattcgtacttcccccccttttttgactattacgataaccaacagcgagaccccgcctaccgttacgaatcgcccctggacgtctatgagtcgacagatttccagcccctggatagcctgagcttacgctgtgctgaggaggagtctgactacgccccagagtcggcacttgacctctcaacttccaactacccagttctgtgcgaggaagaccagttcattgtcagcgcccgtgcagaaaggcgccgatggggtgagatccaaacggaatacgaggcacggttcggcgcctcacgttcttcgacccggcaagccctggccatgaaactttgtcgtctcaagcaaaagtacccagagctcacgtcagttgtgggccacaagcagaggaagacaagaaggagaagatgcgaggaggcggcgggggggatccgaggatcatcacgaggggacgccatcgccgctgcgcagaccctgcttgactttctcggccagccagacaatggcaggttagtgccccaagctgattgtatagcagtcgtcagaataattggccagctctacaaggacgaatgcatttgttgagagaacaatacatagtaattgattggatcaaccgtaacataacatcagaacgtgactcgcgctgagaacaaaatgcatcatttcacgtcggcctgcaacgaccagttctccgtgttctccacatccacatgtgtatcggttcccaattgctcaacgttttccaacgtacgatacttgtcgtttaatcgaggggttgagctgcacaagtgcgttgagaccgaactcggccatactaggcggtatacatggttgtacagctctccctcgggtccgtttccgtcagatgaatgggtgtcgt

SEQ ID NO: 114 - DNA, 2137 bp, Colletotrichum cereale
ggggatatctcgtgcaatgaccgttcgcctttcgtagtaggcaggacacataggtgtgaacctctgtagtattcgacctgtgaaccgcgagcccacaattgaactaaaacaacacgcatgcctgcttctgggccacccttcctaaagcactcgatatggccaggcaattctttatatctcaaccagtgcccgaggttgcacttttcgaaaaggctttcgaggatggatcggatacgcttggaaacgtcagatacttgttgtaaaaagggttgacctacttaccacatcttcgagaacacgttgctgacagaagtccaaaccgtggggcgacaagtactggaaacccttctgctcaatttccgagacatgcccaccgattgtcgagtcgtgtagatcaacaaagccttctttgtgtagggagtcctcggcagtttcaatcgagaaagttgtcgactccatcagcacgtactggtcgatgatgtgataggcgcatgaaaacgatgttgggtcgcaaaattctgggtttgggcaatttggatggcccggattatagtttgaccgtcagccttactcggtggtgagccgggggcaggcgggggtttgcgacagaaaaaggctcaacccaccaatagtccttttaagcaataatatgcctccgaggatgcgggacctcctttcgtataattaaataagcgcaatgaaagtatttctacttggaacctattcgcgtgacccagctttttgttatccgctcaccggaacacaacttgaattttgtccgccactaaccggcaattaagcgaacgcccgagccgcagccgccctgttatcttcctatccaggacattctccgagtaccttcaaatcagtgtagcggctcggtgcctgatgccaaaggcgaagaagaccgcgggcatatctcgcgactcggggctatcctacctataagcttcacctagccagcggtaaatctccaggcggctacccaagcgatggcgtttcggaccgcccggcagccttcgccgctccgggccccgcctcgatcttgacctctctcgcctaacagcagaccgatctcgaacactcgctgcaaagatcgacaagcccaactaccagcaccgacagcgcaactgggcatggaagaactttctattcacaaggtatccactgttagtagctgttaagatcatagagggctccggcccaccgcactatcatttctcatcatcagcccacgcgagctgaatcccacgatcatggccgtctccctagatgtagggccaacgatcacggtccacggggacgccagcacttctcgacggtcgggacgagtccggaaaccgaccgcaaaggtcagagtggttgagcaagtcaactaccaagacaatgcggagcttaaagacgagatcaacaagctctcaaacctcgtccaggatctcctacgacgggacgccgaaagggaacagttcctgaaagactgtttgaagaagatcgaatccttggagaaagagcttcaggaagagaagcaacgttcagaccggcaccaacgcggactagcaaggtccatgcatgctgttagcacaggacccagcgagtccgccctgagtctccaagggcatcccttacacatagcccagaaccagccgcctccagctcggtcctacgcgacggtggcgagccagccgcttaccagaaacctgcatgaaccaacgccagcaaaacaagccgcaaaccgggcggcctcgaaagacctacgcatcttcgcacgtctgccacctgaaagcccgctccgcaacgagagagcctacgacatatacgtgttcgttcgagaaaagctaagtccccaagctcgagaagccctcaaggggatcgaccatgtcaagacaggattggcactcttaccttcatcagcagatggggcaaaagtcctgctggagaacagagaacagattgctgcccttctccaggcacaggcggtcgagcagcgcgatacctggatccgggcctatatcgcaaacgtcccttacaccagacactgcctgctcaccaacactgagctggaaatcacgaccgaggagctccttgaagagatccaggccacgacgaaactcaagcccgaaaaagcatacttttccag

SEQ ID NO: 115 - DNA, 465 bp, Characidium gomesi
cggtgacaaagggcagccctgacggagtccaactctcactggaaacgagtctgacttactgccggctatgcgaaccagactcctgctccgtttgtacagggactggatggcccgtagtaaagagccatgtaccctgtactcccgaagcacctcccacaggataccccgaggaacacagtcatatgccttctccagatccacaaaacacatgtggactggttgggcaaactcccatgaaacctccaggatcctggagagggtaaagagctggtccagtgttccacgaccaggccgaaacccgcattgctcctcctgaatctgagcttcgacaatcagccggactctcttctccagtacccctgcatagaccttaccagggaggctgaggagtgtgattcccctataattggagcacaccctccggtcccccttcttaaaaagaggaaccaccacccccgtctgcca

SEQ ID NO: 116 - DNA, 466 bp, Characidium gomesi
tcggtgataaagggcagccctgacggagtccaactctcactggaaacgagtctgacttactgccggctatgcgaaccagactcctgctccgtttgtacagggactggatggcccgcaataaagagccatttaccctgtactcccgaagcacctcccacaggaaacccagaggaacacagtcatatgccttctccagatccacaaaacacatgtggactggttgggcaaactcccatgaaacctccaggatcctggagagggtaaagagctggtccagtgttccacgaccaggacggaacccgcattgttcctcctgaatctgaggttcgacaatcagccggactctcttctccagtacccctgcatagaccttaccagggaggctgaggagtgtgattcccctataattggagcacaccctccggtcccccttcttaaaaagaggaaccaccacccccgtctgcca

SEQ ID NO: 117 - DNA, 4482 bp, Kalotermes flavicollis
gagaggtcactgttgctgatcagctggacacctagctgactgcgtgcatgcgtgcacgccgcgcgccgcctcctcgtggtaccgctggtaacgcagggtcactgagactacctgcggctaaaggcgcgcgcgagggattgtaagtccaccacctccacgtggttccccgcgggcaacggcatagttcatctgccggccaagcgtgccgttccctcgatcctcctctgattagggataggaggggggcggtggctcccgccgacgacctggcaaacaccttggacacgctaagataataggccgtcctccgggccggccgaatcataagcacacaatggaagtccctctaacatcaagcctcggatctggggcaacccaagctcccgggaccccagaattattaggggagcacaccgttgaacgacctggccttgatcaaggacattcttatggtttgttaatggatgacgtagagctgccggtgaggttaccattttttgggcctctcatatgcccaggatgcaggacgctgctcacctctgaggaaacgattagcagccatcataggagggtccaccctgatgcccggacgaggtgggtctgctatggttgtgattccccatttatgacataccgggccattaaatgtcacttacctaaatgctctggcaggaaggtagtgacaggggatcacatctgtaatggctgcacaaagcggtttgagtctcagagaggtctctcactgcataaaaggagagcccatccgggtcttcggaacgaggaaatgcttgagcctcctgtgagagctgagcgacgccctaacgcacataaatcctcaatatggagcattgatgagattcgtatcctggagcaatatgaggctgcctacgtcggcgatctccacatcaacatgaagatagctgctcacctgccgttcaaaaccaataaacaagtgagcaactatcggaacgatcgccgtaaaaagtccagaacggcgactgacgcgagccaacagggacttggtcccaatgacggcaatagaggaattgtccccagcgggcagtcatccccgttatttttagagggctctgacgccgagggggacgaggatgtttttaatgtcctagtgccgcccaccctagggggtcttgaacctgctggacaggttcattcactctctgagggggaaacttcgccgctggtcggcgaagcggatccctgttttatgggtggcacgccgtctgccggagaggcctcgggctcaaccttgttgggtccggatcccaccccggcagatggatattctctggtcaggaaagacttacagctcagtgtgcagacatccccgttattagcagtgggctctgtcggcactgagtctgtgcaatttgaacgtggggtgttatcgtgcggtacgccaccagaatttttacacccggaacagtttgcacattgtgcaaacaatgacccggttttgaacgcgtcagaggagcaggtgcacgccccactaggggaagaagccaatgacctccctgacaacaaccatccgtcggagctgggggttgaccccgaagacccgacgtgtagtcccgcaacggaacaggtccaaccctcttctgaggaagaagccgatgacccgtttgcgcaattcaaggcgtggcgaagaagggtggcttcctatgccttgaagatcgagaccggggttcttccagcccaagtagatgacctccttcggagactgagggatggggacacacagtctaaggtaacgtgcgaggaggtggaggaagtggttttatccctcactagaacgatactgggtggcacggcacccaaaaagcgcgttgagggtcgaacgaagtggacgtacaaaagtcgaaccaaccatgaggctcgcaagcgtataatgtacgctagatgccaggacttatatcgcaggcggcctcagcgacctgtggagagggccgtcggataccaggcggaggaatctcttcttgacaaccaagatgagagaccatcccacggagcctttgaaaccttctatactgggctctggggtaagtccggtcaatgcaatatcacaatgcctcctggtgtgcctcggcacaccgggcatgtactgagggaagttacgccaaaggacatctactcgaggctgaggaaactaaagaaagactatgcacccggcccggatggcgtaactaaattgaaggtgcagagcatgggagcatatccctcacttcttgcaaaggtatataatctggtgatgctaaccggttacttctccagttgttggaaggaacataagacctctctaattcctaaggatagaggaagcccaatggatgtcagtaattggagaccgattacgattggctccttactcagtcggatttatacgggtctcatagaacggaggctgaggacagtttctgacatccaccaaaggcaggtagggtttatgcccgtcaatggttgtgccgccaacttgtttatatttgatgaatgcatccgacaagccaaaaaagaggggacaattgtcggcagtcttatagacgtcgccaaagcatttgataccgtaccccatgaagccatcctacgggcgttgagctcgcaaggtgtagatgagcacacgatggctcacataagagacatgtattccggtatccgtacgcggatcaacggcaaagggagcgatatccctctggtgagaggagtgaagcaaggtgatcctctatccccaatgctctttaatatggtgatggaccctctcatacgagacctacagaggaagggcttcagaattggcggccacgagataggggcgttggcctttgcggatgacatcgtcttgttggcggactccattgatggggcccaggatcatgtagatcaggttgggcgctacatgaataaactgggcatgaccctcaatccacgaaaatcgtcctccttcctcatcactgcgatgaggaagacctggatatgtagggacccgggcttgtcaataggggagactaaggtgcctggcgccagaccctcctctgcacttaaatatctcggagtaaactacacactctcggaaggcctggagagtggtgccttgatagacaagctcatgcaggccgttaacagagcacgaggtttggcccttaaaccgctgcaaaaggtcaacctcatacttgaacgaataatccccaaatttttgtatggtatcatccttggcgggcctagtttgactaggctgcatgcagccgacaagtgtgtcaggatggctgtaaaggagatcctgcacctccatcctagtacaacagaccatgtactatatgccagaaaaaaggatgggggaatggggattccccgactggctcaccttgtccgcctagccagtctcaggtcggggttagctctgttagcgagtggggacgttgccgttcaagcagcggggatggcaggcgacctggaaggccgctgcaagaaagtcgcaaatgatttgcggcttaattggccggtgacgctgagagatgtggtgagagccagcaataaatttaaatctcaagaatcaaaagattgggagcgtctggcctcccagggtcacggagtcaaggacttccggaatgaccgtcttgggaattgctggctctatgatccgacggtgttgtccagcagcagatacactgatgctctcaggctgaggactaacacgttcggcgtcaacgttgccctaaggagggccgacaaggaccttgaggtcaactgtcggcgatgccacgggaaacctgaaaccttagggcacgtgctcggagagtgtgtggcaggtaagggtatgaggatacaacgacacgacaagatggcggcctttgtggctacaaaatgtgaagaaaaggggtaccagacgacccgcgaacagctattctccatcgagcagggaaaactcaaacctgacctcgtcgtaatagacggggaaagggctctcattgtcgacgtaacagtccgctttgagagtgggaacgccctctcacggggagcctctgagaagatcgaaaagtatcagcctttggctgactattttgtctctcagggggctgttcgagaagccaacgtgttaccgattgttgtcggttccaggggagcaatcacccaggccacattgaagtccctagctacgctagggttagatgtggaacgtgttggcaagtacctcgccatctgtgccgttgcctccagcgttgagatcgcatgcatgcacctggattacacataatgtcccttttggcttgcccccacctgcttaaaggaactggcaggaaagagagtgatccgtgccatagaaatatggttatccggggcaagtcactagcaatatgggacttctccgggtccgtgcggtccttccaacatgagctggacgtagtccactctatgacttgaacgatacgggggcgtatctcccccggaagaggtcgcctaggcgacttagaa

SEQ ID NO: 118 - DNA, 10053 bp, Crithidia fasciculata
aagcttccggaaacaaccggcacaaattttgaggcggaagcgctgcttttttttgtgtccgggggggtgctccttggggtccccctgtccagccccagccggtcgcccaccacataggaatttgcgaaggacccccaaaaatcccggtccccgagggcgagttgtcccaactttttcaaacctcatgaagagctagttgcgtcatttgaaagttcgtgtgcagaaaccccctcccccacgtttgtacaatggaagcgtttacgatacaggttttctcacggttttgaggtgttttttcgaaaaacaaaaaatatagaggtgtatagcgcttatttttgacacccccctcaaaacatgctgggggtataggtccttccaactaacgctatataagtatcagtttctgtactttattgattctctttctgctgcctttcttttccgccaactgtccgacctataagcatccggtaaataacacgggtctaacgtcgcacagtgcacaccgaacgtggttctccgcacgcctctgcacaccgagccctccgacacaacaggagagccggttgcacgagtgaagagcgccgccgcgaggtgtagtaaaagaaataaataaataaataaataagcacacgcagtggccacagtgaaccggccactcgctaattattttcacaacacacacgcagcagctgcaaaggcgtgtccttttcccccccttttcccttttcccttttttttttttttttttttttttttttttttttttttttttttaagacgaatttttccgatttttggctttacaaaatttttcaacttgttgttttgagcgatttgcacgaaaaagcgccatataactaaaatttttatttttggaaaaaatcgaaattttgttattatttaacgcggcttgtgcagattttaatcttggctctcgggacttttttgcggagccgtcggcactcgagaaatttggttctgaaatttttagttttgtttttttgaccgctgaatacgtccttttgaggcagttctgggcctctctaagttttggttccccttttattttagccaaggaccgttttttggggtccgttaaagggggagttgggaggtttgaggtcgatctgagtcacaaaccgaaaagatacagccaagtgtgagtagtaagtttttgaaccgctgggttggtttttgaagtttttggtagccggagggcccgggccttagggcaaaaaaaaaaaaaaaaaaaaaaaatggctaaaatgatgaaatacctaaaggaaaaaatgtgtctctccggggcggggagcaacagtcagggtaaagaaaaaacgtccctgagggtgaggtgcgggcttcccccggtgtacccgcgagtcgccgacgggagaacggaggaaggcgagtttgtttttggtgggaagaaacaaccggcagcaaccacaccaccactgccgccactaacaacacagccgcaaggttttcaggtgacggcagaactcgtagagcaggtgttgcgcatcctgcagaccggtggcatccccgtcccgactccaccgcacacgggcaccaccacaccagcgacgcatcagagcgaggccccgccacaaaccggactagccacgacccgcgacacccgcgccactgatcggaagcaaaccccgcagcgtggcccacaagagccgaagcgagaggttccgacaccgcggctagtagctccacaaccgtctgtgccaccaggcttccgtctggtaccagcaagggcctcgacgccaccacgctggcaacgggaggcgactgcacaggccgcaaccacaacaggcgcggcaaaccgggtttcaacaccgcagcagcgcacacccaccacaagcaggagtgcaacaccacagcccaacatcgcatcgccgagtggcgcaccaccgcgctacaacgcaacaagactctcgccggtgacaccgctcctggtgccagtgccgccgcgcgacggcaggacgtacgcacaagccacgcgtagcaccacgccaatactgtacaacgcacaacacgggacgacgacgtcggccacccggcaggcgactccgtcactatgggcggcacgcgcctccactgcaacgccgcaccgggcaccatcaccaacagtacggctcccaacgcggacggtaccgccagcaattcttacggaggagcaacggaaggcagacccagagttccatcaagtgaggacgcagaaccagcgtcatcgtagaatgctggaagcgcttgtggcaagcatgaaggattccgaggccacagcggcacactacgagacgtcgtacatgtacgcaaaggtgctggcggaacacgcggagatgggacgcgaagggctacgacgccatttcagccttctcgccgacaactacccaaaagcacacccagttgacagaccatactggtattgtcagggtcaaacgccggaaggacgaccgtgcacgtacgcgcacgaacacgaggcagtgatgcgcagccacatcgcgaaacgtcacgagggacagagggtggaaatgcgtcagcacgtcctctcaagctacagcggtggagcgcacaacggcagatccacatgtgcggccaccacggcggcggcaatgtggagcacccgaccggacgcacggcgtgacaccgcgacgtgggccgccttcaagaaatccacgcccgcggcgacaaaggccatgctgcaggacttgcggctagctgtgcccaccaccgcgcgacgagcgctagaggcagtcgttgcaagagaggccgacaccacacaagacgaccaggaaacacatcaaaagctcattctggtatccgggagggtgaacagagcggtcggagcagcagacgttacaacgcagctagcaaaaatggtaaccgaaaagcacgacgagagcgcatacgaggatgtcacggaggtggccttcaatatcctcgcgccggcgggggctacgggaatcgaggggatgccgcacgtcccggagaagatcgagcttccgtccgcgagcacaaaacaaacaatcgagcttaaccttcacgcggtggcaagcgcaacggagccaacccacctaaccgccgcggtgcgagaggtgcaaaaaagacgcggcatagagataacaacatggcaccgctacgatggtgcggtgcacaccacatcgcccaccgcaccgccatcaaactcggttgtgatgcttctttatacacgggcacaaaccacacaggatgagcaaaagcagctaacgctaaaaggagcagacggcgacaaggacgacgacacgtacagcttcctcagtgacgacagcgacaccgaggacagggttccagaagatatcgacgatcgcacgagcacaagcttcacacaagagttgtcgccacaaaccacggcggaggatggagagcacgtctttggcggacacgtggacccagccgtgctcggagactggagcgaagaagatgacagcctcgagcaggagactgcggatcgcgcctgtcgcggaagcgccgctgcgaaaactgagcgacaccgaagcatgacaaagttcctcgagagactcgcgcagcacgaaagtatgacgcactcaccgacatcacccggagacgtgataagagccgtcattgaagaagatgaggcatcgagtgcactattcgcatgcggaattgagaccgcacgcacatgcaggagctgcgggtaccaagtcgatgcggaggtgctggatgacatagctgtggtgacggtgacgaacacaggcctgcgacaagacaacttatccacacagcagctggacgacgccatcaaccagcacaccatttacaccccagaagagtgtgcgcgatgcggccgggaaaccgcttctgcaacacatcgcctcgtccaatgggcggtggcggtggtccttccagaaaaagaagacacaacgcagaccacggaggagcgacatcttccgcgaacggtaatggcaaccaatggcaacggatcgcagtgcacattgcacctcgttgcgatggccaatattcatgcccaccgtacagctgaggtgtgggagatggtggcccgacactccgacggaaacgagcaatggagacgacgcgggcacacggacgaagaagaccagcaaacggagacggagagacggggcaacgtacttttatacactcgagatgctcccaccgtcttggccgtgttcaccacagcggcgcgtagcacaagcgctgtggaagaatcgacggcactcaccaatgtgacaacaccgcaaccagcagcaacgccggagcaccgacaggaaacacgtgcaacgcaagacgcgcaacagacacaaagagagacaccgacaccgcaacgctcactagaaggaatcctggaggaggtgaccggggtgcgaccacgatctgcggtgtccaacatcgaggcggttcggcgaatgctgtgcagcattgcgagcggcaagatgagagcacgaggcgggatctcaatcaaccaagccttcgccaccctggccaacgtgacacaagagtggagaacggcctttgccgataacgggtgggaaaggcgcggctgtgcagcatgcggggcccgcgagggccaaaaactattcgactcccagctgtcgatcgtggatgtggcgattcgaatgaaagaagagatatcgacaaccgacctgacagcagcgctcggcatacgcaaaacacaaacgagtgatgcgtgccctgtgtgcgatgcgcacatgcaatccaccattcaacacgttccaggaaaagcagtcatgttttcaattgaagaggcgacggcgacaggaaaccaaatcacgacaagagtagcgccaccaacttttacgcacaaagcgccgaacggagcagaagtcaccagatccctactggcagttattgacacaaccacggggccggaagcccaagtgcaccgcgttacagcaaactgggggacagcggcgcaacggtggtgcaaggtcctgccggaaggaggggaacaagagaccaagcccaccgtcccaccaaaagggaacttactttgctacctttctcacaagccacgggtgacacaaacagcacaacgcaccgaagacgacgatcaccgcgacacaaacaatgaggagatttcctcttcatcacatcaagctccgaaaaaacgggagcgaccggcgagcagcacgaccacgccaccgagcatgaaaccatcgaattgcagcgaggtgaaaattgacaccacaccgggaaggcagcggcaaccacacaacagggaggaggagcagacacgcgaaacggcacgtgcgccaacttatcccacggataacgccgccaacgagaacgcgagcgcgcggaaacgcgaggaacagcggggcccactgggaggcgccacttcgacgagccctgttgtaatcaacagcagcgccgacttttcgatggtggaagacaccgccgcaacaccaatccagcggacgatgtcgttcaccctcgaccccctatcgccggaggacgaagacgcagtagcaccggacccctttctggcatcaattgtccaggtagtcggcgaggaagatgagggcacagcggaagcaccatcgatgaacaacggagaaaacagtgagccggctgaaaccccaacacgaagcctttttgaagcagaagacgtaccgctgccggcgtcaatcattgatgtcgacgacggtgccgaagaggacgcaccacacgcccagaacaacgggcaacaagtccgaaacgcagccacgtctccacaacgggaccgcgtaacgccaccaccggacgcgcggcactgcccgctatgcccgcacacccctaaaaatcaaagcacgccaaagccgcagcgcttccaacagctttgtagccacatgaacattaaacatcacgtggcggaagtggcagaggcggtgcttgaggcggccggtttggaacgatgcagccgatgccggcagtttcttcgccgcacccagagagcccgcgagtcgcacaggtgtgagccacaagccggcgagccaacccgggatgaagagggcggggagacgcaacatggggctccccgggcgacggccaccgtgcgggatttccgacatgacagccccaccgcggatgacacggagtggctcgaaaaaacgtcgagcacggtacgccacctccacaaaaaagagtggggacactggctggtgaccgtaggtacggttctcaccggatacaccgcatcggtggaggaagagcgatggaagcgacagctggccatgacgacggtcgtgcgcgacaacctgggccgccaacgtcgcggcgacggggaaacgtcgcaagcccaaccgcaacgctcggaggcaaacacggcgccgcagggaaggggtgaagaaacaacggccacgcaaccccaccgcgccattaccgaggaaaactggggccaggaccgggcggcagaggaggagggacagctcccacaacagcacaaggggatgaccgccgaagcggagcgcgaagagcagaaccggaaacggattctaaaccagctatcgctgggcgctctgggaaaggcggcgcgatccctcttcaacacccagcttccgcgcgccaccatcgaagaggcgcgaccgcaactggaagcgctgcacccccaagcctcggtaagcgatctccccctacctagtgagacgccgttcctccacgctgtcaaaccagagcgagtccgagcggtcatcacaaagcagctgggacgcgcggcggcacccggcttggacgggtggacccgagagctcctcgttccaatcaccgaagacaagggcctcctgaccgagctgacggcactagtacaggacatgctggtgggaaacgtgcacccgtccttcgcgacacggatccgcgcctgcattctacacccttttcggaaggaagccggctcggcgaaggtccgtcccatcacgccagagtccgcgcttatgaagctggctgcgcacatcgcgcttgacagtgtggagaagtcgttccgcagcaccttcaaagggtggcagtacggcgtgtggggcgactccaccgaggcggtgaagcgcattcgcgaagcatacgcggaggcctcttcggacacgctggtggcactggacgcgacaaacgcgtacaaccgcatgtctagacgccacatcctggaggctgcgtacgcacaaccggagctccgctttgccttcggcgtggtgaacctctccctcggtgccgctggtgagctcgcgctgtatgaaaacggtgcgaagatccacgccctcaaatcgacagagggggtgcggcagggaatggtgctcagcccgctgctgtttgccaacgccatgagtggcatcatccgaccactgatggagatgcatccgagggtgaaagtggtcgcctacctggacgacgtgacgctgatcggtccgcacgctgccgtacaggacttcctcgcagaagcggggccacaactctcacgcgtcggattcgacatcaacccggcgaagtcccaccacctggcaaagctggaggttccagaggcgttaagtgtaagcggaagaacgattccgattgcacagggcgtggtgcgcatcctcggtgcgggtttccgaggggacacggcctcagtagaggagtgggtgtgggagaagacgaagacgcatgaccactacttcgagaagctgcaatcggaatggctgccgcgattggcgcgactccagctgctgcgtggctctaccgtgccgcgcctcaaccaccttttgcgcacccacaagccggaggaactcaatcgaagtacgacttggtttgacgagcgcgtgatggaaacggcgctgaacattgccaacatcggtgaccgaagaaacgcggacgacggagacccagggcacacgccgcccgaccccctacgagagacaaggctcctggttcgacttccgatggcgatggggggtctggggctgcggtcgcaaaagccaattgcggggtttgccgcggagtgtgtggggacgaagaacgcgcagcgcgagcgcacggcggtggtcgacgtcgagattgagaagagccttcattctctcctttcggagcctgctcttcttctcctggacgcgaacacggcgacgggtgcgacgcgtgcgttggtggacccggcggtgaaaatgtcggaccgtgcagcggaggtgatgctgaagcagcgcctttttcaacgcgtgctcccggtggggtggcagtgcgtgtgtggagaagacgcaacgaacgagcacatcaacagatgcaggcaggcagaaggcggtgcaaggattgcgcgacacaacaaggtgcgtgacacagtcatcggctgggcaaccgaaatcggttatgtggcgagagcagagccgccgacacagaaccagctggcaacaacgattgaaaacagccatcgacgacggctggacgtggagatcacaacgccgaacggaaccttcactaccgacgtcacggtgacgtaccccggtcgaacgggtctagggacacacgccgtacaggaggcgcacaccaacaagttggcaaagcacggcgacgacgcgcgtgcacaggacaagatatttgccccactagcgctggagtccaccggtggaattcacaaggacggcttccagtggatgcggcggctggccggcgtaaaaccgcacccgtacacacccaatactgcgctcagcatgttgctgacaaaggtggctcaagcactgcacgagggtaatgcctacatgtttcatgtggcagatcaagcgcacaaacaccgccagctcggacgttcggtcggtgaggtgcaagagtagagtacattgaagggcggtgaactgtcagagctattttttcctttacatttttctttgtttcacaacaaggctttacaataggcgacgcggaagatgaaggacaatcaccgacatcttttatgcatcatacgcgacggcaccgcagtaacaaaatggaaatttcaaatggaattttaaatgacataacaccaagagaatgcgccttgtctgcaaaaccaccggtggggcgtcatgatgacatccagatgcggatgtgcggaaccaatacaccaggaccgaccacacaatcggtcaacacacagaaaaaaaaaaaaaaaaatccagtatgctaaagagagtggatcacagcgcctacgtataagaaaatgataaaattaatgaaaataatagatcacctttaccccatcaaggatatcaaagcgtgcagccctctgttaaagatgtgaaaagcacaaagaaaaaagaaaagaaatgaaacgagactgaacatactgatatattacactaatctggcgcagaaaaaaaaaaaaaccagcccgggcctttacacattccaccttccgttgacgacggctcttaacacgatgcaaaattcgacatcttgagcctcgaatgccaaccgacaacatgagagcaccaccttttaatcaaaagaactcggaaaaagaacagaaaagcaaataagatgacgaaagagaatccagcacgcctttctattacggaaagcgttcaatattgtaaacccagcgagaatcaacccgagtaggtcaacctcaaagaggcagatccagggtatcaacttttaatttcttacccaattgcagccgcttttttccttgcttcaactttttcttgcttttagtagcgccagaaataatcatcaaggtcagatagcagtcctctcttttttaactttagttttccaacgactgcatttttcatttttctttttccaactctatcctttccgagtaaaacgtcgaaaactacagtggacgcctagtgcttcacgtcatgtgaagaataaaaaatatgctaaggtcacgggcaaaggacatcacgtatccacactttgtcttcggacaaggcgatggacgggaactggcgttttggaggtggttcacgcaactggttcgtgccacttatttcctgcgttctgacggtgatgacagaccggtgcgatggtcggggcacccgcatataagtatcagtttctgtactttattggtataagaagctt

SEQ ID NO: 119 - DNA, 6865 bp, Capsaspora owczarzaki
agtcctcttttttcccccttgattttctctccttttgcctttttcttttttctcttctttcctcctttctctccctcttccctcttctccccctctcttccccatgcctggcgccgtggcctccccgatggacacatcaggcggtcccgccaacgccgcgcatccagcggacctggacgcaaccgctcaaccccgcgcgccgcagcaagtgttgatcaccaatttcatggcgccttcagctgctcctgctgccgccgccccctccaccgccctcgctcccccgagctcgagtgcaaacctctctcaacaacagcatcccagctcccagcccaccgcggcgagctcgaacgctgcgtcgtcctcgcacgcggcgccctcaatgagctacgccagcgcagcctcccgccgaacaacggttgaccatggaggcctcgtacctcccttggactttacgtccctgccggagttctacaaggataccgtgttcaaaatctacaagagagaacatcccactctggatctgaccgcgcttgccaatgctgctcgctcccaattcaacccccagcccatcattatcgagagggctgcttacttccttttcacggtgactcgagcggatcacgctagcaccctcgccttaagcggcattacggttggcaaggccaccatcaggccgtccacacctgttttcacctttcaggtccatttccgcaactacccatatgccactcctgcagagaacctctgcaagatgttctccaaggctttgggaatcaacttctctgagctcaagttcaccctgaccaaagacgggttcaacgacggctccgggcacctggtggccttcggcgacgagtcgcagctgaaggagtatgccaagcgagttccctattccatcgccatcggcaaagatgaccatgtcttcctctcctgcaaaaaccaactgcatggctgctgctactgcaagaccactgagcacaccagagaaaagtgcacccaggccccggcgtgtagctggtgtctcggcaagggcctctccggccaccacaaccccaggttctgcagccacaaccccagcaagctcaagaggaagcgcagctctcgttccagcgcgcacccccagcgcactgctcacgctgcctccgcgagccaatcatctcagccgtcgacctcagcgtcggccacgagcacctcaagcctcgcaccatctcaatccaatgcgcaggctcttctctcctctgcgaccgctcctggcgctgcctctaacgtagcagcccgtcaggccgcatcatcttcctcctctgccgcgcctgctgccgcggctccggcagcgtcggctgctggcccttctgctccctcgggtgcgcctgcctctgcgtctggcccctcccgcacggtccctccggctgcgcccacggccccagctgccgcaccagccgactcggacgctgcgcgccctcgtgcaaactcgaccggcgctgcagtagcccacgctggctcctccaggccctctggcgccagcactccatctgcgagctccaggactccgtccgccagctccacgccagctgcgtcccgcagtcgtgccgggtctatctccattttcccccagtggtcgctgtcatcgagcgcctccactcccttttcggcgggggtgcacacagcgttgcacccgtccacagcgtcccagtcgcagtctgagggcctcgccactccctcatcgacgcgcgtccgtctccactcggcagacagctctcctgagggtcacgtcaacaaaagccgtcgggtcgaccactccgagtccaccacgcatgatgagcagtcctcctcgcaggtcaccagcctgccacccgaccaatcctccgcgcctcccggcgctccggatcaagatgtcggttcctcccatcaaaatctgtagttggaatgccaagaccatgaggccttccctgttcccggaatcccccatggccctggccttccaaccgtccttggccgaaacgctcggcaaggacgccacgatcatcatgctccaagaaactcatttccgttcctcagaggaaaaacgtgcagagttcctcctctcccacgtctaccactccctttggtcctcgtttgaccgtctccctcttgcccccggtgaacccaatcaccctcgtcacggcgtcgcccttcttgcccgcaaaggaagcgacgactgcccaattgtctccaacctcacgctgaaacacgcaatccccggtcgcctgattgtcgcctcagcatccatccatggtatcaccaccctcctcgtgaacgtgtacgctccggccagcggcgacgcgtccttgcgcatcaggttcctcgaagaagtggaaaccatcatcaccacgcacctgcatccgatcgtcgacggagaagcgcaacccgcccttccgatgattgtcggcggcgacttcaacctctgcttgagcaatcaacgcaactacttgtcctcctctactcatcccccgccattggatcttgcgcagaggttctttgccaacctgacctcccggctcaacctgtccgagtcgtggacggagtgccacggcaacaagcatctgtacacctggtccccaacaggcaactcccctggttccagcagacgcattgattacatcttcaccaacgatgcatttccctttacccccgtctccttcgaggccaaggaaacgaggtctgaccaccgagctctcattgcggctttccaccacgttgaccaccaacaccgtccccctccgccattcagactgaactcccggctcctgacggacaagcgtctgctggactttgtccacacgtgcattgatcagctgaacgagtccatccggctgtcgaaagatcacgcccccctggcctgggacattttcaaatccagagttgtccgctacgcgtcgtcccttggcgcctacgtggccaaatgcaaccgcattgacgaggaagcttgtcatcatctcatcacccacgtcgaatgcctgatgcaggatcccctgctcacggcggaccagctcaaacgtctccaggacgcccgctctggcgctgtagctgagctccaagaaatcgctcgtaccaaggctgaaggcgctaggttgaggtcgcaccacctctcgtgtgccctcaccgaacgctgtaccaaggtgttctttagccttgagcgtgagtgcatcaaagcccaaaccattgccaaactcacggtgaacggcgaggactttactactccgaacgacatagcatccgtgctgcacgacttttactccaaactctatgactctgaaccaatcgacgaggctgccctgagcgaggtccttgcgcaagcaaatccggcgcgaaagctgtcccgagcagaacagaagtcactgggcgcggatctcaacccgtacgagattgctgtcgctatcgagaacactgcgcctgacaagagccccggtcctgacggcctgacaggtgccttctatcgcacattccaggcacgcctctgctacgcattgtcccacgtagccaacgcggcgtaccggaacaaacgcctccctgactccatgcttgaagggtacctgaaggtcatgtacaagaaaggcgcccgctcagacccgggcaactaccgaccaatcacctgtctcaacgtggactcgaagattatttccagagccttgatggcgcgctttgccctgattgcccctgagattgtcaacctcaaccagaacggatttgttcctggtcgtaccatcgatgccaacatccatctcatgcgcgacttgctcgatttgtgccgcgtgtgcaacattccgggtgttgctgtcttgctggactcggaaaaggcattcgacagagtcgatcaccaattcttattccaagcactccgcaagtacggcgtcggtgagagtttcatcagttggatggaactgctcaacactggctgccaatcccgcgttgtgtacaactgcaccatctcgcttccattcccgatcaaacgatctgtgcgtcaagggagcgtcgaagcgccgttcttgtatgccatctacgccggcgtcatctccgactatgtcatccacaaactgcgcgacaagatgctctctctggccctgaggtctggtccccaaatcgtggaacccagcttgtttgctgacgacacatcgatcttcctgtcggatcccaaccacatccatgccctgtttgaagtctacgcaacagttggcagggctaccaacctcaagatcaacgaggccaaaacctccgtcctgcgtctcggcccccttcgggatgccgatccgccggacggcttggctcatctccaatgggtgcctcctgacggcaccactcgagtccttggcgtgcaacttggctacggcgatcttgccaaagccaacttcgagcccctgcaagccaaggtcgcgcgtgcgctgggtcgctggtcgcgccacagtctctcgatcgctggcagggtcctgattgccaacgcgatcggactctcccgcgtctggtaccactgtcgcttcatccacatgcccaacaagtactccaaggcactgtccgacactgtcaacaagtatctctggaaaggccgattctccccggtcgccagggaggttgtgaccgctcctcccaaaacgatcatgtttgggcttggactcatcgatctccccaccaacattgcagcgacggctgcccaagcgctaatcaacttcctgtcgcctgttcccagcttctggaagttggttgtcaaccacctcgccgaagtggctgacagaccagctcggctctccgactatcctgtcgccgagtacacggccatgcagcggctagtcgccaaattcccgttcagactttcgctctcggtgttctggcaccatgccttcagggcgtggcgcaggctgctccctttctctgagcctcctcgctcgaagaacgaactgctcgccactcccctctggcgcaaccccatgcttgacaagatcgacttcaagatgctacggaaacacggcatctcgtacctccatcatctccactctggcaagaaatggcagtcggcccgcgatctccgcgagttctgcgactcccgtctgccacaggtcgaagccagactccaagtgatccgctccaaagtctcgctcatcgacccgtccaaactgcggatcgcccctgtgcgcttccgcgagaacgattgggttgttgactcgtggggcttcctccgcagaatcttggaaactccggccgccgacgccttgtctgtgcgcgtgaagccctacgtgttccgcctccacggtcaggttgtggtgcctaagcacatcctctcagccaggctcccgcttgctgaactcaccccagcagtggtctcggattggacctctccgtctgccaagccccacaccaagaaaagcgacctgctgatgcagctcgctgaagcctatcctccaccaaaacgccctgaggtcgaaggattcttctttggctctcttatgcgtctcgacgttgacccatcccggctgcagctgcgtggcgctcccgagaacatgtatcgctcgctctgcatcgacaaagacctagacgaccttcgccgcaccgcaaatcgctccaggaggacgatgctcgaaagccgccatccctctgaaattgagaatgcccgctactggctggcactctaccccaaacacatcgaggagtgcaaaaagcgcgtgcacattgtgcgatgcacctcatctgacgcatcgctgcgcaatcttcgccacatgctcacgcccgccccggtcaaaccaactgccctggtcgagtgggagcaaatcctaggacccgtgcactggtccaaactgcgccgcaacatgatgaccaatcttgtcccgcgcaaccgtgccggcctcatctggcgcatcgctcacaacaccgagtacctgggtgagattcgtctgctgtctcgccgcgacaagctcaccaacgaacaactccgcgaggagtcacacagtggcgcgttcgcctgcgtccactgcttccgacttcatggcacccgtgcccctctcgaaaactggctgcacatgattgtccactgccccctggctgtggcggtctggcgcgaggccgaaacgctgttcagccacgcgcaaggcccctggttccctagacagcgttcgcaatggctctttggccctatcaagaacaaacgctaccacgccttgatgaaagacgaagcactcgcttgtctcaccatcgtcatgcacactgcccgttggactctctggacgctgcgctgcactgccaagttcgacaacacagtgttcacccccgccgacgcggtcctccgctttcggtacctcatcacactggcagcgcgcctcgagcactctaccaaacccctccccaatccctggaggactgacgacgacggcgacgactttggcgccgcccctctccatactgatgagcaagagcatccccccttcgaaagcaggtggggaaaggcttttgaaatccggtacaatgaacgtctttccacacaactgtttgccctcgcgtacacctagtacccgcaaattgtgtgtaaagcggttgaccgtttctgaattgtcgctccttacgacagtgtgctgtcccaccgcctgccagccgtctacttgtttgtgaaccgtgttggctagcaacatgtctttcgtggtgtataggtggggaatgcctgatccttccattgtcagcccggctgatcatctgttcgagttcctctgtgagctcttgagcactctccccgcatgccttcactggtgtgcgttatgacgacattcaactgtctcatatcctacgttcttttttctttgttattcttaataaagctttagacggtaaaaaaaaaaaaaaaaaaaaagaa

SEQ ID NO: 120 - DNA, 6319 bp, Capsaspora owczarzaki
agtcctcttttttacatttccctctttgcttctttcttccttgctttccttcccactttcgaatcgtcgtagtgccatgtccgaccaacaagcctcctcgtccactcgagacgagcatccccccacgcgtgcccacccccacggcggcctcacggccgctccaggcatgggagcatggggtggcggcaaccccctcgccaagacgggcgccgcgctgccggccaagtccggcctcgagatgatcgacgtcaacgaccccgcctacgctaagctgaacgaagagctcagcctgaacgcctctcagatgggtgacggctcgaagcacactgtcgtggtcagctggacctcgcttcgcgccaacaagatcgatggcagaggcaacgagatcaccaagctcctgatggagcacatccctgagggctgctgcggcatcaactttggcccgcatgagctgagcatcgtcttcaagcacccgaaccaagcgaccgaggcgtgccagaagggcatccagtttggaatgaccaccatctatcccaatgcgtgcctgagggaagtcgtgctgatgctctacaacgtcccgatgcaccactccaacgaagccattgcggatatgctcaacaccaaaactggactcaagttcgaaaagtgccatcgctccattggcaaagcgccaaacggctgtcccttcgaaacgggcacaaggatctactacgctacgttgaccagcgacgtgaacgtcaagcaggtgattgacaaggtccctgactccattcaagtcacgtctgctagtggctccccccgtgacgtccaaatccaagtgaaaggacaacccaccaagtgcttccactgcaagcagcaccacaagtacgcgacgtgcccgacccgccgcacccagtgcaaccgacatgaagtcaacgaaaatgaaacgacccgcctgaacaccgaccgagccgagactgcaaacaacgacgggttcgtgcaggtgggccccaagggcaaagctgccaaagcacccacccagcgcgcgtggccgaagcccgctacggctcagcccgcaaaccaggcctcgacctcgaagtccagcgccacggcgacaacaacgcaacccgcagcgcggacgacgcaaaccgctacgacgcaacccgccgcaccccgcgccaccgcggccgcctctgccgcggctgctaaagccaaccaaacggcgtccagccaagcggccccgtccaccccgcagcactcggcccaaaagcgctctgcaagccaattgacgcctgttggggccagcagggtccacaagcaaccgcacatccaacctgacgaggacagcttcgcagttgatgaggccacaaccactgcgttggcgatcgctggcgcggacaacgatgcagccgtggaactcgccacgctcacgttcgacgacacctcaagggacagcatcccgagccagcagctcaacagcgacatgcaggcgctggtagtggcgaccatcaacctcaccaccaatgacgacgtggaagccacgaccaaccagccgagtgtgtcaactgcggccggcgcgacgcatgacccctttcgtgacgagggtgcacacgaggcgcccaattccgaaaacgcagccactcaggagaacgccaccgacgccgaggccccagcgctgcccagcgtcagtgaatctccagcgacggacgcgccaggtcccagcggcgcggacgcgcccagctcttcccaacaataagatggtgaaggtggccacatggaatgtccgctcactcaaggtcaactcgaactccctcaaggagaacgagcagactattgggcagcaacaactgaaacggtacatgggaagcctcccatcgctggtatgcctacaagaaacacgactactgacaacggatgagaagaaagcaagcgtgtacttgttcaaataccactgcttctggtcctccaacgacaatgacaacgacaaacaagctctcgacccgctcgatcatccaatcgaccagcccagtctagacgacgcgaacagccccgaggaaggccacgcagatcaagacagccacgacgaaatcgagctcgacacagacacaaacgagtacgtggagacccgaaaccacggagccggcctcctcgttcacgaagaagacgaagaattcaaagatccagagatgctgcccagcccacttccaggcaggctagtgctagtgagcgccaagatgcgaggacaaaagaccattctcgcatcagtctacgcaccagcaagcggcacccaaaggaaaatccaattcctcgaagcactcgaaacagccatcaagaacgtcatccagcctaatccagaggagcccgctcttccgttgatcatggctggagacttcaacatcaccatggacaacacatcagcaaaccggacgagcaacagcgacacgaccgactcggtccaaggccgcttccgctccctgctgtcccggctgaacatgcgtgacttactcgacgaagttgaccgcaagaacgccccactcttcacctgggaacgcgcgtctcaaggcaagacggttggctcgcgcatcgacttcatctttacgtccgaggcagtccaactcaccgggtccaggtaccaagcgtcccacaactcgcgctccgaccacgcccctgtcgttggcgagtactgccacatcctagacaagccgcgcccgcaagcgccgttccgtctcaacgacaccctgctaaacgacccgtgctttgaccactttgttgtccacgaagcccgagctctccaaacaatccgagaaccgttcgagtgggagttcttcaaggcaagagtccgctcctatgctcagaagcgtggtgcacaactggccagagcgcgcaaacaagaaagcgaactggttagccgaaaacttcggtttgtcgaaaagaacctcgcggaccccaacaccccagaagaggaaaggaaagcgctcctctctgcgcactgccacctccgcgcagagcagaaagccgacgacgaccgctcggctcagggggcgcaagcgaggtctatgcggaactggcgaatcgaaaacgaaagaccgaccaagctcttcttcgcattggagcgagacaagcggaagagccaaaccatcgaccggctcgtgtacaacggccaagaagcgactgaaccagaccaaattgccaacactctgcgagacttccttggcacactctacgccagcgagcccaccactcaggaagacattgacacggttctggaagcggctcgccccagctaccgactaacaagcgacgaacaaagcaagctgggagctccactcacagacgctgaaattcggctcgccatcgaacggactcctaagggcaggtcgcccggcccagacggactcacgccagcattctacgcaaaatacgccggcatccttgctgctcccctggcagcccttgccaatgtcgcgcgagacagaggcaggctcccagagtcaatgatgcgtggccatgtcaaggtcctgtacaagaaaggcgatcgagctagcgttgaaaactaccggccaatcagcctgctcaatgtcgactgcaaaatcatctcacgagcattgtgcaaccgactcgccaaagtcctgagcaaaatcatccccgtcgctcaaaatggcttcgtcccaggacgcacaatcgacgccaacatccacctgttcagagacatcctcgacctgacgcgccaccacaaaatcccagggctcgcggtgctcctggacagccgcaaagcctttgaccgtgtggctcacgactttctgtaccaagcaatggcggcctactcaattggcgactcattcatctcgtggatgcgcctcctcaacacggggtgccaatcgcacgtagtgtacaacgccacagtctcactccccttccccatccaaaggtcggtgaggcaaggctcagttgaagcacccttcctgtacgcgatctacgcaggtgtgatcagcgactacatccagtctcgccgaaacatcgccttcctcaatgtgcgaccgcagctcgagcccctggtcatcaaagcgtcgctcttcgccgatgacaccacaatctttgtccgcaacgacaaggacgcgatggctctcttcaagcactacgaaaccgtcggcagagccagcaacctcgccatcaaccaagaaaaaaccacaatcgtcccacttggtccccgcaggaacgacgagatccctgaggtcttcaaaagcctcggcgtcgaatggattgaccgaagcaagacgaccagagtactgggagtcatgctaggctacggagacatcatcaaagacaactacgagcccgcacttgccaaagccgagcgcgcacttcatcgctggagcagccgcggactgtcgcacccagcacgagtcctcattgccaacaccatcggtctctcgagagtttggtaccaagctaggttcgtcccagtcgaccaacgccagctagagaaaatcaagaacatgatacaacgcttcatctggcgcaaaaggtggcccacaagaaacctcgccacactgaccgccccgaccatctcaacgcattttggccttggcctcctcgacccggctacgagctccaaagcctacctgtgtcaagcacttgtcaacctatgcaccggcccaaaaagcgattggcagatggttgcgaacgaaattttccgaacagccgacctgagccgcaggcgagaggtgcaaagatacttcggccttcaacggctggtaggcgctggccctccgctacccgcaaccacgtcactattctggcacaaggcactgagtgcctgggcaaagctgcaacccgcgctcgcccaaccacggactcgcgaccaagcgagcacgacgcccctctgggtgtcaacagtcggcggcgaatacaacgaatcgaaaaacagaaaaatcctcgccaactcgggctactgctacgttcaccatctcaggacaattgatggggacgaagagcgataccggacaaagcccgaaatcgagagcggcatcaatcaccgaaacgctggcaaggccgcccaatgggcccacgcgaagctcatcccacggttgcagctcgaccaactgctggagcacgaaggccctgaaccggcactacgctggggaaagacgccggacggagtcctccgcagcttccatctcgagctcacccaggacggcacgaaagaacttttagggcaaccgcaccacgtccacgaggacggctccatcgaccaaatgcctgaacatgccagagtcgtagacccactcgaaattcaagaagccgtcgtcatcaagcgaaacaaacagcactggctcatcggcctgctgaccgaactcgacatcgatccaacgcgcatcatcctgcagggccgaaaaggagccaaccacacgcccatgctcgtgtcggcgccaggactgcggatcaagaagctccgcaagctgctcaccaaagcgaggcatgagcccaaacaactcgctagctggagaaggctcccggagcaatgggtcgacattgccaaactgtcttgctccccgctggtggagcgcaaacaaagcgctctgctatggagaatcgcacatgacacggagtggctgggctgccacgccgctcggtacctccgccgaaaagaccccgaagcagcagaaagcaaactcaactcaggcgagctcgactgcccacactgccgaagaccagacaaagaggagacttggtctcacatgatcgtggaatgccctctcgcggaagcagtgtgggacgaagcagagacgatcttcaagcgggctcacggcttttggttccctaggcacgacgacttcaaaatgctcggaccctggcgcacacaccgatacgaactactcattgcggacaagaaggacgaccactcccgctcgtgtctcaccatcttgttccacctggccagatggacactctggacgttgcggtgccgagctcgcttcgatcacacaaccatccacccgactcatgccgttgcgcacttccgaagccttgttctcaatcgtgcgaggcaagacaccttcacgtgccgcaaaaacaacgaactcaagacaagcccaggcttccataagctctggggcaacgcactcgcaatcgagcccgactcgactctccaaaagatgattctcgtcctctgtgacgaccaaaatgttgttagcaccccagacatcatatctgggctgcagatgtttgactagagctgcgtacgccaatgccagcggcgcagctcagcgaacttttgttgttacgacggtgtgagtactgttaaatacaaatacacatcggtttgaaaaaaaaaaagaaa

SEQ ID NO: 121 - DNA, 6377 bp, Capsaspora owczarzaki
agtcctctttttctgtgttccagcgccttcccaccaaagcccgaacacacacgcccaacgtcagcaaaccaaccgcccaacgccaacccagaaatgactggtccgtccaagaattctgggactggtccaggccaacccgccatcgcgtcagcgctagcggcggccgcccaacatcaacaacgagccaacaggactgcgtccccgagcagccaagtggacatgacgtccaatgaccccgcgcccgccctccccaccgcgacatccggtggcaacgccgctccctgcacagctggcaacaccaacgccagcacgaccaccacccccggccaagccggccaggccacggcgacggcccccaccgcggcttctgctgcggtctcctcgcctgcggcctcatcctcatcctcatcctcatcctcctcctcctcctccccctccccctcctcctcctccccctccactgcctcctcttcctcatctgccgcaaccaccactgcgaccagcgcccgggctagcctcggcgccagcgccagcagcagcggcaaaggcccctccaccaactacaggaacgctgttgtcgccaacgccgtaaacgatcctgacaccgacactgaagccgaaactgccccgctgtcctttgaagaagccaggaagctctttgaagacgcaggcagcccaacactgaccatcccccaactccccgtcaacaaatggaacgaagcaatcgtctacatcgtcaggaactaccaccatgtcttccaaaccggccaagctggtcacacgcacgccaagctgttctctgcgagcttcacatctcaggatgcgtaccgcaaagccctgcaagagggggtcaaactaggcagctacacctaccagtgcactcctcagcaccgcggtcttccattcaaactcgaaggcatcgaacccgacactgatttcgaacggctgaaagcagccatcgcccacttcatcccgaacggagccgccggtagaccagtcggggtcgtctcggacatcacagtcatcacccaacgcatcggtaaaacaacactcttcacgaagaacgcagttggcaccattatctgcaccagggcagacgcccaaaagatcggcgccgccatggaccgcctcatcgaggtggacaaccacgcaatcaccatcacctgcgagtaccaaaccccgttctgcccccgctgcaagctccgccatgccagggaggactgcccaactgcgccggcttgccgatactgccaaaaaacgactcactctccctacaattgccccgctaagcacaaaggcgacaagaagcgcaaaacccaagtgagcagaacccaccaccactccgaccccgagtcggacaccgaagaggtgctcccctcgtacaagcaccatgccacaaccagccaatccaaggacggtttcatcccagtcaggtcgaacacccaccgatccaaggaccccaacgcccaacctggcgacgtcagcattgtgcgcaggaccagcgcgagcgctgagcaaacacaagcctcacccgctccgatcagcagcactgctaacggacgcacaagccccgatcacgacgcgaggaacaagcgcttctgtggtgaagaccacagggaagaccctattccagtgtcaaacagctatgcacttctggcgaacgctgatgactcacactccactttcgaaccgaccaccgtgcccgaggagcctccgggggtcgcgatggacacgagtcaagaatgaccggccttctcttcgcaactctaaatgcgcgctccctctctgtagggggcaatgcgcccctccccttcttctcctcctcctccgcctctctcatccatgcactctccaatccggccaccacctacaacggccgcccaactcctccaaccgtcatcctgcttcaggaaacctggctcacgccagcgaccgaagcagccgcctccaacctcttccgcgactacacttgcttctggagctccgagccggaacccaagcacggggtcggcatcctcatcaggaagccggcaccgggcgacaccgaccccgcactcgcgagcccaacactactcagctccatcccagggcgagccctcatcatcacagcaaacctcaacagcaagccaaccatcatctcatcaatctatgccccggcatctggctcacaagctgacaaagtggcgttcctggaccaactcagcgacctcatcaagtcagccacccagccaaacgacgacgagccaaggctgcccgccatcatcggcggcgacttcaacaacacaccaaacatcagccccctgtacgtccaaccagagccaaaccaagagcctaggagcgccacacaggcaaaccacgctctcaaggacttcatcaacaagcacgcactcgaggatgcctggctgctcaaccaccgcgccgatgaccctgtcgaatacacacgatggccgagcaagaaccagacacaccgagcctcccgcatcgacctcatgctcctgtcatccaacctcccgctcacaatcaagtcgactgcgaccaggatttaccaacactcggaccatcgaggcgtctgtgtgaacctggtggcgccgtccgcggaagacagatgcactccacccttcaagctgaacgacaccattctcgaacacgctggcttctgcggcatggtactcaacgagatagcagagctggcgcgccgccccgaccccgagaaccactggactgctttcaaggccgacgtagcatggctagcccagtgcctgtgcggctccattgcgaaagaccgggcgaaggctctggcccaagcgagccgcaagctcaaaatcatcgaaggcaacctcctcgcagcaacatcccccgcagaggcaaaactgcttgcagccgaacgagcggagcaggaagcccgtgtcaaagctgagctcgagcatcgcgcgcaaggagcacgagtccgctcggccaaaaagtggcgcaccgagggcgaacaccccacctccttctacttctcgctcgaaaagcagtcccaaaaggcgacgcacatcccaatgctcctcgtcgacggcaaagaagtcaccgatgcggccggcatcacggacgcccagcgagatttctacgctaagctctatgcgcacgtacccattgacccagcagctgcccggcacatcctcagccatgcaaagcccaacgagatgctcgacgacgaggaccacgagttgatgagcagaccgctggaggcatgggagatcgtccacgccatcaacaaaactgcatctggcaagtccccagggcccgacgggctgggcactgcgttctacaaaaagttcaagcacgagctggccccaatcctcgccgccatcgccaaccgctcgctcaaaaatggccgccttccggaatacatgcaggacggcttcgtcaagctgctgtacaagaaaggcccgcgctctgaccttggcaactaccgaccaatctcgctgctgaactgcgacttcaaactcctgaccaaagcagtgatcgctcggctgcagctggtggtcaacgacatcataccactcaaccaaaacggttttgtcacctctcggaccatcgatggctgcgtccatctcacccgagatgtgattgatctgtgcaacaccatcaaaacccctggagtgattgccatgacagacgcgtccaaggcgttcgacaaggtctcacacgacttcctgtatgctgcactcagagcgtacggagtcgggccaggctacatcaacatgatcaaactctacaacaccaatggccgctccgcgatggtgtaccaaggccgagtctcggatcactttccaatccaaaggtcggtgcgccagggaggctgcgactcgccgacgctcttcgcgttctacgcctgcgccatcgtagactacatcacgtacggcacaaagctcaagttgttgcggatccccagcagcaatctcaaagccgatcgcaagcgcggccgagcgaatgaggaccggccagacgatcttgtcattctccccaccctcttcgcagacgactcgtcctactttctcgcctcaccagcagacgtcccaaacctgctgaacgagctcaagtttgtggggacggccacaaatctggaaatcaatgcaccaaagaccaccatcatcccgctcggaccaactgcaacgcgcaagcctccccccgacctggaaggcctcgagtgggttggaccaaactccacgacgcgctacctcggtgtcatgctcggccacggtgacctgaccgtcgcaaactttggcgacctacttgacaagctgcacggccagttgtcgagatggctcgtccacgggccgtcactcccaggtcgtgtgctcatcgccaacaccatcgcgctgtccaaagtctggtaccgagcgaggtttgtgcccctctcgtccgagcagacagcaaaactcacccgcatcatcgacaagttcctctggcacccaagcaaatggccgcgaactcaccaggccaacgtcgcagcaccaatcaaatccgtggcatgcggactcggactcatccccgttcggcgtcacctcaaagccctcctcgcccaagccgccctggcatggtgtcagccgtatgctgccccatggaagcacattgctgtccgcctctggcgtgcggcagacaagccggcatgcccactcaacgtgctcaggctggtgatcaaggcctcgtcagactttattggcatctctgcattctggcacaaagcctttgaggcatggcacgagctcaggccagagctccaaacccctgcctgccgcgacgaggcgctcgctcacccgctctgggactcaccggacatccaggacgacggcaagccgctctggtggccgagctggatcctcaacggatacatgcgcgtccgcgacctgcgccgcttcatcggtaacccagctagagaagagtggtccccgctctcgctcgtccaaagcttcaccaacgcaaaatactacaacaagctccacgaggcactcgaccggagccagctctcgtcgctcgtagagcaggatagcgccacaatcccgtcagtgcaagatctaccgtggtgctgggcccaaccagccgacgacgacgacgccaatcccaaactcttcagagttgtcaaactccgcacgggcagcccgctcacaagcagctcactcggagccggccaagtgttctacgagtcggagaacgccctgatcgcgcctgcccagccaggcctagtcctcaccaagttccgcctggcaaccgcgcaacacgccaccgtcgtctactggcgagctcccaacaccaagcctgaaccaaacaagcggggaaagattttcctcccacgaaagcagctgtaccatgttggccgcactcaactcatgcccctcatctggagcaacatcgtcctcaacggtgttcactcaagcgtccagaagcccctgcaagtcacatcgcacaagctcaaactgaaaacgctaaggcagctgctcactccacgtccctcgagaccagacgccctccaatggtggatcaacaaagttggctacgtgcccttcgaatcactggccagctccatcagaaccagtctagtcacatccaagcaagcctccctgctctggcgcattgcacaccgcaccaaccgactgggcgccgactggctggaaacagatggtcaagcgctgcgcgccggctcgctctcccgcgaagagtacgacgacagaattgccactgggcgctacgactgcgcgcactgcaaacacgacggccgctcggccagagagacctggcaccacatccttgtccgctgccacacagcccaagcggtttgggaaaccgcgaacgccatcttccagcacgctcactcaagttccctcccaatgttcgacaaagccctcctgttcggtcccttccccaccacgcttgcgcgaaaaaaggaaatgcgagcgcttgccacgatcctgtaccacctcggacgctgggcaatctggcgcacccgctgcgaagcaaaaatcaacaacacattcacacccagccacaccaccttcatcaaactcgtccactcccgcgccctgcaggacattgtgccgcgagccccgcctgctgactctcccacgtcgaagatgtggggaaagtgcattgtcaggtcagaagagaagaccaccatttcacttctacccccgaaacccggtgagcatgagcaaaccgagtcaccaagcggcgcccgtatgaccaggacgctaacaccaaacttgcaaccgcaagaataagttaaacacgttgcccttgtcacttactccttgcccctgatcatgatcctcctctttgtggtttttgagccttagaagctttttccactctccaataaacgtaatacaaaaaaaaaa

SEQ ID NO: 122 - DNA, 6168 bp, Capsaspora owczarzaki
agtcttctttttttgagcaaaagcaagagcaatcatgagcggtgtcagcaacgacggagcaaccaagaacgccaacacggcgaccaagccccccgtggggcgcaggggcagcaacccttcgaaacccggggcggtccagtccacgctggaggcgttcatggggggcaacggaggtgctggcgcgtcgagtgggcagaacgactcgctgcccacccaagaccaccagatcgcggtcccggacggaatggctcagccgacgcctacggtctcccgtccgccgacgccccccccccccgcaacttggtgggctcctcgggcctggcggtactggactcgacacccgcctctgcgagctctgcccagcttcccccgcccggccctagtgccgaggacgagccccgccccccgacgcgtggcccatccccgatgcgcaccggcgaaatctcctacgcggagatagtgggggccacgcgaacgcagctgatgcaaactgcgagcagcgaaggagcggcgtcctcccaccgctcttccgccttccagccagtccacgcaacccagcaggcccagtcgcagggtagccagcaaccgcagcgcgtgcagccgcagccccagcggcaggcgacgccggcagcctcgtcgtcatccgcgcccagtggcgaagatggcagcagtgccaggaagcggccccgcgtggatggcagcaccgacgagactgaagtgaacgagctcagccccaatgttgacattgaggcgagcgctagccggacacagcacaagcagcgcaaggaaaacgagctccaagcgcgaatcaaagcatcacgcgcacacaacaacgtcctcatcctcccgcagttcccgcgacccactacgcaagctgaaatgaaaaagtttgcgcagcggatccaaggaatcgcaaacacaaagtacgtggtggaaatcgtcgagatctccgccaagcttgggcgcatcaacttggttttcgaatccgaggagcatgcgaacaagatggtgaacgagctcgtcgagatcaacggacaaagctacgacctggaaatggctgtcgagggctttaccatctctctgacaggcaacacagccaaggtcgacgaacaagcaatccggaacgcaatcgcgaaacaaggacaaatcaacatcgaccgagtcggctcgccacgccattcgtactggcccctgctaccgggggcgaagcaacgaatgaaaaatggcgagatcaagatcgacctgcgagtcacctccgaagagatggagctgattggcaaacgattcgaaccgctcatcaccatcggaagcgaagagctcaggctgaagtgcgatcacatcaaggagcactgtgtgatctgcctcaaagagccccacgcccgagtcgactgcccgagggtcaagtcctgcgccgtttgccacaccaagaagcacccaacccatcaatgcgacaaatcgaaagttcctaacgccccatccaaagggaaagggcccctgctctccatggcggtggacaaggagaacgcaaacagggccaaccaagatgcaaatctggcagacgtgagcgacctgctaggaaacaacagctcggcgggtaccccgggaggagcgaccgcctccctcgttgcaggggcagccggcgcaagtacggctgcctcggtcacgagcggaggtggggcgcccgacccggccaaccgctcttgaaacccgccaaagttttctccattgcgacgctgaacgtccgaaccctcgggatcgacgatcagcgccctgctgagatcaaacgtctgctgaacaagccttcaatcgtgtttttacaagagacgaggcttcgccagcggaacgagatcaatgctacacgaatcttcaacgactacaactgcatctggtcaagtgatgaccgctcgcctacccccgcccacggagtagcaatactcacgagaaagcccccaacacagcagcaaccggacgaccacgaagtccgtgagctcgctgtgctcgacaagatccccgggcgagcgatcattgctcaagccgacattgacggaaacaaaaccttgcttgtgtgtgtctacgcccctgcagcgtccgacccagagacgaagcaagaattcctgaccacgctctctggtctggtagacaaacacacgagcacccatcccacgggtgcacacatcatcatggcaggcgactttaacatccgccgcaacaacagcatcaagtactactcgaaggccaggaaggttcccgacccactcgacagcgctcagaaggcctttgctgagatgctcaacagaatggggctggaggacctgtacgacgacgtggacccgcacgccatcagctacacctgggccaggccaacccgcaacgcttcggacaccgatggtgctgtcgaggagcgcagccccacgcgcattgactacatattcggctccagtacgctcccgttcctggccacacaagccaggatcaaagagtacaaggactcggaccaccgtgcggtgtgcgtcagctgcatgggcaccaacgaccaaccacggcctgcagccaagtacaaattcgatgcgcgcctgctgctggacgccgatttcacccactactgcgagagtgtcctcatcaagttcgcgcgagacggcgctccggaagctggatgggatctggcgaagaagcagatcatgagccgcgctcgtcaactgagcaccgaccgtgaccagaacgccaagagacagcaggagttacttgagacggagcttcgcatgacggaaagaagtatggcagaactacggatccaaggtggcaacaccaaagagctggaacgctgcagaacacgactggaaagcgagctccacgcactgctgaacgagcgcgccgaggccgcacgcattcgaacggcgcggagatggcggctcgagaacgaacgcaactccaagctcttcttttcactcgagaaggaggcgcaacgggcactcaccatccccagcctgaaggtaggcgacacggttgtcaccgaccccgtcgacatcctcaaggcgcagcgcagcttttaccagactctgtacgccagtgagccgaccgtcccggccgcccaggaggaagtgcttcattgcgcctcgccttgtgagctgctggacgcggaagaccacgagcgtatgggcgctgacctgaccgcaatggagctccgagaggcgatcaaaagaacgaccaaaggcaaaagcccaggctctgacgggctgacgcctgagttctaccatcactttgaagagctgctggccccgctgctagctaccatcgcgaatcggtcaatgcgaaacgggcgactacctgcatcaatgtacatggcacacatcaagcttctgttcaagaagggcaaccgagacgagctgaaaaactaccggccagtctcgctgctcaacgtggacagcaagatcattgcacgcgcgctggtgcaacgtcttcaagctgttgccaacgacattctccccacatgccagaacggttttgtcctaggacgcacgatcgacaactgcatccacctagtgcgcgacgtgctcgacctgacgaaggaaaagcgcatcggaggagtcgcggtgctgctggactgcgaaaaggccttcgaccgcgtcgaccacggcttcctgttccaggccatggagcgatatgggattggagaaagattcttgcactggatgaagctcctcaacacgggatgccaagcctgcattgtgtaccaaaaccgcatctcggagcccttcaagatcgagcggtcggtgcgtcaaggatcggtggaagcgccagcgctgtacgcgctgtatgcatgctgcgtggcggactacctctgcaaaggggctggcctgcgcttcctgcgcctggacccgaacctggcgaccgaggtcaccctgtttgccgacgacacgacggttttcctggaatcacagaacgagataccgaagctgatggcggccctcaaacgagtaggggaagcgacaaacctgaaagttaacgaagaaaagacgacagtcatcagactcgggcgagacaagcgccagactccactgcaagcgatcgcccacctcgacttcctgccacctgacaaatgcaccagagtcctgggcgcaatgttgggctatggcgaccgcgaggaggcaaactacaaagagctgctggacaaggtgaaggctcagctactgcgatggaacagcaggggcttgtcgatgccgggcaaggtggtcatcgcgaacgccatcgggctgagcaaggtctggtatcgggcaaggttcactccactgtgcggtcactacctggaccggctcaaacgcatcattctgcgcttcttctggcccacgcgcttcaaagcacccgcaacactcgcaacgctctgcgcaaaaactggctcggaggctttcgggctgggactgcttcccatcgaccaacactgccaggcgctgctcgcccaagcagttgcgaacttttgcctgccggccgcctcgctgtggaaaacggtgacgcagttgctgtggagggcggcggacacgcacgacggcgagccaatcggcgacaggcggctgctgcactcgaaaccgggcatcaaaaaggtcagccatttctggggccgagcactcgctgcatggtacaagctcaaacccgcgccacgcaggcccaacaaccgaatcgaggccctgactttgccgctgtggagcaatccactggtgacggacgacggcaagacgatcaactggccatcctggatgagaaacgactacaagacggtgagcgatctctggaacttcaaagaacaaaggtgggcaaccgccgatgaaatcaaggttccaggggccacgcacagcaagctgacgcgactgcttgaggctctgcgagactcgggcgtggaagagattctgagcagggaagtcacggagccggacgactatccctggtgctcgacaacgacgagggctggtagcacactgctacacgaagtgctggcagtgaagaacactagcgaaggcaccatgcttctgctacgacgtcatggctggtcagacaacaacatcatcgcacccttcctcacgacgagttgggccaagctaaccgccacaagaccgctgctcacggtgaaatgggtatcacacagcgcaaagaaaaccctgcttgccaacggcaggtggaagccccaggcaaccgatacgtactttgtcggctacggttttgacgcgtggatcgacccgagtgtgctgatgcttcataggcaaggcctcacaccactgccagtcgtgcacaaggatacaacactcaaggccatccgcaagcgtttgacagccacccccgagccctcgcgcgcactgctcgagtgggacaggatcattgactggaactggagcgatatgaaggctgtgctcaacaccaacctggtcacacgcaagcaggcttcactggtgtggcggatcgcacaccaaaccgagtggacgggagagcaacagcttagagccgacatcgagaagggcaaaaccaagcaggagaccttgatgcagagagcgttaggcacctacgcttgcccgcactgccgacgaggaaacgctcgccccaccgagacttggatccacctgatttacgaatgcccggtagctgaacacatccggcttagagtcgagcaagttatggttgtcgcacacgatcttggcactccgtcctcggcagcccatgcactcttcggacctgcccacaaccccacactgccacgaggatatcgacgcaacagacctgctttcagattgctgatgaccctctaccacttggcgcgttggaccatttggcgacttcggtgcttggcgaaattcgacagtttggacgcgacaccagaattagcgaccgcaatgttcgataaacttgtttccaacagagcttacgaggacctgactttgaggagggcagaagcaatgcaaatgtggggcgcatgcgccaaggaaacggctaccggcaaatttgtctttgaacttgagcttcacgatgccgcggcatcgggggcgtactgaagggccagactcaaatacgggcccatttcgttgaactttgcttgaaaagggggctattctttcattagtcttcctgcgttttgcttttgaggttgtgaatcattcttgaatacacaatttcacctgaaaaacaaaa

SEQ ID NO: 123 - DNA, 3848 bp, Anopheles gambiae
gaaggctaaccacaataatggagacacgatctatgagaaaaaggaccacacgattgcccgaggagggagcccctactggagctgggcctgggacgggagacagagcaagcatccagcggctggaagatgaaatggtgcaagagcgttctttcagtcaacgggctctgcccgtaccacgaacgcaaaacagaaacggcagccctataaatcaccaaggcaatgctgcatctgctaatgttgctgtggctgatagacaacagtcactcattttggcaggaggccgacggcagaggattatgtggacgagagagatgaaccattacgtgatccgttgctactatgtttacacgaggatggagacggacatgcccggcagagtgaagatgctgggtatgttcaatgaccgtttccctcggtttgcgcatcagcttgacctgagcaagttgtatatacggcagcgagctattattttgcctgaggaactggagttcatcaagctggaggtgcggagggaatttggagaggaagaggcaggctggcgcgagtcgagtaggatttctgctaggcttaatacaatagaccaaaatacatcaagggcgagtgaggatcgtgatttggatgaacccaccgctccaggattgtcagtggatatccaacaccagatggccacagctgttacgcagttccatgggacagaccccttgtctcgtcaccgactaccaaaactgcattattcttaccgcctgaaaacagcagtaagcatcataaaccaagatgttctacctcagtatttggatagcgtagggagcattgaggatctgcagttaattgtgtattcggctgcggtggctgttgtacgaacgctatggttgcggacctatccgcaaggagacagcgaaggtcgaccatgctccaaggctgaaaagcccgcctggatgcgacgtctagaaaaccggatcaacgcaacacggacaaagattggtcgaatgcaggaatatcaacggggaaattcatctatgaaggtggtacgtcagattgctgaaatggttaaacctaaagaactacgagacctcactgatgccaacataacggaggtactcgacatccatttacaacggttgagtgcccttgcaaaacgattacgacgttatgctgaatgctcgaagcggaaagaacaaaatcgaatgttcaacattaacgagagagaattttacaactggatccgaaatgataagcccaattttagagaagggctcccggatattggcgactttacacagttttgggccaatctatgtgagaaacctgtccaacacaacagcgaaggaatgaggttagcagaagatgagcgcttcagtgatggtatcgaagacatgcccgtgctagttgtgaatgctcaagacatacgtgaggcaacgcagtacaccaggaatggagctgcaccaggacccgattttgtatacaatttttggtataaaaagctaatcacaatccatgagcagatagcggcatgcttcaatacggtgttggaagattcgagaaaactaccaaaatttatcaccgggggagttacttactttctaccaaaagatcaaaacacaaaaaatcctgcgaagtatagaccacttacctgtctttctaacttaaacaaagtgctgtcgtcagtgataacgcagaaagtgaaagatcattgcgataccaacaacgtaatgaccgaagaacagacaggacgtcgaaaaaacacgcaaggctgtaaagaccaggtcattattgatgcagtcattgttggtcaagcagccaagaaacaaagaaatctggatatggcatacatcgattacaagaaggcgtatgattcagtaccccattcataccttcttaaggtactccagttgtacaaagtagacgggaatgtcatcaagctgatgcagcacgcgatgggtatgtggagtacatctctacacgttaccgacggaaaagttgtactacggtcaagatcactcaatatcaggaggggtattttccaaggtgacacctttagtacgctgtggttttgtctagctatgaacccgcttagcagaacactcaaccagcaatgcaactttgggtatttactcaaaagtgaagaaataagcacgagaatcacccacaccttctttatggatgacttgaagctgttcgcagaaacagtacagaagatgcaccacctgttgaagaacgtgcagggattcagcaacgacattaaaatggaatttggtatcggtaaatgtcgatcaattcatctacaccgaggtcaagtattggatgccgatagcttccgtgccaacgaacaagaggaaatccgccacatggttcaaggtgaaacttacaagttcctcggtttcctgcagctgaggggtattcactatgcagtgatcaagaaagagctacaggacaagttcttacatcgtgttagctgtatcctgaagagctttttgtcagtcggcaacaaggtgaaagcaataaacacatttgcggtggctctgttgacctacagctttggagtaatgaaatggtctaatactgacttggaagcgttggagcgaacaattcgtgtggtttccactaagcaccaaatgcgtcacccaaaagcgtccgtcgagagagtaatcctgccacgaaaaataggaggggtaggaatcattgatattcaggcactttgtatttctcagatccatcagctgcgaagttacttcgtggaaagccaaaaccgacatgaattataccgcactgtgtataaagcagatcacggattaagcgccctgcatctagcgcagcaagattaccagctgaattgcaacataaaaaccgtcgatggaaaaggcgcaacgtggaaacagaaggagttacatgggacgcacacccatcaactgaatctggaacatatcgacaaagtgtcatctagcacttggcttgtgaggtgtgaccttttctgtgagacagaaggtttcatggtagccatccaagaccgggtaattgcgacgtggaactatcggcggtgtatattgcgtgaagacgtggaggaccgatgcagaaagtgcaactcaggaggagaatcgattgagcatgtcattgccggctgtccagtgctagctgggtcagcgtatctcgatcgccacaacgacgttgccaaaattgttcaccagcagcttgcactgaggcacaagttggtagagcgatttttaccctgctaccgatacctcccagatccggtccaggaaaatgattgcataaagctgtattgggatcgcgaaattataacggacatcctcatccgtgccaataggccagacatcttagtctacgagaaaagaaagaaacgagcgaccatcgacatcgacattgctgtaacgttagaccataatgttcagacaacattttccaccaaggtgatgaagtatcatgatctggcagaggagttgaagcagacgtggtatctggaggatatccgcattgttccggtaatcatctcggcgaccggaattgtacctatggccctcttacgttccctggacgagctcgaactgcagagagaactacccaggattcagaaggcggtgattcttcgaacatgtagcactttaagaaggttcctgaatccctataactaacatccggtgcaaactcattaacattaagaaaagagagaggagaaatgagaatgagattcattcacctttggcatttgaatagcccggggtaggtgaaaagttcccagcatattgctgagaagtgacaaaattcggataataataataataataataataataataataataataataataataataatatgcataataata

SEQ ID NO: 124 - DNA, 2854 bp, Entamoeba histolytica
agtaatacaaaggaagataaataaactaaaagacatgctaataagaggaaactataaaaaattaagaaggatattaagaataagaagaatgatagaagaaaagataaggggagaagtaaatgaagaaataaaacaattagaatatttaaaagaaatgaggaaaaagaagtagacttaaacaaaagtgaaagaacaagaatctacagaaacaaaatcatgagtactactggaaaaaaagaaataagaaaggaaataggaagagaagaacaaccaagtgaagaagacacaaaagagtttttgaataagatatataacagaggaaaaagaataaagaaagagaatgaaagaataaaagagataattgaagagagtaatagaaggaatttgaaaagaataataatcacaaaagaaaacatagagaatgtgataacaagaataccatcatggaaagcaccagggattgaaaatatgcatggatattactggaaaagattagagagtgttagagacagattagttatagtgtttaatgaatggttagacactccagaaaacatcccaatagaaatgctaacaggaagaactattctaatacacaaaggaggagatagcaaaaaagcagagaattatagaccaataacatgtcttaatgtaataatgaaaatctttacttcaatcataaatagaaagatagaagaacaactagcaaataatgaagagaaataccaaattaataagagtcaatatgggaataagaaaagaagtctagcagcaaaggaagtaaatatcaacagtttattagaaagaaatgaaagagaagtacagaagaaaagatatttggaatcattctatgacattagaaaagcatatgatacagttaatgatgaatggctagaaaatgtattaagatacttcaaaataccatttcaaataactgaattaataaagagtatgagtagtagatggagaataagaataggatatagatataaagaagaaataagagaagttaaaataaagaatggtatattacaaggagattccatttctccactcttattcatattacaaatgaatatcatttctgatgttattgatagaacaaatgagaaaagactaaaagtgaaacacgtactatacatggatgatattaaagtaacaagtgaaacaaagaaaggaatggaaatggtgcataaaaatataatagaaacaatagaagtaataggaatggaagttaatgtaaataaaagtggagtaatgaagaaaggaaatataggaatacaagataatatgaaagacattccaatagtagactcagaacatcaatataagtatttaggtgtttatcaatttacaagaaatgatgatgttggatgcatagaaagaataagtaaaagtatagaagaaggaataaaagaaaacaataaagggaatgacagtagtatgaattatattaacagaattaatacagaaataattcctaagttcacatatagtgcatctgtagttaaattgcctataatgaagctgattgaaatagataaaatgataaggatagaagtgaaagaaggaaagattattggagcaggaatgtgtacgagtagattatatgtaaacagaaataaaatgggagatggattgaaaagcattagagatgaatatgcaattaaattaataagaagtattttatattacacatggaaaagaggaaatagaataggagacatgataggaataaatgaaaataagaatagaatgttgaatagattgtataaaagcatgttgaaaaaaagaataaacaaagaagaatttaggaaaatagtagaagaagaaagaggaaaacgggataaaaacagaataattaagtatgtgagagagaagttccaagaagattatatcaataaatggagaaacaagaaagtaaacagtgaaatattgaaaggatttgaagataaaacgatggaacagaagaaaacaattaaagtgtggaaaggaattaatgttataagaaaagcatatatacaaataaagaagatggaagagaaagcaagaaatgtaggagtaaggaaagcattaatgaaacatgatatgagatatgcaatatgtccaatatgtaataaaatagcaacaataaatcatattcttttgaactgtatagttactaagaaaacacaaatgaataaacatgatagaataggagaatatatatggaggagtttaaagattaaataccaattatatgaaaacaaagaaaagatgaagatgagagaagaagaaaatacaaagaaattaataataaggaaagaagaattaggaaagaatgaaagaagaatagagaaagataaaatacttatagtttggaatcacgaagtagtaaacagaagtgaagacaaattccataaaagaatagatatttatgtcagagacttaaataagaaagaagcaatgattatagatatgacaatagtaagagataaaaacataagtaaagcatttacagataagattaatatgtattcaaaactacacgaacatataagaaagatagaaagattagtacgagtaatagttataccagtagtaataacagtgagtggattaataaacaaagaaacagttatattactaaatgcagaaggaatagaaataccaagggaaataatgacaagagagattgtaatatcaaatatgaaagatcttatgagatattgtggagatcattctggagaatacagcaatgtagaaataccagaagaagaagactctcaggagagtgaaggaagggaagaaattctcacctgaacaataagttgaaaggtattaaaccttaatttaatatttattctttattctt

SEQ ID NO: 125 - DNA, 2759 bp, Entamoeba histolytica
aatatgatatatatcatattaaaataaaaacaattgaacaaataaactattataaatacctccgaaagatgaaaagaatagaaatagaaacaagaaagaataaattgaaaaagaataagatgcaaatataaaatgatgaaatatggaaaaatgcaacatctaaataaatctaaagaagatgaatatccagataatatctccactattaatttctggaaaggaatctatgaaactaacactaatatagatttcctgaatattaatttatatgaaatattaaatgaaaatagaattaataatagaatgtcaataatcactcccaatgaactagactgtgatactaaattcgttgataaatttgaaattaaattgaaaatgataaaatacaagggattttggattaaatatttagaacaaccaaagaaatatttattaaaattatttaatgaatggttaaacaatcctaatgaaatacttctccattttattcaaggaaggacaatattaatatataagaaaggagataaattagacacacagaattacagaccaataacttgtttaaattgtctgttaaaagtgtatacgtcaatattaaaaatgaaaatagaaaatcaattgatgttaaatccaattgaaaaacaattatcattaaatcaaattggatgtaagaaatatacatatgcatcaaaagaaggattattatacaacactataatcaatcaattattattaaagactaaatggaagtgggtagaaacatattatgacgtctccaaagcatatgatagtattaatcatcaatggattaaacaatgtttaatttattttaatatcctactagtagtaattaatagtatattatacatattaaataatacatatcttaatttatattataatcaagaaagtgataatatgattaatgtagaaagaggaataatacaaggtgacagcctatctccacttttatttatattatctattgatgtattatctaaacaattagataaacaaataagcaaattaaatattaaaatgaatggagaagaaaaacaagtccagttaaaccacatattgtatatggacgatttaaagataatgactaatagcctcgatgaaatggaaaaagcccacaaattaactaaagaaatatttaatgcaataggattaaaaattaatttagagaagagtgggataatgactaatattagtggtaaaataaatggtgaattagatgaactaccaagagtaactaatgataatccttataaatatcttggtattgaaataggagataaaataaacatcaataaatattgtacaagaatattaaatgatgtatcttctattttatcatcactaaacactatgaaatatagcagcctcaatacaataagaaagattaatagtgatataatctcaaaattaagatatggattttgtattgtcccatggaaactaggagaattggagaagatagataaacaaataagaaaatcattaatacaactccaattatacagtagaaatattcccaaaagtagactatttgttaaaaagaatgaattgggattaggattaatgtcaccaagagatgaatgtggtaaagaattattaagaatatatttaaaatataagtggagatcaagcacagaaataggagaaatgatagaagcaataaaagaaagtccaaatggaataattaaaagaatgaagaaagcatttggtaagaatattaattttaatgaattaatgaatgtaatagaattaaatgaaagaaagcacaatgtaaaggaaatatttgaatggataaataatgaattaaatgatagatatttaaatgaatggaaagaaaagaaatgtggtgaatatataagatgtgcaaatggcacttttaatgataagaaattaacagtagccacttggaggtcattagatataaaaagaaatgaattcctccaaatagtaaagatgcaagaaggtgtaactatgacaggaaatattaaatcaaaaatactccaaaatgatgctttaaaatattgtaaacattgccctaacacaatagcatctattagtcatatattgttaggatgtcctgtaatgaaaaagaatcaaatatcaaaacatgattatgtttgtaaacaaatatttaaacatatattaattatccattttaatgaatttgatgcaattgattttgataatcctccaaaatgtataaataatgataaaatggttataacttacaataaagatttaatagttagtgaccattctttccatgctagaagaccagatatatattatcaaaatatgaaagaaaagaaaggatatatcatagatgttgctatatgtcaagataataatttagaattaaattatattcacaaaataaataaatacaaagaattacaagagaaaataagaaataatagagaattaatatatgtagaaataatacctgttatattatcaataaatggtttaatacataaagaatcagtaagaagagtaaaatcattgaaattaaaataagacttttccaaagtcctacgaacaataataataaaaaatatgaaagacttaatgttctatacaggaaattctggcagcacattataagaagaacaatttaatgcgagcatgttagaattgaactctattacaccaatagagcatattgaagaaattgaaataatcacttctcagtatgaagaaaatccaattgaggatatatctaatatttgacctttttt

SEQ ID NO: 126 - DNA, 3988 bp, Giardia intestinalis
ctaacacacagcctgcagcgcctggcccccctggccgtgacccgcgcgcccccgcgcacaggagcatacccctggagctggggagaaggcccccctggccgcgcccccgccgcgagaccacgcgggcacgggggctgggcgccccgggcgggcccttcccctccgtcgtgaggctgcctcccctccaatgtccttaccgccttgcgcgcatattacgtagtaaaccgcctctgtaaaaaaaaaaaaaaaccatgcgttccgccctttccgcgccttcgggaaccacggagatcggggcttcctcaggcccagagcctcccaaccacgctccaaccgactcccacaggcccctacctaggggcactcccgatcctatgacgctgggtgacggcaacgatgcctcgacgaccgccatggcccggccttcctcttgcgagcccctctgcggctcccacgggcccccatccccccagcctgggcctggcaacagccgttccgccacggacaactctcccaatgagtcttctcctgtccatggcttacagggctccggggcctcggtggcccgggacgcctctcctccctgcctgtcgaacgaccttctgccctgtggccaggagcccctcccgattcccgacgacggcctcccatacgacctgggccacgacaactccccgtccatcacggacgagcaggaggcccggggcgcagacctgcctgctcctgggggccgtacgactgtctgcgagcgctgcggagaggtgctgcctgactctgcggcgatcgatgtccacatcgggatgcaccatccgcctcccggttcaccttctccgtcgcgcagcccttctccgctgtcggggtctgcccctccacctgcagccgccgagccctctccctcgccaacgccggaccctgtgttcccgtatgcatgcagcatgtgccgggcccgatacaaaacggagagggggctgaaggcccatatcgccaggctcggccactacctcccgctcgacgccacagtccccgagcgcatcggggtgcctagtggcagcccgtcccctgagctgcttcgcctcctcactgacgtattcacagagatggcggggcgccttcctcctgtagaggccctagcgcgcttcctctcgacgtgccgccgcatggagggctctggacggctccccccggcgcagtcgcttctccggaaggggctgctcggccgggcatggcaggcgctgttgagcgagacgtcctctgccgccagggtccccgagccccagggcaaggagcgggaagcgattgtccatgagctccacccgcgccccatgcctgtctctctgccccccgtccatcacgtgctcggcccgtcgcccaagataacggccaaggcgctgctgaaggagctgcaggcgatgaggcctgtcgcggccggaccctctgggctggggaagcctcacctcctgcacctttgtggggccgccggggctgcggagctcttcacctctgtcctgacgaccctcttctccagcaggaactgggcccagctccagcccctgtgcgagttcaggctgaagcttctgcccaagtctggcggccgatggcgccctatcgcagtgcaggagacgcttctggtcgccttccaccgcttgctcctgcgtcggactcccgcgctccgcaagctcccggcgtggcagctggcctttgagcacctcgcccagatgaaggcgatccgcgcggccgaggagctgaagaggacacaccacctgctcacggtggatgtgcggaatgccttcaacagcgtcccgcattccgtcatcctctttgcgctccgccgggcaggggtggtccagccgaccgtcgcgtacattgagtcgttcctcgcggctcggcactcctcggacctccccgcggtcccagcgggcgtgccacagggggacccgctgtccatggcgatgttctgccagagccttgtctggccggtggagacgtacctcggccagtacaaggtcgttgcatacgccgacgacctcgtcattgcgtcagaggaggcgattcccatagataccgtgaagagtgacgcgcagtctgccctctcccgcatagggctcacggtcgagctctcgaagtgctcctcgacccaggccggggcgatctccttcatgggcacccgcgtgctcaagcactcctccttcaacctcgcgcagacatcggcccgccggctccacgagcatctcgccgtcctccgtgcttcgggtctctcactccacgaccgcctcaggctcctgtctgcctgcgtcgtccctgcagttaactatggaccccttgttgacgactacccgggcccgtccccctatgccgacgtcgatgcgcagatagtggaggaggtcgcgacccttctggagatccccgaaccccttgcgaagacccttgctctgacgccccgcgcgaagtacggcctcggactggtgctgccccatcactactacgacgagatgcacaggcagcgccaggacatgaaggcgggcgtcttccgcgagctgaggaagaagcgcctgcaggacacggccgcgctccgatccttcctgccgctcgcattgctgggctgcgcacccctggacaacacgcaggtcctgttcataggggactgcttggcggggaggtaccagcggggccggccgatgggcacgtgctgccactgcaagcagcccttccttcccaggcaccatctggtgtgcaaggccattaacgggattcacgtggcgcggcacgacaagattctggacgccctgctcgcgtgctcccgcggtcgcgctgggtctgttgtgcgcaatcccacgatcccagtggatcacctccagcctgaccttgtcatcggtgggggcttcggggacttggtggtcactgtcccgtggaggctggagcggtcctatgccctgaaggccgccaagtatcgccccctcgtgctccaggggcgggcggcccacatcctccccgtcgtggtcggtgctgacggcgtcctgcaccacctgtctgcggccggactcgcgttcgccggcgtggaccttgcgcgcttcatgcaggaggcggcgcaggtcatcctctggcactacaggctgtcggccctcctgtacgctgggctgcgagtggagaggccggtgcaccgccccgcccctgcagtatccctgccggaaccggctcccaacgaggctcgggctactcctcctactcccctcacccctgccatgtggagccctggcacgtcgccctccgtagagatcatggccgatctcagccagcatcctgatgcggcagtccctcctccctggggtcctgctgaggtctcctcctcgatcacctggggcaccgatcaccccgcacagccggatgcaaacgaacgcccagaccccttcatgtgctcaagggccccctccccgcctccactggatgacgacagccccgacgatgcaggagcacccgagccggtgcacaaggccctgccgtccttcttcaagcgcgtcggtcctcccaagccgcatgcccctgatggcttctaccccttcaaacgcatcgacacggggcgctagtggtcatgcttgggcaccctgcccgctgtcggctgccccacagcgcgaacggacccctgggcctgcgtgccgagctgtctcccctggtactcctcgctcgcacccgaggcctcttgcccctatcattcgggtgtgcatcacgtccagacacggtgcgatagatgcctagccgcgatgccatacacactcgaccaggccgggccaggccggacgcccccctggatggccagacacccgccctgcctacgtttgggcacttcctcgatgggactcgtcatctgcccacgccgcagcccggtgttcgtctgtctgtcctcccgggcagcggcggtccttgggtgctgagtctggcgagctggtgctgggggaagaggctagccccgtgtgtcattcgtaccatcgcaccg

SEQ ID NO: 127 - DNA, 2890 bp, Giardia intestinalis
cccggcgtaccccttcaggtgcgctatctgccgggcccaatacaagaccgagagggggctcaaggcgcacatgggcaggctcccgcacttcacaccccttgaggagaccgtccacgacatgatcgggataccgagcggcaaccccacggagcctctgctgcagctcgtcctggccacctacacggggcttgcaaggaccctcccgcccgccgagacactcgcccgcctcctcaccatctgccggaaggcgacggctcgggccgcctcccgccctctcggatgctcctacgtagggggctgctcgggcgggcctggcaggcgtgcaggacgaggcgtcccaggccccgcggatcccggagcccaggggcgagcagcgaggcagatcatccgcgacctgcaccccctcccaatggacgtctccctgcctgctgtcccccatactctcgggcctgccccgaagatcaccggcaagaccctggtgagggagctgaggtccatgaaggccgtcgccaccgggccctctggcctcggcaaggcgcacctgctccacctctgcgacaaggcaggcgccgccgaggtgttcgcgaccgcgctggcaggcctcctcgccacccgagactggggccagctgaagcccctcgcggagttccggctcaagctgctgccgaagcccaacgggaagtggcgccccatagcgatacaagagacccttctcgtcgccttccacagggcgatactcaagcagacggcgcctctgaagaagcttccctcctggcagctggcgttcgagcagatggcgcacgtcaaggcgatcagcagggccgaggagctcaaggcctcgcaccacctgctgaccgtcgacgtgcgcaacgccttcaactcggtgccccatgcggtgatcatcttctcgctccaccgggccagggtcccgctccccaccgtcgagtacgtctcgtccttcctgggcgcgaggcactgcgtagatctggcggccgtgcctgcaggggtgccccagggcgaccccctctcgatggcgctcttctgccagtcgatcgtgtggcctgcggaggccttcctctcccagtacgagctcctggcctacgccgacgacctggttgtcgcgtcccacccctcggtccctgcagacacggtgaagagggacgcgagcgacgccctggccaaggtggggctctgcgtcgagcagcccaagtgcgcctcgacccagctgggggccatcgccttcatggggacaaggatactgagggacggcccctacaacctcggggagcaggccacgcgctctctgctcggccatctcgagaccctccgcgccgcagacctctcgcgccatgacagactgcggctcctggcggcgtgcatcgtcccgtcggtgaactacgggcccctggtcgacgcatacccggggccccactcgtacgccgacgtggacgccgcagtcgtcgccgaggtcgctggcctcctgtccatccccgaccagcaggcccgggcccttgccctcacgccccgctccaactacgggctgggcctcgtcctccccggccactaccatgccgacatgcagcagcagcggagggagatggctgcgggcaccttccgcgagctgaggcgcaagcggatcaagcagtctgcgcccctccgatcgttccttccgctggctctgctgcgcggacctcctctcaacaacgatcaggtcctctttgtgggcgagtgcctcctgggacggtaccagaagagcgtcgtcctcggcacctgctccttctgcaagcagcccatgcgccccaggcatcatctcctctgcaaggctgtgaacgggatccacgtcgccaggcacagcaaggtccttgacgccctcgtggcctgcgccaaggggcggcccggcttcgtcaccctcaacgcggccgtccccgtggaccatctccagcccgacctgatcatcggcgacggctacggggaccttgtgctgacggtcccctggcgcgtcgagaggtccttcgccctcaagctggccaagtacaagccgctcgtcgacgccggcagggccagacacatcctgccggtcgtcctcgggaccgacgggaccatccaccccacgtcggctgccggcctcgcctctgcgggcgtcgacgtcccccgcttcctgcaggaggccgccctggtcattctctggcattacactcagtcggccatctcgtactccgcactggccgtcccgaaggcgtcccctgttgcggctgcggtccagggtgccccgctggtgcctgcttctcttcctgcaccggcacgcaaggacccgcccagcgccccgcagtgtcctgccgacgcccccgctgcggcgatcactgaggcggcggggctctgcacccatgccctgcctgcgtcccccagcgtggagctgatgctctcgttcgaggtctccaacgccccctcgcccgggtcctacctgccggagccctcctctgaggcgcacacggcggagagcccgaccccaacgcctgcagcagcgggtcctcccgtcgccccgacggtcgagccggcccggaagcagcgcccgcccatcttcaagtacgtgggggtcagggcggcgccagcgagggaggacaggccctatccattcaggaaggtctccggcacccttcctgggggcgacgctcctcgctccggctagcacgggctgcgtggcggccatgacaggccccatcccctgcccgaccgatccatccctgctgcccgccgtggcctgggagtccctcgacgccgcacatgacacaccctcgcggcacgtgagaacaaaccagggctctgtctcggctcgctgctctgtccctgggtggccaccctcattgtgatggcgcctgcctctccagctgcc

SEQ ID NO: 128 - DNA, 4704 bp, Giardia intestinalis
aaaaaaaaaaaaaaaccatgcgttccgccctttccgcgccttcgggaaccacggagatcggggcttcctcaggcccagagcctcccaaccacgctccaaccgactcccacaggcccctacctaggggcactcccgatcctatgacgctgggtgacggcaacgatgcctcgacgaccgccatggcccggccttcctcttgcgagcccctctgcggctcccacgggcccccatccccccagcctgggcctggcaacagccgttccgccacggacaactctcccaatgagtcttctcctgtccatggcttacagggctccggggcctcggtggcccgggacgcctctcctccctgcctgtcgaacgaccttctgccctgtggccaggagcccctcccgattcccgacgacggcctcccatacgacctgggccacgacaactccccgtccatcacggacgagcaggaggcccggggcgcagacctgcctgctcctgggggccgtacgactgtctgcgagcgctgcggagaggtgctgcctgactctgcggcgatcgatgtccacatcgggatgcaccatccgcctcccggttcaccttctccgtcgcgcagcccttctccgctgtcggggtctgcccctccacctgcagccgccgagccctctccctcgccaacgccggaccctgtgttcccgtatgcatgcagcatgtgccgggcccgatacaaaacggagagggggctgaaggcccatatcgccaggctcggccactacctcccgctcgacgccacagtccccgagcgcatcggggtgcctagtggcagcccgtcccctgagctgcttcgcctcctcactgacgtattcacagagatggcggggcgccttcctcctgtagaggccctagcgcgcttcctctcgacgtgccgccgcatggagggctctggacggctccccccggcgcagtcgcttctccggaaggggctgctcggccgggcatggcaggcgctgttgagcgagacgtcctctgccgccagggtccccgagccccagggcaaggagcgggaagcgattgtccatgagctccacccgcgccccatgcctgtctctctgccccccgtccatcacgtgctcggcccgtcgcccaagataacggccaaggcgctgctgaaggagctgcaggcgatgaggcctgtcgcggccggaccctctgggctggggaagcctcacctcctgcacctttgtggggccgccggggctgcggagctcttcacctctgtcctgacgaccctcttctccagcaggaactgggcccagctccagcccctgtgcgagttcaggctgaagcttctgcccaagtctggcggccgatggcgccctatcgcagtgcaggagacgcttctggtcgccttccaccgcttgctcctgcgtcggactcccgcgctccgcaagctcccggcgtggcagctggcctttgagcacctcgcccagatgaaggcgatccgcgcggccgaggagctgaagaggacacaccacctgctcacggtggatgtgcggaatgccttcaacagcgtcccgcattccgtcatcctctttgcgctccgccgggcaggggtggtccagccgaccgtcgcgtacattgagtcgttcctcgcggctcggcactcctcggacctccccgcggtcccagcgggcgtgccacagggggacccgctgtccatggcgatgttctgccagagccttgtctggccggtggagacgtacctcggccagtacaaggtcgttgcatacgccgacgacctcgtcattgcgtcagaggaggcgattcccatagataccgtgaagagtgacgcgcagtctgccctctcccgcatagggctcacggtcgagctctcgaagtgctcctcgacccaggccggggcgatctccttcatgggcacccgcgtgctcaagcactcctccttcaacctcgcgcagacatcggcccgccggctccacgagcatctcgccgtcctccgtgcttcgggtctctcactccacgaccgcctcaggctcctgtctgcctgcgtcgtccctgcagttaactatggaccccttgttgacgactacccgggcccgtccccctatgccgacgtcgatgcgcagatagtggaggaggtcgcgacccttctggagatccccgaaccccttgcgaagacccttgctctgacgccccgcgcgaagtacggcctcggactggtgctgccccatcactactacgacgagatgcacaggcagcgccaggacatgaaggcgggcgtcttccgcgagctgaggaagaagcgcctgcaggacacggccgcgctccgatccttcctgccgctcgcattgctgggctgcgcacccctggacaacacgcaggtcctgttcataggggactgcttggcggggaggtaccagcggggccggccgatgggcacgtgctgccactgcaagcagcccttccttcccaggcaccatctggtgtgcaaggccattaacgggattcacgtggcgcggcacgacaagattctggacgccctgctcgcgtgctcccgcggtcgcgctgggtctgttgtgcgcaatcccacgatcccagtggatcacctccagcctgaccttgtcatcggtgggggcttcggggacttggtggtcactgtcccgtggaggctggagcggtcctatgccctgaaggccgccaagtatcgccccctcgtgctccaggggcgggcggcccacatcctccccgtcgtggtcggtgctgacggcgtcctgcaccacctgtctgcggccggactcgcgttcgccggcgtggaccttgcgcgcttcatgcaggaggcggcgcaggtcatcctctggcactacaggctgtcggccctcctgtacgctgggctgcgagtggagaggccggtgcaccgccccgcccctgcagtatccctgccggaaccggctcccaacgaggctcgggctactcctcctactcccctcacccctgccatgtggagccctggcacgtcgccctccgtagagatcatggccgatctcagccagcatcctgatgcggcagtccctcctccctggggtcctgctgaggtctcctcctcgatcacctggggcaccgatcaccccgcacagccggatgcaaacgaacgcccagaccccttcatgtgctcaagggccccctccccgcctccactggatgacgacagccccgacgatgcaggagcacccgagccggtgcacaaggccctgccgtccttcttcaagcgcgtcggtcctcccaagccgcatgcccctgatggcttctaccccttcaaacgcatcgacacggggcgctagtggtcatgcttgggcaccctgcccgctgtcggctgccccacagcgcgaacggacccctgggcctgcgtgccgagctgtctcccctggtactcctcgctcgcacccgaggcctcttgcccctatcattcgggtgtgcatcacgtccagacacggtgcgatagatgcctagccgcgatgccatacacactcgaccaggccgggccaggccggacgcccccctggatggccagacacccgccctgcctacgtttgggcacttcctcgatgggactcgtcatctgcccacgccgcagcccggtgttcgtctgtctgtcctcccgggcagcggcggtccttgggtgctgagtctggcgagctggtgctgggggaagaggctagccccgtgtgtcattcgtaccatcgcaccgcgccgtgctgatccccccatggaactgcccgccagtggccgcctccggtccggggcggcacagccctggctcgggccatcctctgctgcagcgccccggtgccccctggagaggatggccgggtgctatgtgctactgagccctcgggtgcatcgcttccccactgccccccctcatgtacccactctgggcgccccggtacagggaacctggtcactctggccctggcctccaggtgcttgccctccaatgggccatccctcatgcgcctgtgtttgcctggcccattctcccctgctcctctctacctctcctgctcggtctccgctgagtcgcggtgacggctgttgacagtcccggccgggcccccaggtttcgctccatacctgggccacatgcctcccaccagcgctggcaccacatgggttgcttgtcacagatgggactggcacgcacagaagaatatggctccacggcgctctgccggtctgtcctgagctggcgtcatcagcctggacccgcccttagggggcctcctccatcacccgtgcctccccacaccacctcctaagccgtcagtctgctctctcaggcgtgaccttctgtcggcctcctgggccgtatgggaccaccgccccgctgcccccgccatcttggccagacgcctccggtgagccaccattctggaatagcacgacacgtgtggatgggctagctatggcgcacggtccgcaccctcccttctcacggactcccggggacagtccggacgcgtctcccttgtcccccgaatcggtggccccggccgatccccatcgtgcatccttatatggggcactgcacacacctgtccacgctgtccccttgggccggccacagctcaccccgtgtgtcgatgggccagaatttgggctccccaaacccctccacccccaagctgtttcctcgcc

SEQ ID NO: 129 - DNA, 772 bp, Giardia intestinalis
gcgcctggcccccctggccgtgacccgcgcgcccccgcgcacaggagcatacccctggagctggggagaaggcccccctggccgcgcccccgccgcgagaccacgcgggcacgggggctgggcgccccgggcgggcccttcccctccgtcgtgaggctgcctcccctccaatgtccttaccgccttgcgcgcatattacgtagtaaaccgcctctgtctggttctctgggctcgcgcttccctttttagtgcaacagcattatggtgcctcgcgtatgtgcgcggtgcagtgggccggtctgtaggcctgcctttgactggaatcctggatccctgggtttctggcccgacgcgtcgtcttctaccccccaaacaggcctgcactcttcttggtccacgggctatttgtctctttgtttccgcggcccagggcctgctggttgcgccggggcgacgctcatggtggattttattttttccaaaatccagaatttgggcctgaagaccgcccccgcaggcctggaggatgcggggaatcggtccacccacaccatgcgctcgagcaaaggccaagcacccacgccatcacgtctcatccaggactcctgcgccgccacggaggaggatcggcaccttcgccatcgatcctccaggatgccccctaccactccccctcacatggcacgcctccctcgggcctgtatgtctgcatgccgctatgccctaacaccgcagccgccctctccgcggatccactaacacacagcctgca

SEQ ID NO: 130 - DNA, 4814 bp, Girardia tigrina
gtaggtaactatgactgcaaaataataattctacacctattgttgataactcatctcgtgcgcaaacggagcatgttatttctaatcatttcgtcacacaggattcttctaattctgatagtaatattatagatagagataggaaccttgttgatttagatgcgtcaataacttctcctactattatacagccagaggatagtaagatatctgaggatgaggacttcatcttagtcaataggaaaaagagcaaaaataagaaaaaatctaagaaaacaactgaaaataaaaatgaaattcctattcaaaagagtaaagataagaaaaagaagtctaaaattaataccgaaaaactaactgaaaatattactacttctgaaataccacttgaaattgctccttccatacctttaccttcagcaagtacctcgggttctcaacaaccggccaatcctccagaagacgctactctaagtgatacggatctcttccttacacaggatgatcccgatagtcttattctttctggaagtactcaaccaacctttgttgacctcaacccttcacagcaatcggaacttccttcaaatactgacagccaaagatttgaggcgggtgaaacacccaaaatcataacttcttacagggatgaccttttctactctacagtccttcactacaactcagatacaggttacggtataagtgttgacaatggggagcagaggtttcgaattcttgctaggaatcttgtcaggaaaaccaaggataagttcccctctttatatgctggacaagtaattagacacacagtcttcttcaatcacttcaaccaggcatactacgccaataatataactgatagtaaaggtaatctaattgagttttctgatgataagccttttcaaagtataccgactgacccaaaaactgaactagagcaaattaggagagagagacaacatctagttgatagagctcttagacataatcagttacgggaaacttatattttaaataaacttaataataataatggggggggtggcgaacatttgaaaaggaaaaagatcaaagtcaatacggatgatgtctccagcaatgatggagacagaaaacatagacgacaggaagaaacctcggacaatggagctgctattcccgctcaatccaacaatcaaattactcctttaaactgagttcgactgaagtgggagagctcgttgagcaatctccagctccccttcagtcgcctcagttctctaacaattataacaatctaaatatcaacaacaacttatactatagtctcaatacttttaatcagtctaataacctttgctgtcttgttaatattgagtttttcccaactcaacaccttcttggtgatatagttaactcggggtgcataaactatatgaataattataataactttgataatattaatttatatattaatagtaatgtattatcttacaataattataatcacagttttctcgcttccccatatactactaacatcacagaacatgcagacataaacatgcacgtgcaagaagttaacatgcagcaagataacaatacacaacatgctataacacaacaagtctctctacaagcaacatctctgcaacacacgttggacgaaatgatagtccagtttaacactgctgtcaggttaaagaaaaagcacaaagttgcaaaaatctttaggggacataatcatcgtaaagaccttccaacattgcctgctagggaacagtataaaactaaaccgaaacttgcaattagagaggtacttcatcgaaaaacaacagctacgtcttccccttctgaaaatgcaattaaggcttttttctcctcctacagccgtccagctgaacttttcactggtcaggaacttcttgaatcatcttggttcccagtacacccggaagatgactttgagtttagaattccgggtagagaccaaatagcgaaatacatcaagtttgctagtaaatcagctgctggtcttgactggatcacgtacgaggatattaagttaggcgatccgtccggggaaattctccaacccatttttgaatatatagtacaaaataacatatgcccatccgaggggaaggctagtaggaccattatgattcccaaaccgggaaaaagtgactattcagatccttcttcttggcggcccattacaattaccagcgcagtatacagacttctcatgaaatatcttacatgggagctgtataactggattcttcttaatcagatgctgtccaggagccaaaagagtttagggaagtttgagggatgtcatgatcacaacgcaatgttgaacatgctcatccaagacgttaggagacagaccaacccgtctaatccaatcaataagaataagaggctatacatagtcttcctagactttacgaatgctttcgggtcggttccgttagatactctcatgtatgtccctcaacgctttggcttaggcacctctgctttaacgctgattaaaaacttatatctagataactacacaaatgtaacatgtggggaaagcaaaatagaaaacgtaaaattaaataaaggggttaagcaaggctgccctctatctatgctgcttttcaacatttttatcaatattataattagggcaatagaagctatgccagatgtccatggatacccacttggagatatggacatccggatactggcatatgctgatgatattgctctaatatctgactcccacaaagacctgcaggaaatggtctacaaggcggaatatatcggtcggattcttggactactcttcaacccgtcaaaatgtgcacttatggacattccgcacgacaagaagaggacgccgcctatcctcgtcaacggtgagatgatcaagtgtgttggaaaggccgacccatacaaatatcttggaacctttagatcctggttccggaagctggatataaaggagctcctccagatgatgatggatgagactaaactcatcaccgagtcaaatctacatcctcaccaaaaaatccacgcgtatgagaccttcattcacagccagctcccatttcaccttagacacagccgaattccgttctcagacttcataacaaacagaaaaacaaacaaaacaacaaacaattcaaacgactcagaaaaatctatacagaaagcctacgatccggaatcaggacaattattcctcaacaccttcgcccttccaagtggatgtgctaaggatttcttttacattacaaaagatgcaggtggacctcaactcacaagcggactggatgagtacttaatccaatcaattatgtacatcttccgactattgggcagtgaggaccccaccttaaactctgcaataaaacatgatctcatttcccacttaaatttaaagggttttgtaaatattaatttttctcaagccatttcaatctttaattcaaattttaccgaccgaaccgatcacttttcacatcttagccgcactgaatgggcaagacttcaattagctcggaaaaaattgaagtcaaccttagccatccaaactaatgtctgtctgataaatgggcatcttgtcttaactctttcgctagaaaacaacgttctgttaattgatagtaaagaaaagggggatgtcaagaagatccatgcatccctcatggggtttcttaggttagctcaccttatcagactgcaaaaacatggatggtcaaaactgctcttcagtgcgaccactcatcacgaaatactaaataagcgtatcttgaatggtcacgtcccttataagatttggtactttattcatagggcgcggctggggttgttgcctactaaactctttagtgttagtaacctttgtaggaagtgcggggggaagaaagagaccatgtcgcatgctttggtcaactgtccaatgatgcagaccctcattaatgagagacatgatgctcttgaaatctcccttgtacaaattctttcttctaaatttcagggtacggttataaggcaaaagacctatgtcaacgagttaagacccgatatcacaatggaatcggatacccaatattatcttgttgaggtaaaatgcccctttgacacgaagatgagttttgaattgagaacacaacaaactactgataaatacaacattattattgaaatattagaagatgtacaccctgggaaggaggtgcgccttgttacgtttattgtaggcaccttaggctcatggggcccgcagaactcggactttttgagagatctgggattctccaaagacgaaatcgaccaggtgaagacgcggctgatgcttcagaatatcaattcctcctgcgagcagtggaaaagatttgtgcaatatgcacccacaattacacctgggccgattccagacgcggagagcgaggacgatcaggggacgagcgacaatgggccaacagctgctacagtgcaaggaccggtgattggcgatgaggaggaggaacttcaaatctacgattccggccttgacgagtccagcgatgatgaacccgacccagatgatgctgaattacttttcacaattgacatagaacaatatttgaattctgtgataacagactgatccgtgtgtttgtgtcgtatgattgtttccgtgtgtgtctatatttttcttttttatactttcaattacctcgttgtaatgttataacttcatatggaatatatgtaatttagtttagtttagttagtttagtttagtttagtttagtttagttagtttagttagtttagttagt

SEQ ID NO: 131 - DNA, 3210 bp, Giardia intestinalis
  modified_base (130)..(130): a, c, g, or t
atgatttactccacccaccggttgcttccagtggtgtgctgctggggcctgcgctgcaggtatggtccagagatctcacgggtaagctctcgctcagtccctggccatgtccggagacgagggttggccncgggtcgcaatgatagccacagtggtgatagggaggagctccctccgtttgtggatctggggtctgtgcgttcctcggctgttccgcgggcgtgcgcacagctggacctgaggcgaaggagagcccgcgaggacccgatccacattatgaacgcaagatcgtacctccgggacacccagagagcaagccgtgagtctctactcgggggaccactccgaagacgtttgccctctcggcaggacacacacgctggctctgtggcctaccgtgcgagagcgccaagcaactaaccgagcacctgagagaagcaaacgatgacagacacagagtgctgggcgacgacaaagctgatcattccggcccacataccgaaccagacagagcctgccatgctcatccaccagggtgcgcgcatgatcgcgagcatcgagcaggccgggactggggtcgcgctccccgctatcaggggcctgaacgccctggtgggaagccgccagaggactcctctgccaagcaacaccgcggagcagtcccagagtaaggcagacccagaccccgagaaggcgagacgccggatagcaaacagggtgaacaacgcgctgagcttcggagcagttgctaaggctctccgcgcccttgatgacacacccatggtagacaagccagagaaggccaaggccgccctcagcgcgctacacccgtgcgtcctccccgaaggctacgttggccttgactaccctccatcgatgagctcgacggggctggagccggcaaccgaggaggaaatgaggaaggccctgtttgggactctcaacaagaaggcctcaggcgtgtctggcctcgggccggtccagctcaaggcgatgaagcagagcgacagcttcgtgaaatacctcacgcaggcgtacaacgagctgaccacccaccccgaaggagtacccgatgtgacggccatgttcgagttccgggcgatcctcatcccgaaagagtccgacggatacccccgatcgcgataggcggatggtcacgaacatcttccaccgcgtcctgctgaagcggctgatcaggcatgccaactacctctcatgcgaacagatcgccttcaagcagaacgcatacgcggtaggcgtgaggagggcccacgagctcatcagcaggccggggatgcacgccgtctccctcgacataaagaacgccctcaactcgctcccgagggcagaggtcgtcagagccctgaacgaggcgggcgtcccgaaggtcctggtcgactacatcggggacttcctcgacctgaggcacagccgggacgtgaagtgcgaggtctgcggcgtcccccagggcgacccgctcagcacgctcctcttctgcatggccatcgagcgcctcctgagacgcctcagggagaggggcatcaccttccttgcctatgcggacgacatcgtggcgttccacgacgaagggtacccagcaggtgtgataacacagctggccacagcagaggctgccgccatgggcctgacgatcaggagcgacaaatgcaagtccaccatggcgggcgaggaggtgaccttccccaaccacccggtgtcccccacccctgccagtctcgcgccgaaggccatcgcaggtgccgagactgccttgaagaagatcgagaatgcccccataaccacccaccagaagctcatcctgctgtcactctgcgtggtcccgatggtgagctacgcccccctggtcgagataacatcggacaaggcggactacgaggagctcgacagacgtcgcacaaagcttcagcaagctaaccagcagaagctgcgatcgcctggtcgacttcctggcgtaccaaaggagaagggcggcctgggcctgctcatgccggggctctaccacgacgagctgcggagggtgtgggcctccctggacgtcaacaaggggaccagagacccggtggagctgccggtggaaggccaggcactgcaagggaaggggcctactccaaccgcctcctcagccacacaccagcttccagacagagcggcgacgtactgtctgcagatgtgcggcgtgctgaccgaggaggaaagggccctgaaggagaagggcggctcgatcatggcgcagaaagaggcacctgcccgggctgccacacggcgagccctcgaccgcgacatgaactgcccgaaagcggcgtgaccctcgaccacgaggcacgacatgatcgtcgcgtgcctgtgcctccgcgtctcggggaagctcaaccggagctggaaatcaagacccacagccacctcagcgaccagaaccagaagcccgacatctggctcgtcgacaagtgcaaagcgatagatgtgggtgtcatccagctccgccagatggatgcctactacaacgagaaggtcaagaagtacagggacgggacgctcccgatcatctacgggacagacggatccctccaccccaagtccaaggggcacctcgaggagctccacgtggacgtcgagaagctctctgtccgggccgccttcgccatcgcccacatggctgcagaggagaacgagcatccgacgaagctgatcagacgcgaccgggccgaaagcctggtcacccagagcgaccgtctcctgtcatcctacttctgacagctgaatgaatccacccctgggacctgtcgacaacgaccgagaaggggcacaagactggacacacaaccgagttgaatcccaaccagaagagaaagccccgctagctgctgctgatatacatggacagcattgagaatgacaacaaagaccagagcttcactcaccgtgaagggagaacaaggagaggcgccctagtagaccagcgagcctgcaggacggcctgatctccaaaaggacctatgtgcacacctagaccgagcacacgcccgtagaacagctgaggaacgcagatagctcctccctactaccactgtggtctttatattgcatacacgaccaaccctcgtctccggacatcgccaaaaattgagcgggaatttactcgcgagatctctggacagcgcccgcaggcgagggccccagcagcacaccact

SEQ ID NO: 132 - DNA, 3019 bp, Giardia intestinalis
cacagctggacctgaggcgaaggagagcccgcgaggacccgatccacattatgaacgcaagatggtacctttgggtccccagagagcaagccgtgagtctctacttgggagaccactccgaagacgcttgccctctggcaggacacacacgctggctctgtggcctaccgtgcgagagcgccaagcaaccaaccgagcacctgagagaagcaaacgatgacagacacagagtgctgggcgacgacaagctgatccttccggcccacataccgaaccagacagagcctgccatgctcatccaccagggtgcgcgcatgatcgcgagcatcgagcaggccgggactggggtcgcgctccccgcaatcaggggcctagacgccctggtgggaagctgccagagggcccctctgccagacaacaccacggagcagtcccagagcaaggcagacccagaccccgagaaggcgaggcgccggatagcaaacagggtgaacaacgcgctgagcttcggagcagttgccaaggccctccgcgcccttgatgagacacccacgatagacaagccagagaaggccaaggccgccctcagcgcgctacacccgtgcgtcctccccgaaggctacgttggccttgactaccctccatcgatgagctcgacggggctggagccggcaaccgaggaggaaatgaggaaggccctgtttgggactctcaacaagaaggcctcaggcgtgtctggcctcgggccggtccagctcaaggcgatgaagcagaacgacagcttcgtgaaatacctcacgcaggcgtacaacgagctgaccacccaccccgaggcgatgtccgacgtgatggccatgttcgagttccgggcgatcctcatcccgaaagagtccgacggataccgtccgatcgcgataggcaagacggtgacaaacatcttccaccgcgtcctgctgaagcggctgatcaggcatgccaactacctctcatgcgaacagatcgccttcaagcagaacgcatacgcggtaggcgtgaggagggcccacgagctcatcagcaggccggggatgcacgccgtctccctcgacacaaagaacgccttcaactcgctcccgagggcagaggtcgtcagagccctgaacgaggcgggcgtcccgaaggtcctggtcgactacatcaggaacttcctcgacctgaggcacagccgggacgtgaagtgcgaggtctgcggcgtcccccagggcgacccgctcagcacgttcctcttctgcatggccatcgagcgcctcctgagacgcctcaaggagaggggcatcaccttccttgcctatgcggacgacatcgtggcgttccacgacgaagggtacccagcaggcgtgataacacagcaggccacagcagaggctgccgccatgggcctgacgatcaggagcgacaaatgcaagtccaccatggcgggcgaggaggtgaccttcctcaaccacccggtgtcccccactcctgccagtctcgcgccaaaggccatcgcaggtgccgagactgccctgaggaagattgagaatgcccccataaccatccaccagaagctcatcctgctgtcactctgtgtggtcccgatggtgaactacgcccccctggtcgagataacatcggacaaggcggactacgaggagctcgacagacgtcgcacaaggcttcagcaaactaaccaacagaagctgcgatcgcctggtcgacttcctggcgtacccgaagagaagggcggcctgggcctgctcatgccggggctctaccacgacgagctgcggagggcatgggcctccctggacgtcaacaaggggaccagagacccggtggagctgtcggtgggcggccaggcactgcaggggaaggggacctacttcaaccgcctcctcacgcgcacacaccagcttccggacagagcggcggcgtactgtctgcagatgtgcggcgtgctgaccgaggaggaaagggccctgaaggagaagggcggctcgatcatggcgcagacaagaggcacctgcccgggctgccacacggcaaggaccctcgaccacgacatgaactgcccgaaagcggcgtggaccaggaccacgaggcacgacatgatcgtcgcgtgcctgtacctccgcgtctcggggaagttcaacgcagagctggaggtcaagacccacagccacctcagcgaccagaaccagaagcccgacatctggctcgtcgacaagtgcaaggcgatagatgtgggtgtcatccagccccgccagatggatgcctactacaacgagaaggtcaagaagtacagggacgggacgctcccgatcatctatgggacagacggatccctccaccccaagtccaagaggcacctcgaggagctccacgtggacgtcgagaagctctccgtccgggctgccttcgccatcgcccacatggctgcagaggcgaacgagcacctgacgaagctgatcagacgggccgggccgaaagcctggtcacccagagcgaccgtctcctgtcatcctacttctgacaaccgaatgaatccatccctgggacccgacgacaacgatcgagagggggcgcaagactggacacacaaccgagttgaatcccaaccaggagagaaagccccgttagctgctgctgatctgtatggacagtattgagaatgacaacaaagaccagagcttcactcaccgtgaagggagaacaaggagaggcaccctagtagaccagcgagcctgcaggacggcttgatctccaaaaggacctatgtgcacacctagaccgagcacacacccgcagaacagccgaggaacgcagatagctcctcccttccaccactgtggtccttatattgatacacgaccaaccctcgtctccggacatcgccaaaaattgagcgggaatttactcgcgagatttgcggacagcgcccgcaggcgagggccccagcagcacaccactggaagcaaccggtgggtggagtaaatcatca

SEQ ID NO: 133 - DNA, 5470 bp, Giardia intestinalis
ccatgcgttccgccctttccgcgccttcgggaaccacggagatcggggcttcctcaggcccagagcctcccaaccacgctccaaccgactcccacaggcccctacctaggggcactcccgatcctatgacgctgggtgacggcaacgatgcctcgacgaccgccatggcccggccttcctcttgcgagcccctctgcggctcccacgggcccccatccccccagcctgggcctggcaacagccgttccgccacggacaactctcccaatgagtcttctcctgtccatggcttacagggctccggggcctcggtggcccgggacgcctctcctccctgcctgtcgaacgaccttctgccctgtggccaggagcccctcccgattcccgacgacggcctcccatacgacctgggccacgacaactccccgtccatcacggacgagcaggaggcccggggcgcagacctgcctgctcctgggggccgtacgactgtctgcgagcgctgcggagaggtgctgcctgactctgcggcgatcgatgtccacatcgggatgcaccatccgcctcccggttcaccttctccgtcgcgcagcccttctccgctgtcggggtctgcccctccacctgcagccgccgagccctctccctcgccaacgccggaccctgtgttcccgtatgcatgcagcatgtgccgggcccgatacaaaacggagagggggctgaaggcccatatcgccaggctcggccactacctcccgctcgacgccacagtccccgagcgcatcggggtgcctagtggcagcccgtcccctgagctgcttcgcctcctcactgacgtattcacagagatggcggggcgccttcctcctgtagaggccctagcgcgcttcctctcgacgtgccgccgcatggagggctctggacggctccccccggcgcagtcgcttctccggaaggggctgctcggccgggcatggcaggcgctgttgagcgagacgtcctctgccgccagggtccccgagccccagggcaaggagcgggaagcgattgtccatgagctccacccgcgccccatgcctgtctctctgccccccgtccatcacgtgctcggcccgtcgcccaagataacggccaaggcgctgctgaaggagctgcaggcgatgaggcctgtcgcggccggaccctctgggctggggaagcctcacctcctgcacctttgtggggccgccggggctgcggagctcttcacctctgtcctgacgaccctcttctccagcaggaactgggcccagctccagcccctgtgcgagttcaggctgaagcttctgcccaagtctggcggccgatggcgccctatcgcagtgcaggagacgcttctggtcgccttccaccgcttgctcctgcgtcggactcccgcgctccgcaagctcccggcgtggcagctggcctttgagcacctcgcccagatgaaggcgatccgcgcggccgaggagctgaagaggacacaccacctgctcacggtggatgtgcggaatgccttcaacagcgtcccgcattccgtcatcctctttgcgctccgccgggcaggggtggtccagccgaccgtcgcgtacattgagtcgttcctcgcggctcggcactcctcggacctccccgcggtcccagcgggcgtgccacagggggacccgctgtccatggcgatgttctgccagagccttgtctggccggtggagacgtacctcggccagtacaaggtcgttgcatacgccgacgacctcgtcattgcgtcagaggaggcgattcccatagataccgtgaagagtgacgcgcagtctgccctctcccgcatagggctcacggtcgagctctcgaagtgctcctcgacccaggccggggcgatctccttcatgggcacccgcgtgctcaagcactcctccttcaacctcgcgcagacatcggcccgccggctccacgagcatctcgccgtcctccgtgcttcgggtctctcactccacgaccgcctcaggctcctgtctgcctgcgtcgtccctgcagttaactatggaccccttgttgacgactacccgggcccgtccccctatgccgacgtcgatgcgcagatagtggaggaggtcgcgacccttctggagatccccgaaccccttgcgaagacccttgctctgacgccccgcgcgaagtacggcctcggactggtgctgccccatcactactacgacgagatgcacaggcagcgccaggacatgaaggcgggcgtcttccgcgagctgaggaagaagcgcctgcaggacacggccgcgctccgatccttcctgccgctcgcattgctgggctgcgcacccctggacaacacgcaggtcctgttcataggggactgcttggcggggaggtaccagcggggccggccgatgggcacgtgctgccactgcaagcagcccttccttcccaggcaccatctggtgtgcaaggccattaacgggattcacgtggcgcggcacgacaagattctggacgccctgctcgcgtgctcccgcggtcgcgctgggtctgttgtgcgcaatcccacgatcccagtggatcacctccagcctgaccttgtcatcggtgggggcttcggggacttggtggtcactgtcccgtggaggctggagcggtcctatgccctgaaggccgccaagtatcgccccctcgtgctccaggggcgggcggcccacatcctccccgtcgtggtcggtgctgacggcgtcctgcaccacctgtctgcggccggactcgcgttcgccggcgtggaccttgcgcgcttcatgcaggaggcggcgcaggtcatcctctggcactacaggctgtcggccctcctgtacgctgggctgcgagtggagaggccggtgcaccgccccgcccctgcagtatccctgccggaaccggctcccaacgaggctcgggctactcctcctactcccctcacccctgccatgtggagccctggcacgtcgccctccgtagagatcatggccgatctcagccagcatcctgatgcggcagtccctcctccctggggtcctgctgaggtctcctcctcgatcacctggggcaccgatcaccccgcacagccggatgcaaacgaacgcccagaccccttcatgtgctcaagggccccctccccgcctccactggatgacgacagccccgacgatgcaggagcacccgagccggtgcacaaggccctgccgtccttcttcaagcgcgtcggtcctcccaagccgcatgcccctgatggcttctaccccttcaaacgcatcgacacggggcgctagtggtcatgcttgggcaccctgcccgctgtcggctgccccacagcgcgaacggacccctgggcctgcgtgccgagctgtctcccctggtactcctcgctcgcacccgaggcctcttgcccctatcattcgggtgtgcatcacgtccagacacggtgcgatagatgcctagccgcgatgccatacacactcgaccaggccgggccaggccggacgcccccctggatggccagacacccgccctgcctacgtttgggcacttcctcgatgggactcgtcatctgcccacgccgcagcccggtgttcgtctgtctgtcctcccgggcagcggcggtccttgggtgctgagtctggcgagctggtgctgggggaagaggctagccccgtgtgtcattcgtaccatcgcaccgcgccgtgctgatccccccatggaactgcccgccagtggccgcctccggtccggggcggcacagccctggctcgggccatcctctgctgcagcgccccggtgccccctggagaggatggccgggtgctatgtgctactgagccctcgggtgcatcgcttccccactgccccccctcatgtacccactctgggcgccccggtacagggaacctggtcactctggccctggcctccaggtgcttgccctccaatgggccatccctcatgcgcctgtgtttgcctggcccattctcccctgctcctctctacctctcctgctcggtctccgctgagtcgcggtgacggctgttgacagtcccggccgggcccccaggtttcgctccatacctgggccacatgcctcccaccagcgctggcaccacatgggttgcttgtcacagatgggactggcacgcacagaagaatatggctccacggcgctctgccggtctgtcctgagctggcgtcatcagcctggacccgcccttagggggcctcctccatcacccgtgcctccccacaccacctcctaagccgtcagtctgctctctcaggcgtgaccttctgtcggcctcctgggccgtatgggaccaccgccccgctgcccccgccatcttggccagacgcctccggtgagccaccattctggaatagcacgacacgtgtggatgggctagctatggcgcacggtccgcaccctcccttctcacggactcccggggacagtccggacgcgtctcccttgtcccccgaatcggtggccccggccgatccccatcgtgcatccttatatggggcactgcacacacctgtccacgctgtccccttgggccggccacagctcaccccgtgtgtcgatgggccagaatttgggctccccaaacccctccacccccaagctgtttcctcgccggttctctgggctcgcgcttccctttttagtgcaacagcattatggtgcctcgcgtatgtgcgcggtgcagtgggccggtctgtaggcctgcctttgactggaatcctggatccctgggtttctggcccgacgcgtcgtcttctaccccccaaacaggcctgcactcttcttggtccacgggctatttgtctctttgtttccgcggcccagggcctgctggttgcgccggggcgacgctcatggtggattttattttttccaaaatccagaatttgggcctgaagaccgcccccgcagggcctggaggatgcggggaatcggtccacccacaccatgcgctcgagcaaaggccaagcacccacgccatcacgtctcatccaggactcctgcgccgccacggaggaggatcggcaccttcgccatcgatcctccaggatgcccccctaccactccccctcacatggcacgcctccctcgggcctgtatgtctgcatgccgctatgccctaacaccgcaggccgccctctccgcggatccactaacacacagcctgcagcgcctggcccccctggccgtgacccgcgcgcccccgcgcacaggagcatacccctggagctggggagaaggcccccctggccgcgcccccgccgcgagaccacgcgggcacgggggctgggcgccccgggcgggcccttcccctccgtcgtgaggctgcctcccctccaatgtccttaccgccttgcgcgcatattacgtagtaaaccgcctctgtaaaaaaaa

SEQ ID NO: 134 - DNA, 2853 bp, Danio rerio
acacctgctgccggccgctcgcctgttactcaaagctgccctcaagtgacagcagctcataacagtccacaaagcccccaaagtcagcaagtggcagttacaagatctgactgtgttcccttggctcagccaagaaaccagtggccccaatcctcaaagaaagctgagtggctctagttcgacaaggacgagaaccagatcctggaagtgacaggcaagggggtgtggaccagcgactgtcaacaatgaccaagctcatagtgaacattgcagctgagcgattcggaactgtgatacccaaacccactccatcgacatatacaccaagccacagagtaaaggaaatcaaacgtctcaggaaagaacttaagctactaaagaggcagtacaaggcagcaggggaagtagaaagagcgggcctagaagatctgagaggaatcctgaggaaacagctcgtgaacctatgtagggcagagtatcacaggaaaaggcggagagagagagcaaggaaaagggcagcatttttggccaaccctttcaagttgaccaagcagctccttggccaaaagaggactggcaaactcacctgctccaaggaggctatcaacaatcacctcaaggccacttattctgacccgtataaagaacaacccctggggccttgcggtgcactgctgacaccacctgagcccacatcagagttcaacatgaaggaaccctgccggagtgaagtagaggaagtggtgaggagagcaaggtcaagctcagcaccaggcccaagcggagtgccttacaaggtatataagaactgcccaaagcttctacacaggctctggaaggccctgaaagtcatatggagaagagggaagattgcccagccatggaggtatgcggagggagtgtacatcccaaaagaggagaagtcggagaacatcgaccagtttcgagtcatctccttgctctgtgtggagagcaaaatattcttcagcattgtggccaaaagactctccaacttcctattaagcaataaatacatcgacacgtctatgcagaagggaggcataccaggagtcccaggctgcctagaacacacaggcgtggtaactcagctcattagggaggcaagagaaggcaggggggacctggctgtgttgtggttggatctcaccaatgcctatggctcaataccccacaagctggtggaggtcgcactggagaaacatcatgtaccccagaaggtgaaagacatcatcatcgactattacagcaagttcagcttgagagtctcctctggccagttaacatcagattggcaccagcttgaggtaggaaaggcctttaactgtagcttcaatgacagtgactccatcagggaaaccagcactaacatgaagggttggttgaaagcagtggataaatcagggctccctggaatatttaaggcttgggtttaccaacatggaatcctcctaagactcctttggcccttgctaatctatgaggtccccatgactgtggttgaaggttttgagctaaaggtgagctgctatctacgcagatggctgggattgccacgcagcctaagtaacatcggtctgtatgggaacaccaacaagctcaaacttccttttggctcagtcagggaggagctcattgtggcacgaacacgtgaacatctgaaagtgtccagggcagagactgtcgtcaggaaagggagaaagtggagggcagcagaggcagtcaaacaagcggcaacccggctaaagcacaaggccatcctgggggcagtagcacaaggaagtgctagacttgggagcctagcagcaacccgatacgacttggccagcaggagggagaggcagaggctggtgcaggaggaggtgtgtgcttcagttgaagagaagagaagcagcagagcaatggccatgccgcaacaaggtgcctggatgaagggtaagcaggcgatggagtggaatgtcaaggaaggacatctggacattcaaccccctgagaatcaggttcttgatccaaggggtctacgacgttcttcccagaccctcaaacctgtacatgtgggcagagtggatacacctacatgcccactgtgttccaagccagggacacatagcttgagcagctgctccaaggcactaggtgaaggtcagtatcgatggagacatggtcaggtccttaaatccatagctgaggcaattagcaaggggatcaaggacagccggttacgccaagccacagccaaggtcattcatttcatcaaggaaggacaaaggccagagagaacagcaaagctcttttctgctgggttgctctccatgacccgagactgggtgatgtcagttgatctagagaggcagctaaagattccaccacacgtcacccagtctacgttgagacctgacataatcttggtctctgaggccacaaggcaattaaccctgctggagctaacggtgccctgggaggagaggatggaggaggctcaggagaggaagaggggaaaataccaagagctagtggagcaatgtcggatgaatggatggaggatcaggtgcatgccagtggaagtgggcagtagaggaattgccagcaacaccctaagcaaggcctatggtacacttggaataacaggcaccaaacgaagaaaaggcagcggagaaagcatccagatggctctggttgaagaacggtgggggcagtagcatgccacttggacacaggccatggtctgatcagcctcggtcgggttgcctggaggagggtgtctgttgcaagacccgaaacaccctgtaagcccaggactgatgatgtccaaggttgtgcatcagaagatgtttc

SEQ ID NO: 135 - DNA, 3483 bp, Takifugu rubripes
gctacggaaagccctacagagaaacacccccaggagatcccgagagggggggagaatgagatccccaatcggacggacctaacgttaatgacccctgcaatggaaacgactacgacagtgacatgtatctgcagcaaggtgtgcaagaaccagcgtggcttaaagatccatcaggccagaatgaaatgtctggagcgggaggttgaggtgcaacgcacaggtcctggacctggtgagacgcaggaggagcccggacaggaggcaacccacagatcccagtccctccacgtaccggagcctcccaaccctaacagagtagttcaacagcagcggattaagtggcccccagcaaatagacggagtgagtggctgcagtttgatgaggatgtgtccaacatcatccaagccacagccaaaggagatgtcgacagcagactccaggcgatgagtaccatcatcgttagctatggctcagaaagatttggacggatcgagaagggcaacactgagaccacctcttacaccatgaaccgcaggtcctttaagatacaccaactgcgcaaggagctgcgaaccctcaagaaacagttcaagagagcttctgatggggacaagcaagctttaaaagagctgtataacatcctgcggaagaagttgaaaactctccgcagagcagagtggcacaggaggcgcgggagagagagagctaggaagcgagcagccttcattgccaatcccttccggttttctaaacagctgctcggggacaagcggagtggccgacttgagtgctcaagggaggaagtggatcgcttcctccaaaacaccatgagtgacccactaaggggtcaagacctaggacccaacagagcgctcatcagccctgccccaccatcagcagagttcaagctggcagagcctagtttgaaagaggtcaaagaagcagtgatggcggcaagatcaagctcctccccaggccccagcggagtcccatacagagtctacaagcagtgccccaaactccttgtgcgattctggaagatcatgaaggtgatctggcgcaggggaagggtcaccactcaatggcggtctgcagaaggagtctggattccaaaagaggaggatgcaagtaagatcgagcagttccgaattatctcgctgctatgtgtcgaagggaaaatcttcttcaagatagtgtcccaacggcttacagatttcctcttgaagaataactacatcgacacttcagtgcagacgggtgggatccctggagtcccaggctgtctagagcacaatggtgtagtcacacagctcatcagagaggcccatgagagcaaaggagaactagcggttttgtggttggacctgactaacgcctacgggtccatcccacacaagctagttgagattgcgctacacctacaccatgttcccagtaagatcaaggacctgattctggattactatgatgacttcaggctcagggtaacaacaggatcattaacatccacctggcaatgcctggagaagggtattataacaggctgcactatttcggtgccactcttctccttggccatgaacataatcgttaagtcggctgaggtggaatgtagaggtcccttgtcaagatctggcactcggcagccccccataagagcgtttatggacgacctcacagtgatgacaacctctgttcccggctgcagatggctactccaggggctagagcggctcatctcttgggcgaggatgagcttcaagcccgccaagtcctggtctctggtcctgaggaaaggcaaggtggccgaccggttctgctttgccttaggagagacaccaattccaatggtgacagaaaaacctgtcaagatcctgggcaaggtcttcaacagttccttgagggactcagatgcactcctgcaagccaaagcagatttgacatcatggctcacagcaatagacaagtcggggctaccagggaaattcaaaacctggatttaccaacacggggtcctgccaagactcctttggcccctgcttgtctacaaggtgcccatgtctacggtggagacgctgaaacaaaacatcagccagtttctccgcaggtggcttgggttccctcaatcccttagcagcattgctctgtatggccattccaccatgctgcagcttccaatcagcggcctgtcagaggagtttatggtcacacatgccagggagcaggtgatgtactgggactcctctgacacgaaggttgctacagcaggaatcctggtgaaaacggggaggaagtgggaggcacagaaagccgttgacagagcagaggcacggctggaggctcggctgcagcataacatcctggtgggcaatacggcagggggccgggcgggacttggcagcttccccataccccgctacgacaaagccagagggagggagaagcggagtatggttcaggatgagatcagagcagaggtggaggaagatcggaggttcaagatggtggctatgtaccaacaaggcgcctggacaaggtgggagcacgccgaacagcgaaaactcacctggccagagctctggagactcaaacctcagcacatcaagttcctcatccagtcagtatacgacgttctcccaagcccaaccaatctgcagcgctggggcttagcagccactgcggcatgccagctgtgcaaaaagagagccacccatgaacacatcctcagttgctgcccgaaggcctcgggggacggacggtatcgctggtgtcacgaccaggtgcttaggactctggcagacacagtcagcgcagcaatcaacaactgcaagtaccagaacactcccaagcagtccatcaccttcgtcagagctggggagaaggcacaacaacagccaagttcctttggagggcttctcaccacggcacggcactggaaactgcaagtcgacttgggaagacagctcaatttcccagagcacatctcggccacttcactctgcccagatatggtgctaacatcagagtcaatgaagcaagtggtcctggttgagcttactgtcccctgggaggacagattggaggaggccaacgagcgcaagagggccaaatatgccaatctggtaatcgagtgccagaacaacggctggaaagcccgctgcgaaccagtcgaggtggggtgccggggttttgctggccaatcactaccccgcaccctaaaactccttggagtaaaaggccagctgtgcagaagagccatcaaaaccatcgtagaggctgcggagaaagcctcaagatggctatggatccggaggggggatccgtggagtagtgggccactgggacgcaagtcgggagctgatcgccctcggctgggtcgcccgagcgagtgtgtttgatgatcaaagacctgaaacaccctatgacctcgggttcatcactgatgatgcgtccaagtagcacgtagaggtgtattcaataac

SEQ ID NO: 136 - DNA, 3741 bp, Tetraodon nigroviridis
attggtctggctaagccagtgacgtccaggaacagactggctgacgaccacgaatagagtggtgacagcktggatagacagctgacagcsgggaaagacggcaaccggggctgggagcggctagccacccagcctgcmtcttccgtgagggagaacccaaaacttgctacgaagagcccgaagccaagatacccccaggggagcccgagagggggggagaatgagctccccaaacggacggataacatggcaacgacccaggctagcgttaaaccgacagcggttgccacatgtgtgtgtggcaaaatctgccaaaacccacgaggtctgaagatccaccagaccaagatggggtgcttggcaagtgtgctaccagagcagcgcgchaggttcagcctcagcgagtcgcgggaggtgccagchagggccgagccctatggccctcagcaaccgcattctcctgaggcccttggtgagacgcaggaggagcggggccaggagtaaccccacagtgcccagaacctccgtgctcaggtagcacaagcgccagaaaacccacaamaccaccggcgggttaagtggcccccagccagccaagtgagcsagtagcagccgcctgatgaggatttggaaggtattctggagtccaccgcaaaaggtggagtagacagaaaactccaaacaatgaccacgctggtcatcagctttgccaccgagagatatggtacaatggagaaacgcgctgctccagagaagtacaccaaaaaccgcagggcagaaaagatctcccaactgcggcaggaacttcgggtcctgaaaaagcagttcaagggcgccagcgaggatcagaagccaggattggcagagcttcgttgcacccttaggaaaaaactgcttacccttcgccgagcagagtggcaccggagacgggccaaggaaagagccaagaaacgcgctgcatttttagccaacccttttgggttcactaaacaacttttaggccagaagcgtagcggccacttggaatgtgcaaaagaggaggttgattcctacctccacgacacattcagtgacgcagaacgggagaacagcctaggcgaatgtagagtgctgatcagtccacctgagccagcctgcagtttcaacaccaaggctccaacttggaaagaaatccaaactgtggtcagggctgcaagaaacaactcagctcctggacccaatggagtcccatatctggtgtacaaaagatgccccaaactcctagcccggctctggaagatcctaagggtgatctggagaaggggraaggtcgcccatcaatggagatgggcggaaggggtgtgggtyccgaaggaggagaagtcaaccttgatagagcagtttaggaccatctcactgctcaatgtcgaggggaagatattctttagtatcctctcccatcgcctatcagacttcctccttaagaaccagtacatcgactcctcggtgcaaaagggggggatccctggggtaccagggtgtttagaacactgtggcgtggtgacacaactaattagggaggcgcgcgaagggagaggtagcctggccgtactttggctggacttagcaaacgcttatggcgccataccccacaagctggtggaaatggcattagcgaggcaccacgtcccatgttcgatcaagactctgatcatggactattatgacagctttcatctgagatttgtcacgtcaggcagtgtcacatctgaatggcaccgactagagaaagggatcatcactggatgcaccatctcagtgataatattcgccctggccatgaatatgctggccaagtcggctgagccagagtgcagaggacccataaccaagtcaggcattcgccagccccccatcagagcattcatggatgatctgacagtaacaacaacgtcagttccagggtgccgttggatcctccagggcctggagaggcttatgacttgggcccgtatgcgctttaaacctggaaaatctaggtccttagtcctgaaggcagggaaggtgaccgaccgcttccgcttctacctgggaggcacccagattccatcagtctctgagaaaccggtgaaaagcctaggtaaaatgttcgacggctccttaaagtatgctttttctatcagggaaaccaatgatcagctggggcactggctgacgttggtcgataagtcaggtcttccggggaaattcaaggcatgggtataccagcatggtatcctacctaggatactgtggccactgctggtgtatgaatttccaatttccaccgtggaagggcttgagaggagggtcagcagctgcctcaggcgttggctgggactacctaggagtctgagcagcaatgccctctacggtaacaacaacaagctgacactccccttcagcagcctggcagaggaattcatggttaccagagctagggaagttctccagtacagggagtccaaggatcccaaggtagctcttgccggcattgaggtgcggactggcagaaggtggagggctcaggaggcagtggaccaggcagaatctcggctgcaccacaaagagcttgtgggagccgtggcgactggccgtgcaggcctgggaacaacaccgaccacccacctcagcaggctcaagggcaaggaaaggcgggatcaggtccaactagaagtgagggccagtattgaggaacagcgagctagtcagtgggtggggctgaggcagcaaggcgcttggactaggtgggaagaggccatggccagaaagatctcatggcctgagctgtggagggctgagcccttgcgcatccgcttccttattcagtcagtttatgacgtcttgcccagcccatcaaacctcttcctgtggggcaaggtggaatccccatcatgtcccttgtgccagggaaggggcaccttggagcacatcctcagcagctgtcccaaagcacttggagaggggtgctatcgctggcgtcacgaccaggtgctgaaggcaatcgctgagtctatcagctccgccatggagtacagcaagcgcctacccttaccgggacgcggagttaggtttgtcagggccggtgaacaacctcctccccaaccaagggcccaaccaggcctccttgcaacagctagggactggcaactaagggttgacctggggaaacaattaaagttcccggaaaacatcgtagaaaccaacctgaggccagacattgttctgcactcacagtcgtccaagcaagttattttgctggagctgactgtgccctgggaggagagaatggaggaagcgtatgaaaggaaggcagggaagtacgctgagctggtggaggattgccgcagagcagggtggcgcagtagatgcctgcctatagaggttgggggtaggggctttgcagggaagtcactctgcaaggcctttagcctcctgggcatcacaggcatgcgcaggaggaaagccatctgcgcggcctcagaggctgcagagagggcgtccagatggctgtggatccagcgggacaagccgtggacgagcgcttcttggacacaggccgggaactgatcactcccagtcgggtcgcctgggtgagggggtctgatgttgaaagacccgaaacccccgatgaccccaggtactaacactgacgatgtgtccaagacatgcatcaataggtgtatttagaaatcattgtgtttttttggggttttttttttt

SEQ ID NO: 137 - DNA, 1253 bp, Daphnia pulex
cccaccagcaagatctgagattgccaggaaactcaaaagagcctcaaacacggccccaggagcggacggagtcgagtacaaggacatctcccgtctggatccggaatgtcgcctgctggaggttctttatgccgcagtgtggcgccttggtgtaccgaagtgctggaaatcggcccgaacaatcccgatctacaagaaagggtcgactgaagactacagcaacttccggcccatctcactcctctcaacgctgtataagctcttctccggatgcattgcctcccggatcaccacagtggccagcgacaacaagtggctttcaccagagcagaaaggtttcctcccgggggtgcacggaatacaggagcacacaatgctgctcgagagtgccatagaggaggccaagtcccagaaaagaaacttaacaatctgctggctggacttggccaatgctttcggatcacttcctcacgactacctcaaccaactcttctgcagtcttccagtccctccggccttaaggagcatcctgaccgacatctaccaacataacgagttccatttcgttgtcggcaaggagctggtgatggtgagaccgacatccggagtccgccaaggcgatgggcttagctccataatttttaatcttgcagcggagcctctagtccgccgggccaaggcgaactcccatgggtttcagctcttcaatacttgcctgaaatccacgtcctatgctgacgacatctctgcggccgactccgacactaccagcctccaatcgactatcgatggaatgaattcgacagcctcaattcttggtctccgcttcaatgccaacaagtgctcttctctcaccattaccaacggtagagccagcacgtccacgaagctctccatcaacggtgtccagattcgggcactggatgtaggggagtatgaaaattaccttggcgtccctatgggcactaagctcaccttcagaccagccacagacctccgtgagaagctagtcaagattgcggactccttgctggctccttggcagaagctggaggtatttcgtgcgcacctcctgccgtctctctcgcatcacctagcgaccggccgcgtacagaggggcttccttgacgagcttgacactcgatgtgcggaattcctccgccaagtggcatacgtgccacacacagcccacactgcattcttgtttgcggaccggagggctggggggcttggcgcttctcagcttaaaaaag

SEQ ID NO: 138 - DNA, 3123 bp, Caenorhabditis briggsae
tgttgagagcccaaaccccagaccccttcccaaagcccctgcacagggagccgctccctcctcttctgcataggaaatttgccaccggacccgctcgggcatctaccatcatgataccacatgcatgtctcaacgtctgtttaaaagtataaatgtccattcaaatgttattgtctgtctaaccgtggcacctcgtcccgtctccgatatctccccgtgtcatatcgccgccccagttttgtccccctttcccttgaaacccctccctaaaacgaaccctttacctgcttcctcagtcaaatcagctgtgataaatctctcctgcaaactctccaatgtaagatctatagcatctgcagaacgcctccaagtacttcactctgacatgctagacaaccagatcgaccttcattttgttactgaatcctttctctccccatccgtccctgactctctctcctcatcttcgacccttcattgtcttcgcttcgacagacggtcccctaaccctaaaggcaagggaggtggcgtcgcggtattcgcccgcaaagacatacagctggtagaggctgatagtctcagctcccagttttaccccctacaccactgcgaaattatcactgtcgatctgcttcagataagttgccgattcgtcttagtatactgtcctccgtccacctcaccagcccaatccgatgtactttttcacaatctatctttactgctcagcaacagttatcgcttcaatttccttctcggtgatttcaattacccgcagataaactggtcttctgataaccttctgcctaatgatttgcctgctggcctggaaagcctgatgtcactatccgatctgactcagatagtagacttcccaaccagaaccagtcattgcggtgctgaaaacttcttagacctagtattttgtaacaagccgcaacacatctcgaaaaccgtgaatcttccacccttcctgctctccgaccattcctctgtcctcttcgaaacaatcctacctagtatttctcctccttcacccatcctcaacactacctcgtcaaaacgtctagactatacaaaatgtgacgtcaagcgtcttttggatcatctctgctcttacaactggcccaggcagctatctttcttctccacggttgattcgaaacttgctcatttctccgccattttcaacgaactcgtagtcctctacactccaaccgtccgtgctcgtcgtccaaccttctcgcatagaaaacccaaggttttcaggttcatccaacgtcgcaacccgtccctccctagaccccagctcaaactgcttgttcggcgacagctcaatcgagttaagagggcgcgtgcaagggaggagctttctattatcaacaacaagaaccccaaagaactcttccatttcgttaaatctagactccgtcccccgcactgtcccatttctctcctggttaatggcaccttatcctcagacgcttctgaactagccaacgaattttcttccgtcttccaagaggccttctcgcccccaagacctcctttctccgccctccctgctatcgctccctttgccgtctgtcctgatttttctcctataaatattgcaaagcacatcggttctctaccctcaaaagtcggtttctccccggattttatcaacttccttgtaatcaaaaagtgcagtgatgcgataaccatccctctttcgctcatcttccaagaatccttctcctccgccaaatttcctgagatctggaagcactcggttgttagcccaatattcaagaagggatccaaatatgacgctaataactacagacccataacgctcactcatgcactttccagactcttcgaaagattaatccttgaagagctaaagcgtgttatcggtccgagaatttctccgaatcagtacggattcgtcagtaagcgatcctgtgttctagccgtccttgagtccacttccagaatacagaaaaccttagcaaataagcaacaattcgtagatgttatttactttgactttcgcaaggcattcgacactgtcccacacaatctcttgctgctgaaaatgaggcgtataggtattgatgaacgatgctgcgtttggttcgagtcctttctcagcaaccgctcatccaacgtcaaggttaatggcctaatgtcaaccagtgagattgttgtcaaatccggagtcccccaaggaagtgtcactggcccctttttgtttctgatctacattaacgacttactcggcctctttcctcccaatgtccatgtcacggcgttcgccgacgacctaaaaataaccggttccgacccattggatatgcagagaagtatcgaaatcgtcgagcactggtgtgacatctggagactcaaactagccgaaaataagacggccgttatgcattatggtaaacgcaatcctaagacagtttaccttattaagggatcccccattactccgcatcgctcattcaaggacctaggtatactagttgatgatcaacttcaattcgacaaacacatcaatcttattgcctactctgctaaactcaagtcccgccaaatactgaaaacgttccaatcgaaaaacccttttttatatttccgtctcttcgacacctacattagaccggtcctcgaatacggttgtgaacttttcgatccatccaatgccacacttgccaataaactagaatctccttttcgttatttcaccggaaaagtcatccagagatgtaatatgcccttcaattcatacaccgatcgcctatgccagttctctatgctaaccacccttcatcgccgcacccttctagttcttcgtacctatcacaaaattgctataaactcataccattttccctctatgtcgtcctacattcttcccagccattctaacagagccccgtatttgttcaaaatcaacggtcaatactttgactgcttccttcacagaaacttgtctatgtggaaccgtgtatgtaaggtgataaattctaagcagtccggtggcgtttgctaagcgagtaggagcgattccttatgatattctgatccctcccacttgacctacaggactcttgtcggtccgtctggtcattt

SEQ ID NO: 139 - DNA, 4394 bp, Schistosoma mansoni
  modified_base (137)..(137): a, c, g, or t
atctcacgttttaatttatttttgaactactgcagtctgagtgcttctaacgacccgaaggctcagaaactacccacttcttgaactgctactttttgctgtttatccacaacaacagttgtgattctattctccanatattccttgtgcttttgtcaacattattctataccaactgtaccacctacttcttcatctcacgttttaattctggtcttattttctcatcattagtcacggagagggcctatgaacggtccgtgacgcgaaattctatccgcgatttcgacctctcctgctagtggtccccgaagtacggttcctctggcctgtcagttgtgttaaaactatataataacgatgccggtctcaaccggcgcagaaactgacataacctcttctttgcctattcctgcatcctcaatcgtctcgccaaactacacactccctgattcctcttcaacctgccttatatgtttcgctatcttccccacccacaacatactcctctcccatgccactgcaatccaccatatttcttgtcctcctactccagtgcaagacggttctcagcagatgtcttgtgttctttgcgccgccgctttttcatctaacaggggactaacacaacacattcgccaccggcacatctccgaatataacgaactaatcagacaacgaattgcagtgcagccgacgtctcgcatatggtcaccattcgatgatgcttctttactatccatcgctaaccatgaagcccatagattccccacgaagaatgacctatgccaacatatcagcaccatactaacacgcaggacggcagaagccgtcaaacgccgactcctccacctacagtggtcgagatcaccaacagcgattactacctcttcgaataatcacacaatcacagacatccccaataccgaggcccgatatatttttccggtagacctagacgaacatccaccattgtctgatgccacaacccccaacgcatcgacacatccactcccagaactccttgtcatcttgacaccgcttccatccccgactagactacaaaacatatccgaatcacagacctcccatgaatctaataagaactcaatgcatacaccgccaacgtatgcctgcgatccggatgagacactaggggctactccctcatcaactattccctcatgcttccacagttatcaggaccccctagctgaacaaagaggcaaactcctgagggcatccgccagcctactacaaagcagttgtactcgcatacggtcctccagcctgctcgccttcctccaaaacgaatccacattaatggacgaggaacacgtgtccaccttcctcaatagtcatgcagaattcgtcttccctagaacatggaccccatcccgacccaaacacccctcccacgccccagctaatgtttctaggaagaaaaggaggaaaatagagtacgcacacatccagagactcttccaccaccgtcccaaagatgcctccaacaccgttctagacggtcggtggagaaacccctatgtcgcaaaccattcaatgattccagacttcgactgcttctggacaacagtctttactaaaacaaattccccagacagccgggagattactccaatcatccctatgactccctctctcattgacccgatcctcccctctgacgtcacatgggcgctgaaagaaatgcatggcacggccggtgggattgatcgtctgacatcgtacgatctgatgagattcgggaagaatggtcttgctggatatctcaacatgctactcgctcttgcataccttcccactaatctttcaacagcacgggtaactttcgtccccaagtcatcaagtcctgtgtcacctgaggacttccgtcccatcagtgtcgctccagtagccactaggtgcctgcacaaaattctagctaagagatggatgccgctctttccacaggaacgacttcagttcgctttcctaaaccgagatggatgctttgaagcagttaatcttctgcactcggtcatacggcacgtccacacccgccatacaggagcatccttcgccctgctcgacatatcacgggcctttgacactgtatcacatgactccatcatcagagcggcgaaaagatatggggcacctgaactgttatgccgctacctcaataactattaccgacgttcaaccagctgcgtcaaccgcactgaattgcatcctacgtgtggggtgaagcaaggagaccccctgtcgccactcctcttcatcatggttctcgacgaagtactggaaggtctagatccaatgacccacctaacagttgatggagagagcttgaactacatagcttatgctgacgatctcgtagttttcgctccaaatgcggaactccttcaacggaaactcgatcggatctccatacttctacacgaggctggatggtcggttaaccctgaaaaaagccggaccctggacctaatctctggtggccattccaaaatcacagcgctctctcagacagaattcaccatcgcggggatgcgtataccaccgctttctgccgccgacaccttcgactacctgggtatcaaattcaacttcaagggccgatgcccagtggcccatattgacttattgaacaactacctcacggaaatatcgtgcgctccacttaagccgcagcagcgcatgaagatcttgaaagataatctactccctcgactcctataccccctgactctaggaatagtacacctgaaaaccctgaagtcaatggaccgaaatatccacacggccataaggaaatggttgcggctaccctccgacaccccgctagcatattttcactcacccgtcgctgccggaggcctagggatcctccatctgtcctcatcggttccattccaccgtcgaaaacgtctagaaaccctcctatcttcaccgaaccgcctactgcacaagttgccaacttccccaacactagcttcttattcacaccttagtcaactgccagttcgaattgggcacgagaccgtaacgtctagagaagaggcttccaacagctgggtgagacgattacattcgtcctgcgacgggaagggactactcctagcaccactaagcaccgagtcccatgcatggctgcgctacccccagtctatttttccatctgtttacatcaacgccgttaaattacgaggtggcttactatccaccaaagtcaggagatctcgcggaggtagagtgacgaatggcctgaactgtcgaggcggttgcgcccatcatgaaacgatccaccacattctgcaacattgcgcgctcacccacgacatcagatgcaaacgccataacgaactatgcaaccttgtggcaaagaaactgcgtaggcaaaaaatccatttcttacaggagccctgcattcctctagaaaaaacctactgcaaacctgattttataattatacgtgactcaattgcttatgttctagacgtcactgtatcggacgacggaaacacccacgccagccgcctgttaaaaatatcaaaatacggcaatgagcgaaccgtcgcgtcgatcaagcgtttcctcacatccagtggatatatcattaccagtgttcgacaaacaccagtcgtccttacattcagaggtattctggatagagcaagttcacaatccctacgacgcctatgtttttcatcccgtgacctcggtgacctttgcctgagtgcgattcaaggctcaattaaaatatataatacctatatgagaggaacctaacggctgaacgaatagcccccttcactcttagacattcccccactgttgttgcttatcttcatgctcttgtgttaattgactgctctcttctgggttgacgtctgattgtctctctctctttccatattgcttgctctgcccgcttacttccaatagttgtcatattatgtctttgtttacttgccatgtctaacgacaattactttatctaccttagtttgtcctcttggtttcgattgccttcatatgttcatggcggaatctgatgtttataatgactattcctattaccaccactacaactactattattattttcattactattaacattattataaacattattactattattattattactattattacttctacaattaatattatggctactcctctcagcacaccaataaaatatcaatcaaacatctcaattatatccacctattaaactctctctatttcccctgagttataaacttacaattcagtctaaccgaatatctctcttttacaaatcttaagtatgtaattttgtgccaaacccatttgggtctgtacaatttgatacttaaaaataaatgttattagcc

SEQ ID NO: 140 - DNA, 4495 bp, Limulus polyphemus
tgggaggagacccaaactatcctaggatggggcggaaccgaccatatgagccatattaacattgcccacactatcctctggaggtacctcctcgtggtacggctggatataggtaaatcctgtaaccaaatcctccaacccgtgaaggagaacactaaaacccatatagtggcctcgccaaccactatatgtccaacggcaggagaagctatctcccggatgggaaggaaaaccctaaaccgtgatgggaacttaccggccccatcagctattgggtacccggtagggacttgcaaccctaccctgtatttgcattttatagggaaccggtcggccctatatcagagtagaccgtttattaaatatgggtgaaaatattaacagtaaaagctatggtttggcgtccgtgtggtgccagggcggcggccaaacccgagctacttggcaccaactggggatggtagcttccgagcgattccctggcgacgtgggaccgatcgacgatggagtccaaacatccggaatagaggaattgagaaatacctattccaccaccggctcacatacccaaggtgaacccggtgcaactagagtacaacctatctgtggcggtaggtgccgaaccactcaggtgacgggcttgtttattgatgtctccctacgagacacgaattgtgacaaatccactccggtggacaattacccgatctatgaacctgttaccgatattagacaagaaaataaagaactgacaacgcctagagcttcaggcagcatgtctgtaagtatccagtcatcgagcgtgactgagggcgaaattgataataactctgaaactgaggaattgacggatatatgtttggctacgctagagcttcaggcagcacgtctgtaagcatccagtcatcgagcatgactgagggcgaaactaacgaaagggccacgcctagagcttcagacagctcgtctgtaagcatccagtcatcgtgcgtgactgagggtgaatgtctacctcctacagacaactgcaacccgtctgtagagaaccagttaccgtgcgtaactgagggtaggtttgaacgggtaggctcactggtgacggtgcgtctgcccttcagaaaggtggcatgtgacttgtgttctaaagagttcttgacatattcgaagtttgcagtccaccaggcaaacttccacaattcagaaactcaggcatgctgcacatattgcggtaaaagtgatggcaatcatcactctatagcctgtcacgttccgaaatgtccctggcggcgaactgttacgtttgctgcgaacttaagcaatttcttgtgtgatctttgcaatgatagttttaagaccaaatcagggctttcgcaacataagcgtcataagcatccttgttcaaggaatgctgaacgcatcctttctcttggagtcaggacgccgtcggcccgccctcgccaggtagtgtggtccgaagaagaaacacgaaccctccgggaagtggaagtagtgtattcgggccaaaagaacattaatgtcctctgtgcggggcatctacctggtaagacttccaaacaggtctcggacaagcgccgagacttgcacaggatacggtcttctaacgtacatggtacacccaccactcagagtcgtggagatcctgttgaacaggtcgaggagtacgaggagttggactgggaaggaatgcatccttttcccgaccctgactctaagttttgctcgtaccttgatcagctgagagatcagaagggactcactgaaccggtatggcaggagatcgaaatcgtggcacaagaatgggtagaaaaccttgcccatgttcaatcgtcttggaatcatgagagaacaaccaagcaggtgccagaaaacaatacacctgcacgaagaccatttaaaaggcgtctccatcgtgtggaacgttataagcggtttcagagaatgtacgacctccagcgaaagcgcctggctgaggaaatactagacggccgggaagccgtcacatgtaacctcaaaaaggaggagatcaaagaccactatgatcaggtctacggtgtgtcaaatgatagagtttctctagatgactgccccaggccaccaggggccaataacaccgacctcctgaaaccgtttacgccaaccgaagtgatggactcacttcagggtatgaagaacggggcgcctggccctgataagattaccctaccgttcctccaaaaacgtcttaaaaatggcatccatgtttccttggcaaatgtgtttaacctttggcaattctcgggtcgcatccccgaatgcatgaagtcaaataggtcagtcctcatcccgaaagggaagagcaatctgcgggatgtcagaaactggcggccaatcacaatctcctcgattgtgttgcggctatacaccaggatcttggcacgccgtctcgagcgggcggtgcagattaatccccgacagcgaggcttcgtccctcaggctgggtgtagggataatatattcctgcttcagtctgctatgaggagggctaagcgaaagggaactctggctctggggcttcttgacttgtcgaaggcatttgacacagttggtcacaaacatcttctgaccagcctagaaaggttcgctgtccacccgcatttcgtccgaattgtggaggacatgtacagtggttgttcgacgtcctttcgagtaggcagccagtctactcgccccatcgttctgatgagaggcgtcaaacaaggggaccccatgtctcctatattgttcaacatcgctctggaccctcttcttcgtcaactggaagaggaaagccgaggctttatgtttagggaggggcaggcccctgtctcatctctagcatatgccgatgatatggcactactggctaaagatcacgccagtcttcagtcgatgttgggcactgtggataaattttgttcagggaacggacttggccttaacatcgccaaaagtgccggacttctgattaggggagcgaataagaccttcactgtcaatgactgcccttcctggctagtaaatggtgaaacgctcccgatgatcggtcccgaacaaacttaccgttatcttggggcaagcatctgtccgtggactgggataaacagcgggcctgttaaacccaccctggagaaatggatagccaatatcacagagtctcccctcaagccacatcagagggtcgacatactctgtaagtacgctttaccccggctgttttaccaacttgagctgggcactctgaatttcaaagaactgaaggaactagacagcatggtcaaacaagctgtcaaacgttggtgccatctacctgcctgtacggctgacggcctgctatactcccgtcatcgtgatgggggtttagctgtagtaaaattagagtctcttgtcccttgtctaaagatcaagacaaatctcagactagtgcattcgaccgaccccgtcatatcatctttggcggaatccgatggtttagtgggtgccatcgagggtattgctcaaaaggctgggcttccgatccctacgcctgaccagcgatctggaacatatcattctaattggagagatatggaaaggagaagctgggaaaggttggccctgcacgggcaaggtgtggagctcttcaaaggctcaagatctgccaaccactggttgcctaggccagttggtatgaagccacaccactgggtgaagtgtctggcaatgagagctaatgtataccctacaaaaagaggcctcagtagagggaatctatctaagaacaaagattccgccaagtgtcggggatgcacatcaatgagggagaccctatgtcatctaagtggtcaatgcccgaaattgaagtcgatgagaataaggcgccacaataagatctgtgagcacttgatcgccgaggccagctttaaaggctggaaggttctgcaagagcctaccttggttacagacaatggtgaacgtcggcgacctgatctgatcttccatcgtgatgataaagcggtggttgttgacgtgacggttcgctacgaaatttcgaaagacacgttgagagaagcttatgcttctaaagttcgaaggtatggatgtttgaccgaacaaattaaagaccttacaggggctacctccgttgtttttcatggatttccaatgggtgcccgcggtgcctggtttcctgaaagctcggacgtgatggccgacctgaacattcggtcaaaatattttgaagagttcttgtgtagacgcaccatcctatatacactggacttattatggaaatcgaataacgaacaatatttagaaaggcttgcaccataaattttgtctctttccccaatgatgtctactagcacgctgccgaagctagatagattgaggaatctgcgtaatctgtaatgattacgcctcatgggcatctatcggtagcgtcgaccctgacgttaaattgggtaataagaaatatcga

SEQ ID NO: 141 - DNA, 5027 bp, Nasonia vitripennis
gactagactatgggttcagtcagtcccaaatagccgatcctggcgcgtccggcagtaatgccacgtatgagtcgattacccatctctaaacgcgtagaggtggggagctaaaggccaggcggtttacccgacgtcgaatttctccaggtctgtgacagtcgacggaataaaggtataacatctactatctatcgggtgtcggaagacgccttgcagcgttttccgatttttgctctttgacggtttttcttcaaattgtgataaccgacccgatcacgcggggctttgacaaagcaatgcgtggtcggtaagatggttgcaatcttttccacctcgtttcttttacggaacgaaagcaatgcgtgtggggaacgttaaaaactcctttatgcatcccaggatttatcctgcttactgcaaagcaatgcgtgtggagcgactttaccacgagtcgctccaccgcaaagcaatgcgtattcgcgcaaaagcaatgcgtgtcggcaccacgtagagcaaagcgtgtaggcagactttgtcaaaagtagttctgccgcatagcaatgcgtgtggagatcttcgccggtgaaagcaatacgtgtgggcgaacttagaccttcgcgcccacacatcccatagtgaggagcggcccatgtcgaaagactaagcgccccggtagtgactaccgtgaaagtctataatggacagcggaaacaacgttgcctcggagccgaggggagctgtggacgtgacctcagcagctccaatcggggcggagttaaacgccgaaccttgcgaaggtcgcaaccaaaggagggaggctgccttaagtgctcaaacacgccggcgaaatccggccgccgagctcggaatgcccaacaggctgacgagcccggcgatgatgaggaaatagagacacacgggcctctaactatccggacggcggacgtggagattgtcgcaatagcgaaaaacccacaggcctgtcccaaatgcctgcagggaggtacccaacttctctgcatgggcagctgggaactaagcaggcacatcagtaaagaacacccgtcagtcgacgtgacctgggtgtgcggtgcttgtcaaaggcgctgcacaacgctcaggtcgtggagctgtcatgttccgcactgtaaggggcgacaagaaccaaaggatctgccgttcaaatgtgagcattgcagcttgtcgtttgactcgcagatcggactctctcagcacgagaggcatgtccatccagaggtgcgtaacgataagcgcgcggcagaagccaataagccaaaggggaagagtggccgtaggccttctatatggtccgacgaagacttgctgcttatccgggaattagagagcgaataccatggagctcgaaatattaatgaaagaatagctgaacatttcccggatagaacaggcagacaggtgtcggacgcccggcgtcaaggactatgccgcgctccgagggagaggagcccgcaaggcccagcagaaggtgtcgaggccatcgaagaggtagacgaaggcgaaatcctgaaggggaagagctggtgccaccgatggcgctgcgttggaaagcggccccctggagaatggagggagcgcacccgcagaacaagtcaatcgcccgcgctggaaagcagttctcagcaagatcgagagtgtagcccggcagtggggtccgatgaacaaatcaaggacagtgacgacgacgaattcagcgacgcattaggagaaatatcactcccagaacctctctcggttgaacgcacaacaatctcaccacccctcgagatgactggaaaggcccaatgaggtgggagatttgcaatgcgagcgaagaagccggaagttacgcgaactgggtgactggactgcaggagctagtcaggaacaatgtgctgagtgaaataggactagactccctgtatgaccagctcatccagattatgcggcacccttccgatgacaacgaacaggatcgccttcaattgaacgctagaggccccccacgaaggggccaccgcaagaaccgacggcgccgtcgtctcacggcagctgatcgaaagcggtttgcctttgccaggtgccaagatctttggaacaacaacccaaagaagctagccgagttagtgattgccaatgacctgtccattctccaaaggcgccaagcgccaggtagaacggagacacagactctatacaacgagctgtgggggagggtcggacctaatatcgaagcgccaaggcgcaccgaagacccgatacacgtatcgaggatcttcactccgatcactccccaagagataatgggcagaatcaggcgaattaaaaacgactcggcagcgggtcctgacggggtaacgaaggacgacctgagaggaagaggagtcagcatagccctctccaagctgttcaactcgatcctgctagcgggttactacccaaaggcatggagagagaacagaacaacccttctgccgaagccagagaaagatcctgctgacgttaagaactggcggcccattaccatcagctcaatggttagtcgagtctactcaggcttgcttgaccagcgagtgagggccgtcattaagcagtgtgatcggcagaaaggattcacggaggaaaatggctgtttcagcaacatacagttgttggacgacgccgtatcgaacgcaaagaaagcgggcggtgtcattaccatcttggatgtttcgaaagcattcgacactgtcccgcatgccgtgatccaagggtgcttggagaaaaaaggaatccccgaaaccgtggccgcctatatctcgaacatgtatcgcgactgctccactgcaatccgaacgaggagcggggacgtaaagattggaatgaagagaggagtcaagcaggggatcccctgtcacctctcattttcaatctgggttctcgaacctctattagaacgattgcaagagacaagtggagtggaaatcgaaggcatgaatctctcgtgcgcggctttcgcagacgacatagtatgttttgcgaatacagcccccgaggcgggaaggcagctacggatggtggcggattatctgggccgactcgatatgagtctttcagtgtcaaagtgtatagctgtagagtatgtcccccacaggaagacctggtacactaaaaacccaggcctcgaggtgaacggtaataccgttccgagcatctcacctagtgagacgttcaagtacctcggggcaaaggtctctccctggaaggggctgctcgaaggcttcgaatctgacgcgttcagggaagtcatatcccgcgtccaaagactgccgttgaagcccatgcaaaaggtggaccttctacagatgtatatctttccgaggtacacctatgggttgataacatcgcctccggcgaaggcagtcttaaagactatcgaccggatcataagaacgagaatcaaggagatcctccacctgccagaatcggtaagtagcagttttctctacacgccgaggaagcagggtggattggggctccttgaagtggagaagatggtgctgatacccgctcttcggaacggcttgagagcccgtcaatcccacgatccggtcacacgcgcggccatgaactcgaacgcagccgacgatcggctaaaatcttacgccgatgctctaagactacactggccactaacaaccgaggagctagatacttataagtatcagcttcgcctgagctatgcccagaaatgggctgagcaaaaatggcaagaccagggggtcgaggagttcgcacaagatcccgtcggcaactcatggctgcagcgctatgatcttctgcccgcgtcaaggtacatcgatgctatcaagctacgaacaaacacgtacccgacgcgagcactaatgaagatcatagatggacgtgttgatagctcttgccgaaagtgccaaggcagtagcgagacccttggtcatatacttggcagatgccggtattctaaggataagcgaataagccggcacaatgaaatcaaagacctcctcaaggctcgtctagccaaaaaccatcaggaaaggacggagccgcagataacggtccgaggccagaggtttaaacccgatctcgtcgtgaaaacgaatgagggaagggtgcacgtaatcgacgtaactgtccgctacgagcacagaacctatctggatgagggccgtactgagaaaattggcaaatatcgccaaattctcagcagccttcggcgagatctgcactcgaacgccgaggaggtcattccaattgtaatcgggtcgagaggtgcaattccaagggaaacgcggaaagccctctcgaaactcggaattggcaagagtgattggctaacgatctcactaatagcgctgcgtagctcgctagagatcgtcaacgccttcatggatgactgacctgaacaaaacgtgttgtcttgtcttgtctaaaactatttattcgaaataaggggaggctaactgcctgcaagttgaacgcgaaagttagaccttcccacctaaagcccaaaagtgatcggggaatgaatccgcgggtgaccccagagttgggtaaacccttgaaacgttggagaagcggaagagagtcccgtcaccgagcatcgagagctgcgcccgaatgaaaccgatcgcggatggtgcaagtcgtaggatgggcgagcgatggccaaagtccgctttctcagctacaaaacaaaaatggtatgagacttcgttaacactaatttttccgagcctagcaggctcccttgacaacgcttatgaatctggaaaaggacacaaagtggaaaaagcgttgatggtggacaaaagtcagttgagacttgatatcagttgttttgactaagaattttattatcgttgacttttaaatattttattattgactgttaatatactgacttgggaccaagtcatctttgttacccggtaccggttcctgtcatcaaaccggaaagtccgtcccacgtaatgtggtagacgcaggag

SEQ ID NO: 142 - DNA, 3358 bp, Porcellio scaber
ggcaggagtaactatgactctcttgggctatctgtaaggacattgcgtacttgcggagcactcaagtgattaatagattactgatagaagcgttcccaacagtcccgctggatactgtctatttttgtggaactcaagtaggctagggtcagccctagttgtacgggttcaccaggggtaggccgtgctaacttctatccccgttagtgaccgagagcttcgaaaaagcaacgctagatcaccagcagcccccggggggaattaaccgatcgggggtctcttggtcacgtatcggaatggcggagcgaatggttagttgtgtcgtttgccgaagggaatttcgaacggccagggggcttggcgtccatatgcagagggcccaccgcgaagaatacgatcaacgcgtgggccaggaggctgtggacgtcaaggtccgctggtcgaatgaggaaaccatcctcctcgcttcgaaggagcttgagctgcagggccagggaattcaaaatctgaatcaggaattggctcgtctctttcccagatcgctctaagcgattaaaggtaaaagaaagcaggtggcatatcaacgaatccgtgatgaagtggctcggggggtcggggtccctgctgaccctgaacctcctgagccggtggaggttgagatcccatgggtggtctcgccgcctagggggggattgtaagggcgccgggaatttccggtgaggatctcgcccggctgctgcatcaatgcggtttttcggcgggcgagatcgggccaaatctcccccggggccgcgctcgcaacgctcctactccggagtgggagctgaacaacagagtcaagcgtaagcgtcagaagtttgctcttacgcagaccctctactacgaggataagtccaaagcgcttgacttcataatggatgggagaaatccattcgaggcgggcgagccctctcgtgcggtgagggatgagtggagggagtattttgagacacgtgtggacctgggcagggtggcggatggtgcttgcttgagggtcggtcagcccgtggacagatttcctgccgtgggtgacgacataacactggcggagctcgagaatgcgttgaggagcaccccctctaagaccgcaaagggggtggacggtgtggggttggaggagttaaagcgagtgcctagaagaaccctttttaacatcctcaacggactttggacccacgtcccggagtcgttgtacaaagggagaatcactctaatccctaagaagtcgctaccggagttggctggagattttagacctatttgcgtgctccctgtggtggttagactgctacataggatactcgcaaaacggcttgcgattgtccaacataccgaattccaagccggtttccagtctggcaggtctacttcggagaacatcttccttctgaggaccattttggagtcgttgcctgcggggaaggagtctatgtatatagcactccttgacttccgtaaggcctttgactcggtcaaccacacggtgttgtgtgggctgttgagggatttgggcttgcccgagcgcctgaccgggtacgtagagtccatctaccggtcagtgcatctgactctcggtgacgactggttcgttcaggggcgtggagtgttacagggtgatcccatatccccgttcctgttcaacctgatgatcgattacatcctgagtggcactcaggcgggagtaggtgtcggggtcggagagcgcttagtttccagcctggcatacgctgatgaccttgccctgcttgcgtcctctaggaggggtttgaatgcgaatctggagtcggtcctcgcccgggcacgctcggtcaatctggcacttggaattaacaagtgcgcgacgatcggcaagaggtggctgggccgagagaaaaagatgattcttgaccgagaacccttcctgttggaaggggttgcgattccggtatatcgttggaacaacatatacaagtacttggggatagaaacctctccgggggccgcggcccgctggagtgtcactggattgagaaaccgtctaagtaagctcgagtccgcgtgtttaaagcctcagcagagaatgcacctgctcaggtgttaccttcttcctgggctgtattacggtttgatacaccagggaatctcggttggcctgcttcgaagtgctgataagcaggtcagagccgcagcccggaagatccttcaccttccgggggacgtccccgtcccgttgttcaatgaaaagtcggcgctcggcgggctggggctcgtcgagctagaagtcaaggtgccggagctgttagacaagatcagaactggactgttggggcggggcggcctctggagggtggtggctgatcggattaagatcccgatctcgaatagggaaagacggctccttgtcacggagttttgtgacggccgaggcttttgccaagcaaggaaaagacccggatgctgcgcgtgggtgtcgaacggcaaacttctcatgaagggagccgattacgtagaggcagtcaagatcaggttgggcgttgtgtcgaccaaggagagggcagcaaggggaaggaacgtgccccttcaccaagtaacatgtgacctaggctgcccgagggtggagtcgctggggcatatcctgcaggagtgcccttcgatttccaacctccgaatctcccggcacaacgcattggcctcaaggatacgccgggctctcgcgggtaaggggtggagcacggtcgaagaaccgactattccaacgataccaggaaaccgacgccccgacctggtggcctggcgtggagaaagggctatggtctttgatacggccattgcgcgagctcacgcggcggttttgaacgaggtgttcgataggaaggttgttaagtataatacacctgaaatacatcagtgggttattggacgttcgcgggcaagagtggttgaggtctcggcgctggtcctcaactggcgtggggatatggtggagaagtcctatgttatgctgagggctctcgggttaacctcggctattaaattcatggaggtggcttgtatggaggggtctgttagatccctaaggtttttcaaacaagcctccggcagatggggttgaggcgtgaatgtggttcgtcgttcagttgaacgggggtggaagtctgtccaaagactctcgcccggcatgaacccgcccatgtcgttatcgtgtacataacagattaacgttccctccggtgggacggtttactgttccgccgggggtggagattgcttttgtacatctcccctctattaagtttctgcggtggtggaggcggggaattatttaaaaaaaaaaaaaaaa

SEQ ID NO: 143 - DNA, 4277 bp, Anurida maritima
tcagttggcacttctatattagttgtgtacccaagagatagttactgtgtaggacatagggggttctgcttaccctctatgttgctacttacggccaatcatatggtctagctgtacgtcgccttgtcgtggtcccgccgctcaagatccttcccatgggatcttgctaaagacgtacgtacggtgaacggggttacatgttgaacattgtgatcgttcaacaatccccaaaaaggcgaaagctaaagcgcttgggtgacttagtacgttaaattggaagtttggcactatctccattaggacctcacggaacatttaatcgaaaagtcacatggcggcctaaaagccccaccaatgcgctacgccactggtgatcctccagaaatgggtaaggattagtacggctacagtgggaccccccagatctccggatctgactgcattagatggagaatgatgcagtgaccgagtacgttgaatctttgccttggtctacggataacgtactttaggttggggtacagggtgaagtaacctccctccgtctcttgtgccaacaagattcggaggtttatgcaaccacaatgaacaggaaaaataattacacccgtggtaaccggttcagttccggaagtcccggcaattttgtggttgtaagggatcccgcacaggatctcccgttcaaatgtgcattttgcgaacggacatttacaacgtccaatgggaagggactccatgaactgagaagtcacccgaaggagtataacatgcgtgttccggttgcgaaaaagcgggcgaggtggtcggaggaggagttaagtcagcttgctgaagctgaacatgacctcaaaagtaagaagcaatatgcttccgaactcgacctaagccgggatctggagggttgtatggtggggagatctctggaatccatcaggggacagaggaagctcccacggtatgttgagatctttaaccgactgtctaatagccgagcatcaatcccagaaattggtgaaggtgacgaggaagctaattcagtcggttccgatgaggtgtttcatgcgtccggtcatgggacagggattaccgaggcactagaggtgctggtttcgaaacggcctggtgaggcgtttcgggaggaagtcctgaatggaatagtacgagcgaaacttgagggtagcgaagtctttgtacgacttgagcaatatttgtcccggatgtttgtgggacaaagctcgttggcttctacaccttgtagttcgggtgaggggaaattgcccttgacatgttctggctccaacaaaaaggaacagaggtctgatctgttctcccggttccctgaaaagggtccgagtgtatcagtttcagcgccctctgtctccgacatgggacgtaaacgccgcaaggcgttatctcgtaacgaggcaactcaagtacgagaggaatttgttgagtttgccagaaatgtcgatccaataccccgacgcaagtgtgctagagttaacgaaggcctacaaggtaaccagaggttacctaaagaaaagccgatgaccgctagggcaaaaatgcggcaccttcggcttctaagataccgtaggctgcaagagttgtacaaaaaagaccgttccctcgcagcaaaacaagtgctgcaggacatgcttgattccaaaccaggacggaatcccgaagcggttaagtactgggctgaaaccatgggtaaagaatccaccggtattgatgtgtccgtaatgaccggacgtccgagataccgagacaatgtatggagtccaatatacccgggggaggtttcagcagctgtaaagctgatggatagtagcggggctacaggtcccgatggtttcagtgtgagatctctgaagtgtacacccagcagggttctggcgaaggtctttaacctttttcttttggaggaaaagcttccggcattcctgatgacctcaagaacggtcttagtcccgaaagttaaggagcctaaggctcctacggactacagaccaatctcagtttcgtccaccttggtccggctttttcacaaaatcctggcgagaagactaaccttggcgagcgggttagacagcaggcaacgcggcttcgttcctgttgatggatgtgccgagaacctcgtggttctcgaaagtgccatcaggagcgcgaagaactataagcgttctctattcgtagcttctatggatattaagaatgcttttggttcggtagcgcatgaagccattttcgaagcgttgtctaagtcgggtgcgcctgactcttttgtgacatatgtgcgaaactgttacgacggtttcgcgagtgttgtaaaacttggtcgggacactgcccaaactactgtgagacaaggcgtcttacagggtgaccccttgtcacccattctgtttaatctggttatagatcagataataaggtctcttcctgagacggtgggtgttcaactcgatgcgaacacgaaacttaactctatggcatttgctgatgacctaatcctgctgagttcatcggaggcgggtatgaggcggatgttgggagtcctggctggagtgagttcaaaatttggacttattttccatccaggtaagtgcaagtacctagctatgatatgggcggggaaacagaaaaagatgaagatcgcaacggacttgagctttgagataggtggcggatttatgacgccggtgggagtaactgagacatggaagtatttgggggcttatttgggacagattgggattcaaccagcaaggctctctttgcagacttttctggagagaatcgctaagtccccgttgaagccgcaacagaagttgtacctaattcgggtccatttacttcctaagctcatatacccactggtaatggcgcctattagggcctcaatgctcaataagttggatcgaatggttcgtgttgccctaactggcaaggatggtattctgcacttaccccagtcagtgccttctgccttcttctatgcgccgataggtgagggtggtcttgggctaatggagttgaggacatctataccagcaatggtaaaggcgagattcgagagaatgatgaactccacttgtcatcatgtgagagctgcagctaagggcgctgcaaactcgaacagaatcgctttggcaaatcgattccttcggaagaccgcagatggtattcccgtgactagtgcaaagctggttaaggagtaccaggcggcaaagttgcacggctcatttgatgggaaaccattgagtgaggctgggcgggttaaaggaatccactcatggacatgtgatggtaggatggtgatgacaggacaggctttctgtgaggcccttaagatccgcatcaatgctcttccatgtctctctaggtataatcggggaaccgagaagcctagagaatgtagggcgggatgcaaaaccacagagtccctgaaccatgtcttacaagtttgtccgagaacacatgacatgagagttgcgcgacatgacaagctagtcaatagactaggtggatatttgagccagaaagggttcgaaatccacacggaaccaagaatcattacgtctcttggattgaggaagcctgatatcattgcgatcaaaggagagaagggagtggtacttgatgcgcaaatcggaggagctgcaaatttaaatgcagctcatgacgctaaaatgtgttactactcctcctctccggagatcaaagaatgggtaacgggaaagggagcgccggacgtgtcctacggcgcatgcattgtttcgccacaaggcataatgtcggaggagtcctggaaaaccctgcgggggttaggattctcaaaggggatgctgaactccttggtcgtgactgtcatggagcaaagcacatatgtttggcatgtgttcaaccggagcactgcctcatatgggtggaagcgcaggcgaaagcgcaagtgggattagctcgtttttagcaggaacggcgaagcctgaaggcaaatgtttgtttgagcgggaccctccctatgaagctctaaacaagctgatggccttggaggcacggggtctcgagcaatcacgtgttgatgtgaagtggtgatcactaccaccgctggggccaattagatgaacatgtaagacccaactggtaaggattgaaagtaggagtcgacgtacagactctgaatgtagggcataacgtcaatttgcctgatcgctggtgaatctcgcttgcgagcggtgtgaaatgtgccaccttatcagtggctatag

SEQ ID NO: 144 - DNA, 4400 bp, Bombyx mori
gtcaacgtgaagaaattcaagcaagcgcgggtaaacggcgggagtaactatgactctcttaagcgggagtaactatgactctcttaggggcgatacgcataattttaatttttcgattcaaatccagtcgtcttaatctggtgaccagtggcgcggtcaccagtatagtgcacaggacgtgaatggctccgaggctggcggagtcactcactataagtgtgagagacgatgtcctgtgccaagtatacgtccaaccctaacgggttaagtgaaattagttgctcataacagggacggtgtacctgtttgctcgtggctggctatcgaatggacgggaccaatacacccccctgttagtaatggggtaagagagagcggtctgaaactatggccgagatcacgacgccccactcctacccataacctgcacgtggtaccgccgcacattgaccgatacgggaggaggggcagcacttgaatcacgtagtcttggtgtagccattgcgggactacagccctcgtaagtgccgccttagaacgcaacggggcaataggtgggccggggcgctagcgggggggagtaatctcccctgttggcgtgcaccgcactgctccctctgggggcagtgtcatccggaaacaggtgggccggggcgccaccaggggggagcaatccctcctgatgatggcgagcaccgcactgtcccttatgggacggtgtaacccggatggctgtacacgtggtaaacacgtgacagcagccccgatggacggaccgcgaggaccgtcaagcctagcaggtaccttcgggtggggccttgcgatacctgcgggcgaaccctgtggtcgggtttgcagcccggccacagtgggtttttttcctgttgcaaaaaagtcaaataaagaaaatagacctgaagcctctggcctcccgctggagtcagagaggacaggcgataacccgactgtgcggggttccgccggcgcagatcctgtgggtcaggatgcgcctggttggacctgccagttctgcgaacgaaccttttcgaccaacaggggtttgggtgtccacaagcgtagagcccaccctgttgagaccaatacggatgccgctccgatgatggtgaagcggcggtggcatggcgaggaaatcgacctcctcgctcgcaccgaggccaggttgctcgctgagcggggtcagtgctcgggtggagacctctttggcgcgcttccagggtttggaagaactctggaagcgattaagggacaacggcggagggagccttatcgggcattggtgcaagcgcaccttgcccgatttggttcccagccgggtccctcgtcgggggggtgctcggccgagcctgacttccggcgggcttctggagctgaggaagcgggcgaggaacgatgcgccgaagacgccgctgcctatgatccatccgcagtcggtcagatgtcgcccgatgccgctcgggttctctccgaactccttgagggtgcggggagaagacgagcgtgcagggctatgagacccaagactgcagggcggcgaaacgatttgcacgatgatcggacagctagtgcccacaaaaccagtagacaaaagcgcagggcagagtacgcgcgtgtgcaggaactgtacaagaagtgtcgcagcagagcagcagctgaggtgatcgatggcgcgtgtgggggtgtcggacactcgctcgaggagatggagacctattggcgacctatcctcgagagagtgtccgatgcacctgggcctacaccggaagctcttcacgccctagggcgtgcggagtggcacgggggcaatcgcgactacacccagctgtggaagccgatctcggtggaagagatcaaggcctcccgctttgactggcgaacttcgccgggcccggacggtatacgttcgggtcagtggcgtgcggttcctgtgcacttgaaggcggaaatgttcaatgcatggatggcacgaggcgaaatacccgaaattctacggcagtgccgaaccgtctttgtacctaaggtggagagaccaggtggaccgggggaatatcgaccgatctcgatcgcgtcgattcccctgagacactttcactccatcttggcccggaggctgttggcttgctgcccccctgatgcacgacagcgcggatttatctgcgccgacggtacgctggagaattccgcagtactggacgcggtgcttggggatagcaggaagaagctgcgggaatgtcacgtggcggtgctagacttcgccaaggcatttgacacagtgtctcacgaggcacttgtcgaattgctgaggttgaggggcatgcccgaacagttctgcggctacattgctcacctatacgatacggcgtccaccaccttagccgtgaacaatgaaatgagcagccctgtaaaagtgggacgaggggttcgtcaaggggaccctctgtcgccgatactcttcaacgtggtgatggacctcatcctggcttccctgccggagagggtcgggtataggttggagatggaactcgtgtccgctctggcctatgctgacgacctagtcctgcttgcggggtcgaaggtagggatgcaggagtccatctctgctgtggactgtgtcggtaggcagatgggcctacgcctgaattgcaggaaaagcgcggttctgtctatgataccggatggccaccgcaagaagcatcactacctgactgagcgaaccttcaatattggaggtaagccgctcaggcaggtgagttgtgttgagcggtggcgatatcttggtgtcgattttgaggcctctggatgcgtgacattagagcatagtatcagtagtgctctgaataacatctcaagggcacctctcaaaccccaacagaggttggagattttgagagctcatctgattccgagattccagcacggttttgtgcttggaaacatctcggatgaccgattgagaatgctcgatgtccaaatccggaaagcagtcggacagtggctaaggctaccggcggatgtgcccaaggcatattatcacgccgcagttcaggacggcggcttagcgatcccatcggtgcgagcgaccatcccggacctcattgtgaggcgtttcggggggctcgactcgtcaccatggtcagtggcaagagccgccgccaaatctgataagattcgtaagaaactgcggtgggcctggaaacagctccgcaggttcagccgtgttgactccacaacgcaacgaccatctgtgcgcttgttttggcgagaacatctgcatgcatctgttgatggacgcgaacttcgcgaatccacacgcaccccgacatccacaaagtggattagggagcgatgcgcgcagataaccggacgggacttcgtgcagttcgtgcacactcatatcaacgccctcccatcccgcattcgcggatcgagagggcgtagaggtgggggtgagtcttcgttgacctgccgtgctggttgcaaggttagggagacgacggctcacatcctacaacagtgtcacagaacacacggcggccggattctacgacacaacaagattgtatctttcgtggcgaaagccatggaagagaacaagtggacggttgagctggagccgaggctacgaacatcggttggtctccgtaagccggatattatcgcctccagggatggtgtcggagtgatcgtggacgtgcaggtggtctcgggccagcgatcgcttgacgagctccaccgtgagaaacgtaataaatacgggaatcacggggagctggttgagttggtcgcaggtagactaggacttccgaaagctgagtgcgtgcgagccacttcgtgcacgatatcttggaggggagtatggagcctgacttcttataaggagttaaggtccataatcgggcttcgggaaccgacactacaaatcgttccgatactggcgttgagaggttcacacatgaactggaccaggttcaatcagatgacgtccgtcatggggggcggcgttggttgagccttgcacagtagtccagcggtaagggtgtagatcaggcccgtctgtttctcccccggagctcgctcccttggcttcccttatatattttaacatcagaaacagacattaaacatctactgatccaatttcgccggcgtacggccacgatcgggagggtgggaatctcgggggtcttccgatcctaatccatgatgattacgacctgagtcactaaagacgatggcatgatgatccggcgatgaaaatagccaaatgcctcgtcatctaattagtgacgcgcatgaatggattaacgagattcccactgtccctatctactatctagcgaaaccacagccaagggaacgggcttgggagaatcagcggggaa

SEQ ID NO: 145 - DNA, 3513 bp, Forficula auricularia
tagtccaaaagccttgtcatcttaggatgacgcgcaggtttttgagatgtatatttttatagtagtagtaaaatacgacttgttaaattcttaagataaagagtcatagtagcaagtgaagaccttttcgtggttcctgtcataagtaccctacggggaaaccaacttcacccctgcgaacatggagcttagaggttaccagcctcctcgctcgtcaattagcttggtcccagatcaataaaccagcctcggataaggacggattcaccgaatatcgttagaccctctggttcaacgacgaccatgcaaagatgcaccacgtcagacttgactttctcccaatgtagatttcctcattgtaaattcagaagaccatctcttactggtgtcagggttcatgaacaaagatctcacaaggccttttttgacagactgcaggctgaagtaattcgaaatcagacgtcaaaaaagaaaccgagatggaccgaagaagagaagaacctgttagcacttgcgcaggcgaatctcataatcgaagaagaaactaatattatcgatgacttggtctccaagttcacatatagaaccaaagatgcccttaagagccaaatcaggaaacccgaacacaaaacccgagtcagtgagttcactttggcaattcaagcccatatagacaatattatgctccccgctcccgtccccatagctactgatccgttgcaagtctcttgcaacttcaaggacagagcaaaagactacatcgacacattagagcccataacttcaactaaattctatttagacgagttagaggctctgtgtgacaatatttgtatatggccgactaggctacttatcacaacagtggagtcttacatacgaaaattgtttaaaacaacaagtacgttgaagccagcacagaagttacataatccttcaaacaggaatcttccaaagcgccagctaagacgtatggagtatggtaagacgcagaagctgtggaaaaagaacccgtgtcgtgccataaaaacaattattgacgataaggactgtaagtcgccacccgaaagggaggcgatgacgcaatactggaagacaacgttttccagtaaaaagcggacatgtccccagtatgagcctcgcgaaagtaccaaaacccagttgtgggaaccggttacaatcgaggagcttcattgctgccaccttgaaatgacaaccagcccagggcctgacgggatcactgttagacagctttacctcgttccggagcaattgcttgtcagaatattaaatctcctaatggcctgtggcaaaatgcctgatagcttcttggaatccaaaaccactctgattccaaagaagcccaactctactgaacccggcgattttcgcccaatcacagttcagtcagtgttggtcaggcaactgaataaaatcctagccgccagagtagcgcaacacatcccactagacgaacgtcaacggggatttagaccagtagacggagtcgctcacaacatcttcgaattagacatgatacttaggtgtcatcgatctgaattccgcgatctccgacttgcctccctcgacatagcgaaggcattcgactccattacacataacaccattgaggataccatggaagtaaggggtttccctaaacccatgattaactacataatggcttgttatcgccgcagtaaaacgagattcacctttaatggatggatctcagatactgtgaaacccacttgtggggttaaacagggtgaccccttgtcaccaatactgtttaatctagtaatggacagaatgatccggaagctaccgaaggaggtaggagtcaatgtaggcagtaagcactataatggtcttacatttgccgacgacctactgctcttcgcgactactcctgaaggcttgcaatcctcaattgacattgtccacctcttcctcctggaatgtggactattgatcaacaagcaaaaatcctttgtccttacggtcaaagcatacccaaagctcaagaagacggcggtcatcgtcacagagaagtatatgttagaccgtcatattcttcccgctattgatagagagaagctattccactatcttggcgttccattcacagctgaaggaagatgtagagacgataccatagcccacctcaaacgaaaaatcgatgtgcttacaaaagcaccgcttaagccccagcagagactattcgcacttagagttgtcatcctccctagctgttatcacatcctaacgctaggaggatcgaacctaagtctgctaaagaaaatcgatttgatggtaagagctgcgggtaggaaatggtgctgcctgccaaaggacacgcccaacgcatattttcatgcgtcaagccgcgatggaggactaggtctgccctccatgagatggcttattcctctgcacaggtatctaagacttttacgatatgagggaagaaacccagaagacactaatgtgtacttgacgactgaaatcaatagagcaaaaattagactctccgacaatggctctaacattgattgtcaagccaagctttggcaattctgggcggaccgattgtataagtccgtggacggctctgccctaatcgaatccagtaaagtaccacaacaacatcggtgggctacaggtggtagcagatttttgacgggacgggattttatcaactcaattaaattgagaataaataccctgccgacactatctaggacgctacggggtcgtgaaggcaaccgaatgtgcagaggtgggtgctacaatgtagagacgttacatcatgtcctacaggtatgtcaccgaacgaacggaacacgagttaaacgacataacgccatcaggcagtacattgcgcggggtgctgctgtcaaatttgacacagtcgagagagagccccgtataaagtctgcgtctggtgcagttaacatcccggacctagtggcttgtaacagcgatgaagtggttgtgatagatacccaaatcgtctgggaccaggccaacctggatgaagctcaccaagccaaagcggagaagtatgctcacttaagtgacatacttaagcataaatatagtagagatagggtaaagtttacctctgtaacgctctccttcagaggcttatggagtaaacaatcgctgaaggaactgactgacctgggaattgtcaattccaaagacattcaaatcatttctaccagagctataataggaggtattgcatcatttaggatgtttaattcaacaacctcagtaaattcagtaaattcctttctagaaatcgcattgggataggatgatagcgcacctggtcatcgtctctctcagctgctcacttgctgttctaagtgataataccgttgtttttttagtgggtattcttttacgctttcgtaggagcgagtcccacactcttggagcaatccggggtagtgcctaaacgcatttcttcaacgtaaaaaaaaaaaaaaaaaaaaaaaaaaa

SEQ ID NO: 146 - DNA, 3583 bp, Triops cancriformis
tttttggtctggcatttgatcgtttccgcctcctcgtggcgccagactgggtaagctgatttatcagtgagctaagagaaacgatcaccgcaggagtccatctacctgcgctgcacgtgatttcattgtgcacttggcgagttatcccttgtggagctcgctcgttagcttttgagatgtctcaaaagcgcagaccggagaaagcagtccccgacgagggagcgactgctcatgatgttgcgcaaccggataagagtaagtgttctgtttgtggggagacttttaagggtcctgcttccgtgacaatgcacatggtaaagaagcacccagtcgaatttaatgagcttaagatggccaagaagcctgttccgaagaaagtacgatggtctgaggaggagatcttccaacttgccaggacagaggccgaacttacccttcagggagttcggtttattaatgtcgagctgcagaagatcttcccagcacgcgagatcgagggcatcaaaggccagaggaaactggctaagtacaaagagctcgttaaagatcagctggacgaaatcggccgtgctcctaacccccctgagcaagagatcggagaggatgtgcctagcccgttcaaggcatggctggaacttctgcttgcgctccccaagacccccaatgattttctagaacacaaacttgacaacattattgttcaagcgctgaaggaagacgtgaactccgatcaggtattcaatgaccttaactcctatttaaagctgattcttgagccgagtggtagagccaagtcagttcccggggaaattatacacggtgatcccagtgggtctgctaagacctcagtaaccaaggctcctaagcctgctacagtttcttctagcaggaaaaaacgcagagatgccgagtttgctaggatccagcgtctctatcggaaaaatcggacatcatgtataaatacaatccttgatggcaatacaagagagcatgaggcccctaagaacatggaaggattttggagggaaatattcgagagggaatccccggatgaccccgatgatcccgacattttccttgaggaagaagccagtgatatttggaagtacatctctttctatgagatgtgcaacctttatccgcctccctccactgctcctggccccgatgggttttcctctaaggacctccggcggatgacgccaagagtcctcaacaaaattttaaacctactccttcatttgagagatcttcctcagatcctgaaatcccatcgaactgtactaataccaaaaaccgatttgcctactaaacccggggactttcgtcccataacgatctcaaatatactagtcagacatcttaataagattctggctaatagagtgagccaccttataccaatcaatgagaggcagaaagctttcctaccaattgatggctgcgcagaaaatattttcactttggacttcatactccatcatgcgcggaccaaaattaaatcgctgtcaatggccattctagatattagtaaggcatttgatagcgtctcgcatcattccatcttccgcgctttgcgagaggctcgatgccccattggttttattaaattcattgagaattgttatggtggatgttttaccaaacttttctgtggtggcgtgaaatacccgagtgaggtttctatgaaccgaggagtaaagcagggggatccgctgtcaccagtcctatttaacttagtcattgatggtctgatcaggcaaattccatccgctcttggattcaacgtaagtgatcaggtgaaagtcagctgtatcgcctacgctgatgacctgatccttattgcgaccacaagggctggcctgaagaccctgcttgacttgactaactcctacctagcaaaacggggactttcgctcaacccggacaaatgctcggccctatcgattgtggcatccggcaagcagaagcttgtatatattgcgtcttccgagcattttgatctcgcaggtcagaaaatgcgcaatttaaacgtcggtgactcttggagatacctgggtattcaattctcgcatctcggtagagccgaaaaggtcactccagacctaacatgtctaattaatagacttcaaaaggcccctttaaagcttcaacagaagctttatgctctccgaatctatcttatacccaggcttatccatggcctcaccctctctaagaccaacctcggagagcttaaaacgctggacaagctaatccgcaagtacatccgcgcctggctccatctcccagatgacactccgatgggctatttctatacccccttaaaagctggtggacttggccttccttcactccgtctagtgatccttaacaatcgacttgaacggatactaaggatgaaggcttctcaagacattattgtccgcactattgccgaatcggagacgttgggggtcgagattcgaaagcttcacgatctgttgtccattgatggaacaattctggacacgagcgttaagatccatagcttctgggcagaaagactctactcgtcctatgatggtaaatgtctttgcaattctgcaaattttccccccggaaacaagtggatcggtgaagattctctgaaccaacgctcgcatatcttcgctgattgcctaaagctccggataaatgcgctcccaacacgttccagaacagcacgtggaaggccactaaaagataaaccatgtagagctggatgtcggaacagtgatggtgtaaaggtcattgagacactgaatcacattacacaggtgtgtgagagaacccacggagcccgcgtcaagcggcatgatcgcctagtggacttcgcggtgaaaggactacaaagaccccatcgtgtggttctaaaggagccacattacaagacagtaaacggtgttcggaaaccggacatcgtcattaaaatccccgaccacacatacatttgtgatttccaagttgtatctgatacctcttgtttagagttggagttccggaagaaagccctcaagtatgcggaggacaaaggcctctgcgatcaacttacccgcgaccatcctggggagctctcattcaccgcaattactttcaatacaagagggcttatagccaagtcttcagtcaccgccctccggaaattggggatgccacccagatctatcatgaccctccagaaaatatgtatggagggttctctggagatctggaggatttttaaccagactactgctatggcccgcaattagatgactgccctacccctttgctgccgaagaactactgaagactattgaactaaccaactgtgttaagtaagaactaatgcctctttttccctgcatgtatcccctgatcagtgacttattttcttttcctgttgcgccctttgtttagttatttcctttaattactagaattatcttttcgttctccgtctaattgctttttcggtgtaggaacggctacctaaagctggaagtgggaagtgttttcaatgtactttgtgattatagaaatatatgacccgaggtgcattgtttggcatttcctcgagaaa

SEQ ID NO: 147 - DNA, 5021 bp, Reticulitermes lucifugus
ctcactgctgtcatgccattgttaatgcgttgggtgatggcgggtgatgggagacgagttacagcagagctggcttcacggggggggctgtagttgcccgaaccagtctgcttctgagtgcctccacgtggcctcgctggaaacgtcggagctgcttacggctaacccgtagacaactccggcggccaaactcagaaaacggccttactaccagggtcatccctcgcggcggcgctaagaccttactgtatgtactacggactacagttgagtagcgcgggagagcacttgatgtgagggtagcaacttgttgctacttcgactgtctccctgaagatttccgaaggggtgccgcaagtccatgggggcggtcctgctgtgggagttatcttgcacccgggaagccctcagtggataaatactccaaaatggcttagccacctcacgtggagagaggggaattaggggtttactcctaagggccgatgcctccaatcggatttccccgggcaacggctattatcagccggctaagttcggaccctcatctactgatgggatactctctctccccccgcctgcgtgattagttgggaatgcacgcgggcgggtgattctgacaagcccagcccaaaagttcttaccacgacgtacccgggggtgtcacccgaactaatatattttccgccgatcggttcgctgtggggggatgtcggggcctggtggccgggaaccgtcagccgctctttgagtgtcctgcgtaacccggaggcggtgacgtcgaagggctaggctagcacggtccagacccctgaacgcctggggagacgggcccaccacctgagtaggagtgggtcctttacctcatttgaggtgtctcctcgttcttgtagggggcgaaggacgaggaatgcatccgtccctccaggatgctggtggtttccgtctggtgggctcatgctgaaacgcgcaggtgccgatttgtcgaagaggacatatggggtaacccatagaacctaggcaggagtaatcccttagctgggggggtcagctggtgggtcctgtcaatttatcctcccctccatgccagagccggtccgaggttagagacggactcattttctcctttttatatgtcatgatggccgattataataattctgttgatcatgcacttgaggataatactagattgatatttgcgcgtgacgcagtacttgcgagagtatgtggaccttttgataacttggagtgcgggttgtgtggggtgctcctgacgtcccttcagggcgttcgagagcattgccaccgggcgcaccataacttggatttgacttttcaatgtactaaatgcgataaagggttttcctcgtataggggaatttgttgtcatttttcaaagtgtataggagctcgtatatctgtttcagagggcccccttagttgttcagaatgtgaaagggaatttgactctaaaagagctctttcaacccacgagaggcatatgcacccagggattaggaatgctaagaggctcaaagattttaatccgcggggggggggtggtaaaactattcacggcaatactaagtggactgaagaggaggtccagttgcttgtatcacttagcaagagatttgaggggtataagtctatcaataaagaaattagccttattttaacatcaaaaacttgtaaacaaatttctgataaacgtcgctatttaaatttgcataatggaaatggggggctagctgcagcggaagctgtattagaattttgtgaagatagtcaccctgaagttactgagagcgatggggcggtgctttctgaaatcatggatgaggaatgtcatcagtcatcggtaactatgaggtcaagcatcgtacatggcgacattggtcgtgaggttcaagggaaggaattggtccggatcccgcctgataatagtgtaatggggaattgtgttgttctacttaggaaacttgctactgacaaaagaagtgatttggacttgagtaaggataaagagttgcgcattgacattgagaaggcgacgaaagctaacagagaaagcgcagacggtagggtaattcaatctgtggctggtaatgagatcgatcccgatacttttcaatggaaagaattgctgcttgggcaggtacgggggtttccacgagttgatgagaactctgaattatttgatttggatgacaaattgactaaggaattatcttccgacagccccgtgtggaatgacaactgcgaacttattgtgtcggacttatgtcaggtcttatgcaaaaagaaatatgagttaggtaggcagcatcacgttaggaaaggaaagaggcatcggggtatacatcataagagggagaaatttagggaatgccagaagatatttagaaagtcccccagaaagcttgccgaatatctctaccgtgataaggacctgtctcatatcagtaaagacgctagcactccgcagggtatagagcaatactattctcagttatggggggaacctgaattactagaatccaacacaattgaagaaaagttaccgtccagttccttatttgactgtcttccccccatcacgccggaggaggttgagggaagaatccataagattcgaccgtcttccgccccagggttggatggggtacgcaagatccatcttgtcggtaaagggataaccctggtccttgttaaactctacaacttgctatttttgactgggggatatcctgagtgttggaagcggaacaggaccgtctttataccgaagattgggaaagatctgagtgaggtgggaggatggagaccgttgacaattggttccctattagctcggatgtattcagccttcctagagaggaggattaggagggtgacctccttgtccttgtcgcagaggggctttacgaatatccaaggttgtcacgttaatttgactatcctcaaagaaggcattcgacaggccaaagtcaagaacgggggagttatagtctcagtagacatagagaaggcttttgacacaatccctcattctgtaattttctcccgcttggcgtctcaaggtgttcctccccttcttaggaaaattatttccaatatgtataaggatgtctacactgtgattgaggggcagtgtattccaataaagagaggagttaaacaaggggatcctctttctccactacttttcaatattgccatcgatcctgtgttgcgcagtttggaggagtttcaggggggtctcccacttggtaactcggctattaagatcttggcctttgctgatgatattatattaggagctagttcggcgggtcaggcgcagcagatggtggatatgttgggaataggacttacttcgtgtgggttgggagtatcccatagaaaatgttttggatttcaaatcgtgaataaaaacaagacctggacaattgttgacccgatgatcacactcaatggttcttcattacccttctcagggccagaggacaggttgccttatctcggggtggatataaacccatgggataggaaatcacggtatgacgctggacagagacttatttcggcggccaaacgaggctctcaactatcccttaagcctcagcaaaagataaatttaataacagcttttcttttgccaaagtttctgtacattctgattgaagatccgccttcgcctgcctatctgaaatccatcgatcatgacctgaggcagatatataagaatattttgcacctccctaactgtgtgtcaaccgcctttatgtactctcccaagagggatggtggtttggggctaccgcgtctgtcctgtctagttccacttgcccatttaaaagccgggatcaagctcggttccctccaagattctttggttagggaaattaccacctcagacaggtttgtacgtacaatgggttcggtagctcactccctttgggcatcatggtctctaacgttgcaggatatctataaacttaagtccgcactgaaacgtagggaagctaaggcatgggagagttgtgtgtctcagggacaaggagcagcgcaatttcgcggggactcaattggaaacaactggctccataatccgggaacctatcgacctggacagtatatcgaagcacttaagcttcgtgctaatttaacaggggttagagtcaacttgaagcgttcaggctataatgttccaataacttgtaggttctgtaaggatatacctgaaacgcaggctcatgttcttggactttgtccaaagaccaagggaatgagaatacaaaggcacgattcaattgtgaatagggtgcgagataaacttaagactaagtcgcccgttgctctcatgcatgagcaaaacttcaccgttgaggaaggccaggtgttcaaaccagatatagtgacgattttgggagaggtgggttacgtaattgatgtgacagtacggtatgacgatagagattacatcaaggatgcctctgtggaaaaaatcaggaaatacgaggcccttaaagggtacctgaaggatttatatccacagctgaataaggtagaggttttgcctcttgtctttggtagcagaggggccgtgccaggtagtactgttcacaacatgggattgttaggttttacgaaacgtgaaatggtccacatctctcgcaaagttatagccgactcactgataatctctaattttttagaggtttattgagttagatatatatgacgactgattcttccctaactaaaatataatttggaatgtgcattacttatactttattgtatttattgacatccgtagtagtctgtttagtggatttagatcgttaaccattctgtgacgtcgctgatgtctatatgtaccagtggcagaatgctgactaagaacaaaataattttaaacaatagacagcactaagaaattctgcaaactggaacgtggcccacggtaggccaatataccggaaagggaaaatgacacatccccccttaaa

SEQ ID NO: 148 - DNA, 2338 bp, Ciona intestinalis
aaagttcaaacaatctaaagttaagcataatcaaaaagaaaataagtctaaaagacaaattcggagggctcagtatgccagaacacaaatcaattacaagagaaacagacaacaggccatcaacagtatactctcaaaacagtggagagaactggatgatcgaggacccccacttgagcatgttctgccgttctggcagaagctcctagaaaaatcatcggaacatgacacgaggcaacctgaaccagtaagtggtccaatatgggagttggtagaaccgattgtggccgaggaggtaaggctggtaagaaagtcgatgcccacgtccgccccgggtcccgatgggattcggcataaggatttcatggcggttcaaccgcaaatcttggcggataatttcaacttgtggctcctgactggctaccagccaaagagttgtaggctgggtagaaccatcttaattcctaaagagcctgggacgagggacccagccaaacatcgcccgattacgatcaattcactactaattcgttgcttccataaaattttgagcaacagaataatgaaattaatcccgctatcaccccagcaaaaggcatttagacctggtgatggaatagcggaacacatttggaatttacgccacatactcaatcaacataaattggaaaaaaaggaactcaatttggcgttcttagatgtacgaaaagcttttgacagcgtgaaccattcaactctgctactggccgcagggcgattgggggttccccccccactgctaaaatatatcgaaaatctatatgagggctcctccaccactatcattgcaaacggcgaaagatccccgaggataagggtaagaaggggtataaagcaaggtgaccccctgtctattcctctctttttgggagttatggattgggccatgagcaatctgaaccctaatgtgggtagttcaatcggtggaaagagtataaactgcatggcctttgcagacgatcttgtactgatttccagaactcaaattgggctccaaacgaacttggacacaatatcatataatctgaatcaatcaggaatgactttgaactctgaaaaatgcgccaccctgcggttggcggttgatggaaaaagtaaaaagtggtggatagaccatcgtccttttcttcgggtcgaaggcgcaaaatgtggagcaatggatatagaaggaacatacaaatatctgggtgtaagagtaggggcaggtgacactagagcggagtgtaaggaaaagcttatgtcggacttaaaagaaacaactgaagcaccgctcaaaccacaacaaaggatcttcatccttagaaactatatactgcctcgaagcttgcatattttgacatttacaaatacaactgctcggttgctcaaacagttggatagtgcaataaggatacacgtgcgccgttggctgaagttaccaaaagacacacctttaggctatctatattccgattataaggatgggggtcttggagtcccacgcctcctaagtagagtcccacttcttcgaataaggagaatggcgaagtataatacttcagaggatccaacaactgttgctctaaggagttgccacacattcacatctgccgctgtgaaatgggccatgccgccaaaaattagcaatgtcgtaatctcagataagagaaaggaacgcgatttccaccgaagcgagttagctacctcgatagacgggagcggactttcatgtgcaaatacaactccacgtgcccaccaatgggtggtcaacggaacaggtcttctaagcgggaaaaactatattggagcaataaatgcaagaggaaacctcttacacacagcctcacgagcagccagaggaaggccgcaacgaacaacagattgcgacagttgtcacagggtggaaacactgagccatattctccagtcatgcccaagaactcacgggccaagaataagaaggcacgacaaggtaacaaaggttatagctgaagcagcaggaaagaaggggtggaaaacgatcgctgaaccacggatcccgacaccagagggcattaggaaaccagacttaatcctttatcaacatggtcgtgcaatagttatggatacaacgatcgtatcagattcagcagatttgagcatgagtcaccagcacaaggtgatatactatcagaacgagtgcattcggagttgggtgcaagaagccacaggagcaacggaagtaacatggagcagcttctccgcaaactggagaggatgcatcgccgatgagagccgcgacctactactgcatgactctacctcacaaaagacagctgca

SEQ ID NO: 149 - DNA, 2418 bp, Ciona intestinalis
cgtctagtatgtacggcttgtcgaggtgtcatggtaacggcgcggttggcgcgtgaacaccttttgacacatgggttcggtgtcgctacctttgcttgtggcaaatgtactagggaattcagtggtttatcggcggtgtccggtcattatgtgcggtgcgatggctcccgggtcacggagacccgtcttgcatttgtttgcgagttctgcccacggtcttttaattctaggtcaggtgtgagtcttcactgcaagagctcgcatcgtgctgagtacgaggccgtactggcggccagggataaaaggaccaggagagggtatcatgaagatgagattgaaatcttagcaaaggtggaaattggtctaccgcccggagtgcggaagattaatatagagttggcgactctaggagcggttgaccgtacgtgtgaacagatacgtcagataagaaagagcgcgaggtaccggcgatgcctcgaggagttaaggagtcaaggtagagctactagcccggggcgtacccaatctgagccagaggaggataggctcgttagtgaaccctcttcggagatccctgacgagttcttgaatcccctgccagctgaggagttggaagacttgtgtgcggtcgacttgtcggccgccatgcgtcatttgcacggagaaggatggcccagtgatgcggtggagcagctcgatgttatcttgaagcgtcaccaccatgacgtctttaagagacgcagacaggctcataacaaaggacaacggaaaagcaacgctgaacaaaggtacaaaccgtctactaagcggaggcgtgcaggttttgcaagtgtccaaagattgtgggacacagatcgtcgtaggctcagtcaggtggtttttgacggggcaaaggtcgcttcgtccttccccgacattcgtgacgtggaagaggtctatttcggaagatttgccggcggcgatgagggggaggttgtttccgacaacgaacctgaaccaaagcttggtggacaattcgaaggactatcgaagccgtttagcgttgttgaggtcagtaaggccctgagagaagttaaagtggcatctgccagcggacctgatggagtgagcgtatcgggaatgacgaaaatcggtgcccgggtattgtgcatgttatttaatgtgtggcagttcaccggtcgtaccccgcggtggacgaaggaaaaccgaacaactctgatagcgaagagtgcctctgctgcggaggatgttggagactggcgaccaattacgattggttcgcatgtggttcgactgtacgcgaaattgctttcgcgtcggctgggctcctgtgttcaactgaacctgtgtcagcgggcattccgggatgttcagggttgtgcggagaacgttatgcttctctcaggcatgataagagacgcgaaggcgcgctcccgggacttaaaccttgtctttctcgacttggcgaaggctttcgacactgtgtcccactcttcgattgtcaaagctctccgaaggcaacaggtgcccgagaagtttgtaaggattgtgcaggacttgtatgatggagcggtgacgaccgtgtcggttggaggccgtgccacccctcagctagtggtgaagcggggggtgaagcaaggttgtccactttcgccattgctgtttaacttggtgttggatgagctcattgatgagttgtcgtccagcttcggttacaccttggacgacgggtcgaagctctctgtcatggcgtttgcggacgacttggtgttgtcctcgggtagtttggcgggcttgcggaagctgatcgaaactactcagcagttcctcctaaggtgcgggatggggctaaacgtacagaactgcacttcccttggttggaagtcgatggttggtggtaagcaggttcgtctccgtacggaaccgttcgtgcgggtgggtgattcggaactggcttgtctgggtccgaattccacatgtcgatacctggggatccactttggaatggtaggctcctgtcgcattcggagaagggagataagagagagtcttttgagactagcaagctcggcactgaagcctgagcagaaggtgtttatgttaagatcgttcctaatcccacgttggcggtactcggtaacgttaacgagggtgaccgtgagctttctaagctggatagaccgagttgtgcggatgcgcgtgagagcgatcttgcatgctccgcataatctgtcgagtgaatggctccatctttcaattgcgaagggtggtttgggcattccgtgcatggtagaagagacatggttcagtaagcggcggctccttgaagctatgcgggactctgagtgtccgttagttcgcaactcacgagaggtgcaatgtctgtccgatgacgtagaacgtttgcgagtgaaactg

SEQ ID NO: 150 - DNA, 4718 bp, Rhynchosciara americana
cagaacgtggagaaacggaataactacccagatccgttggttaaccggtggcaaagttaatcaaggttgccataggcttaataaccctatggaaatgtttccacacacctccacgtggtgcctgccggaaattgttctagggtgaacaagctaagttgtgagaaacgggctccaccacaatatggagcctgccagggcgcgagactcaggactctccatgtacaaagtggttagttgcaaaaagagtgcgcctagcatgactgataatttttcactgaaataacgttgaactttatctgtgtcatgtgcacaacactatggtgtctgatcaagcaccatcagtggtggacctgctaatgtattagtagaacgtgtccaggcgataatgcacacacggcctccgggcccatcgctttttttgagattccctagaaacttcagtgtgtgcgacaactgtataacccataagggatggacaaaggttatactagggggtaaaaaccctaatcggctaatggcaaatgggatgtagaaatgccaaagattactcgcaccgaataatggtggccgaaaagcgggtaatcgaatgaaatggtaatgctgtagcggaaacatgatcacattctgtgacagtaaaccattagacctagggggaactatgattaacaagataccagcttacatggaagcaatgaaatgtaagtcacagtagtgataagtggtgaagagtcttgtaatcaccgtaactaggccaggttctggggatgccatgaacttagggggagtatggttagcagatctaccagctaacactattactgataatatgtaagccgcagtagcgctaagtggtgtacagatttgcaaccaccgtaactaagttctgtttcgatggactagggggaatcatgattaacaagataccaacttacatggaagttatgaaatgtaagtcacagtagtgataagtggtgaagagtcttgtaatcaccgtaactaggccagatgtagtcaaagcacatgtttagggggaacaaggttaacattggtaaaagaccaatgcaacctccgtaactaaacgtgaaggcacaaaactaaaagtccagtggatgacaggtgaggtcatcactggacccaaatgttttaagctcatcataacaacacggtgaaaaatccagcatttatttgcctgattgagtagcttccacactattccaaagccgaacctatctgggtttttcttgaaaggccgtatagggcatatgtcgagaaataagtccaaggtgaggtagtgtggccctgtacccaggggtaaggtactatacggtcgagtggctcagtaggcctaactagccactgagtcactataatgactagttatgagcaactacaatgaaacaaacacgagtggtggggataaccctcggatggccactcaaaccactggatcgctatccagtggaccaattaaccagcacacatgtgaactatgttgtaggacatttggtacacgtgccggattgggacaacatgtgagaaaaacccatccaattgagtccaaccaaagcattaatgtagaacgaaagaaaagaagatggtcacctgaagagataagacgtatggcgaatatggaagcccaagctaccataaacaacatcaaacacttaactcaataccttgcaacttaccttcctcaaagaactttgaacgctattaaaggaaggagaagagatgctgagtataaagaactggtgaccggcattatagcaaatcttcggagtaattccagtacacaacaaaccaatcaggtctgtaatgaaagtgaaatgtcacaacgcagtaagatactgcaaagtatacgagaaagcgtacgtgacttgagaagtagacgtaataaatatgcgaaagcattacaagagcttggggaagcagcattgtgcggtaaaatgttgaacgaagaacagctaatacattgtataaagtcaatgttcaacaccgctaagtgtccgaaaggaccaagatttcgcaaaactgcaacccacagtggaacaaataagcaacaacggcaacaacgatatgctagggtgcagaagttgtacaaaatgaaccgaaaggttgccgcaaaaatggtgttagaagaaacggataagatacagataaagttaccggaccatgatccgatgttcaagttttgggaaagtgaatttaaggagggcgaaggcatgccggaaaggatgcccaaggatctgaaggaatcgcccgacttaaaagcgatatgggatccggtaactgaagaggaagttagaaaggcaaaagtggcgaataacaccgcggcaggtcctgatggaattcagccgaaatcatggaacaggataagtttaaaatataagacgttaatatacaacttactcctgtactatgaaaaagttccacataagcttaaggtgtcacgaactgtgtttattcctaagaaaaaagatggatccagtgatcctggtgaattccgacctcttacaatatgttcagtggtccttagaggtttcaataagatccttgtgcagaggcttgtatccctatataaatatgatgaaaggcaaacagcttatttgcctatagatggtgtgggcacgaacatacacgtgcttgcggcgatactcaatgactcgaacacaaaactgagtgaactgcatgtagcgctattggacattacgaaagcattcaatcgcctacatcacacatcgataatcaaatccttagtgggaaaggggttcccttatggatttattactttcatcagaagaatgtatacgggcttacaaacgatgatgcaatttgagggccactgcaaaatgacacaagtgaacagaggagtctaccaaggagaccctttaagcgggccaatctttttgttggctattgaaaaaggcttacaagctcttgataaggaagttggctatgacataggggatgtgagagtcaatgcaggtgcttacgcagatgatacagacttggttgcaggaacgagacttggcttgcaagacaacataaacaggttttcaagtactattaaacaggttggacttgaggtaaatccaagaaagtcaatgacattgtctctggtaccttcggggaaagagaagaaaatgaaagtagaaactggcaaacctttcagagcgaacgatgttcctctgaaggaactgtcaattaatgatttttggagatacctgggcataagctatacgaatgaagggcctgaaagactgagtcttacaatagagcaagatctagaacgcctaactaaagctccattaaagccacaacaacggatacatatgcttaacgcatatgtaatacctaaatatcaagacaaacttgtcttgagtaaaaccacggcaaaagggctgaagcgaacagataggcagataaggcaatatgtaagacgatggctaaagttaccacatgatgttccaattgcatatttgcatgcaccagttaaatctggtggcctaaacattccatgcttgcaatactggataccattacttagagtaaacagagtcaataagattacagaaagtcaacgcagtgtacttgcagcggttggtaaaacagccctgctaacgtcaactgtttataaatgtaatcagtctctagcaacattgggtggaaacccaacaatgcttgcatatcgaacgtattgggaaaaagagctatatgcaaaggtcgatgggaaagacctacaaaatgcgcgggatgataaggcttcgacgaggtggaatggcatgttgcatagtgacattagtggagaagactatttgaattatcataagcttcgaacaaatagtgtacccactaaagtaagaacggcaagaggacgtcctcaaaaggaaacgtcttgcagaggtggttgtaaaagcacggaaacgctgcaacatgtagttcagcagtgtcatagaacacatgggggaagaactctaagacatgacaggattgtgggtcttctccaacatgaactacgccgagactataatgtcttagctaaacaagaactaaaaacgggcatagggttgcgcaaaccggatttagttcttataaaagatgacactgcacacatcgttgacgtgcaagtcgcaaggtgtagtaaactgaatgaaagccatgtaaggaagcgatccaaatacgacaagaaagaaatagaggtagaagtaaaaagtagatatcgtgtaagtaaggtgatgtatgaagcttgcacgatatcatacaaaggtatttgggataagcagagcgtgatgagcatgagaagacttggagtaagtgaatactgtcttttcaagattgtcacatcaacactaagaggaacatggctttgttggaaacggttcaatatgatcactagtgttcgatcatagaaatgtgtgcgataaggtgtgaatagaagggttcaccaagagggagacctagtttggacctcagaaatggggtcataggagtgataggttgtaaagccgttggggaatccggctacacatggtatctcaggagccattcatgcgctgatctcattaaggcgtaataaactgtgaaacagatcctgataatgccgtgctaccaaatgatgtaacgaggcggaaataaaattaatctggggcgttctgcggaatgactactaaatatagcgatgctatatatacaaacgactgatggtaacaccggcctta

SEQ ID NO: 151 - DNA, 3721 bp, Ciona intestinalis
  modified_base (449)..(449): a, c, g, or t
gactctctatggtggtcgccttctcgtggcgagagtcgtaattacctccggcataactgcgagccctcacaaggctggcagggactgcgggagcgaaaccaagaatcaccacgcccgggcgggctaactccctgctcgggtgtaaagcgaaaccaagaatcaccacgcccgggcgggctaactccctgctcgggtgtaaaatattgttacagaaaatacaaataagcaaagggctgcggcctctgccccggctcacaatataaatatgcccggttgccaaagcgtagtgggctcggaatgctcccagtgtgggagagtttttaagaccgcccgcggtttgagcgtacaccggaggagtaagcatcccgaggcataccaccgggaacatatcgccgcccctagagtgaaggctcgttggtccgaggaggagatgattctgatggctcagncggaggtgcaagcgccagcaggtacacggttcatcaaccagtatctgcatgcgctatttccgtctcgatcccttgatgccatcaagggagccagaggcaagtccgcagcttataagaagatcattctggagcagcggcttgcagcgctggtgcctgtaagtcctccaaatcagatcagcggggcggaaagccctagccaaccatccaacacctcccaggaggtaagacaggatcctgaggagaggtctttgagacttcgggacgcgattgacttaggtcacttgcgaaccgacttcgacatgactgcggtgaaccccggtcaccccgacccggtaatacgggaagagattgatcgggagttcctgcgatggctcgaacccaaccggcgcagacgcgggtatgcgaaagcgactcgcattgcactgaacgcgccgggaaaggtgaggcgaagggcggagtacgccgctatgcagcgacaatggaaaaccaagagaggtttgtgcgctagggaggcgctcgaggggacttggaaaatccctgcgagaaccgtctcgcttagtgatcaggaggctttttggaggcccctgatggagagtcagtcaaagaacgatctaagggagccagccaaagtgggggaaaccctatgggggctgttggatcccataacaccggacgaggttcggcagatactgggcagtatgtccagtaaggctccggggccggacggccaccggctgtcggatctcaggtccatccctatcgatcaaatctgcagtcacttcaatctgtggttgctggctggctaccaaccgaaagcgttaaggatgggtgagagctgtctcatcccaaaggtgaaggatgcttctagacctcagcagttccgacccattaccctgggaagctatgtaggcaggtgcctgcacaagtgtctggcatcccgtttcgaacgggatctgcccatttcgatcagacagaaggctttccgatgcatggacggagttgcagagaacgtcatgatcctgaggagtgtcttagacgatcacaagaagcgacttgctgaattgaaccttgtgttccttgatgtaagcaaggcgtttgatagcgtatctcaccgttccatcctacatgctgttaaaaggctgggcgttccgcccccgttactcaaatacgttgaggagctgtacgctgactcggagactttccttcgaggttccggcgaactatcgccctcgattaaagttcgacggggtgtaaagcagggcgaaccgctatccccccacctgttcaatgcagttatagactgggcgctctcgtctctcgaccaatccttcggggttacggtcggagaagcaagggttaatcatctagcttttgcggacgatatagttttactatcatcttcgcaacctggtttacaacgactaatcgatcagctgaccactcacctgggcgagtctggactcagagtgaatagcacaaaatcggcaagcattcggattgcggtcgatggcaagaacaaaaggtgggtggtggatccgcgtgattcagttcacgtcggtggtgtgaggataccggctgtggccgtttcgggctcataccggtacctcggggttaatatctccgccgccgggatgcgggtggatgcagcagacagtctagcaagtaagttggcgaatctctcgagggctcctttaaagccgcagcagcgcctgtacattttatgtactcacctgctaccttcgatctaccatcagctggtactttcgagtactagcaagaaatttctgaagtacctagacaggtgcgtgagggtggcggtccggaggtggctcaggctaccaaaggatacccctaaagcatatttccacgcaaagtgcaatgacggtgggctcggggttcccgagctccagcgggtaataccgcttcaaaaggccggccgttggctgaagatgacgaggtcgcaagatcccgtggtgcaggctgcggtcggactggagtatttccagaaactgttggagcgctggagtacccccgaattatatcagtgggggggggggggcatcaccacaagtgggcacctggccgtcgcacaggctcgatcgctttattcctcagtcaatgggcggggtctgaggcagtcggggcttgtgtcgacccagtttgactgggtgagaagcggctgtagcctactaagtggcagaaactttatcggagcgatgcagctgagaggaaacctgctcgcaactaaattacgtgcctccaggggacgacctagagtggacatatcatgcgattgttgccgtacgccggaatcgtctggccacattcttcaggtctgcccaagaacctcctggggagcgcgtattggccgccatgataacgtggccaaattagtagcgagggagagcgcgaaacgtcattggaaggtgatacgtgagccggccattccaacgccggccggtattcgccgacctgacctcgtgttttcaaaaggggatactgcaatcgtagtcgatgtgacgatcgtgcccgataatgccgagctatcggatgcacacagcagtaaagtatcgtattacgataacggggcgatacgggggtgggtagcccttaatactggggcaagtcacatcacattttcaagcgtcaacaacaattggagcgactgcatggcggaagaatctaagcgaatgctgaaacttggcctcggcctccccaattcaatcagggggacgatctccgcggttgttctggagaaaggcttccacatgtacctctgcttcaagagggggacatttcgagctagctactgatgaagggaagctggattaaaacgtgagtagcaacgggccagaaactctgaggtaagccacctcaatccattatcaaatggcgaaaggcgaaaagagtgggctaccgtaagccgcatggcgccgggtggagaagcagaactccggcccaacgtacgagggcatgaagcccccaaacgtaggatccggggcaaaagcgcacccggcaaaacgaatagccgcaaaagtaggtgtttaggccgggcctcgggcctggccatccttgcaagaaggccaggcactaggtggccgcccgacagccacacggctaagaacaaacaaggcgcctggcgaagacgattaaacacaatcgatcctgatgggtgtgatgaacaccttcataagacatacatataaggatggatcccgccaaggttaagcggtagcttgataactctaaaagctataaaaaaaataaaaaaa

SEQ ID NO: 152 - DNA, 1885 bp, Bacillus rossius
ctccctccactggtctggaggttgcggagatagtagctagcaagtagcgacctctgcgtggttcccgccactagtagtcctagtagggagtaatcctgaaaaggtgaagccaacagctacctctgcgctggtacccggggctggccgccccggaagtttacctcaatgctggctagttctttcaaaaagaagcctcggatggtgagctcgtccaaaagtggcagctcatgtaacgacgcgcccactggtgtcgtcgtgccagcatcgaaggagagtgtcgagtcacccagtcttgacaagaaagttggatatggttgtgaatttcccggctgtcctagggtattcacaaccaagacgggacgtggggtccaccatcgaaaagcccacgaggattggtatgatgcgcgacagaagcttgactacgtgaaagcgcgctggacaagagaggagtcagccctgatggcgcgtgaggaggctaaggctgggacgcaaagtgctaaaaagatgaaccaggtcctgcagttggtcttgccggacaggacactggagtcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcggcttcgcttaattgttcggtcggttgatgactggtcccgggcacgcctgcaccaggagattggttggtttctccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaatggtgccttatagggagagtgtgctgcgttcgggatcgtcttgtactcccggtcaaagaggtcggacagccgagagaactgagttgtgggacccggtgtcctcgaaggaggttgagcatgctcttcctcctctcgggacagcaccgggaccagattcctttacaccaaaggacttcagggcggtgccgtctgctgtttgggcttgcatatttaacatcttcatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtcactcgacgtggccaaggcatttgactctgtgtcgcacgcagccatccttgatgtacttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 153 - DNA, 1885 bp, Bacillus rossius
ctccctccactggtctggaggttgcggagatagtagttagcaagtagcgacctctgcgtggttcccgccactagtagtcctagtagggagtaatcctgaaaaggtgaagccaacagctacctctgcgctggtacccggggctggccgccccggaagtttacctcaatgctggctagttctttcaaaaagaagcctcggatggtgagctcgtccaaaagtggcagctcatgtaacgacgcgcccactggtgtcgtcgtgccagcatcgaaggagagtgtcgagtcacccagtcttgacaagaaagttggatatggttgtgaatttcccggctgtcctagggtattcacaaccaagacgggacgtggggtccaccatcgaaaagcccacgaggattggtatgatgcgcgacagaagcttgactacgtgaaagcgcgctggacaagagaggagtcagccctgatggcgcgtgaggaggctaaggctgggacgcaaagtgctaaaaagatgaaccaggtcctgcagttggtcttgccggacaggacactggagtcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcggcctcgcttaattgttcggtcggttgatgactggtcccgggcacgcctgcaccaggagattggttggtttctccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagcatgctcttcctcctctcgggacagcaccgggaccagattcctttacaccaaaggacttcagggcggtgccgtctgctgtttgggcttgcatatttaacatcttcatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattctcggacatgccagacgtaaccaccgaccggtgcacttggcgtcactcgacgtggccaaggcatttgactctgtgtcgcacgcagccatccttgatgtacttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtaggagatacggtattgaatggaatgg

SEQ ID NO: 154 - DNA, 1885 bp, Bacillus rossius
ctccctccactggtctggaggttgcggagatagtagttagcaagtagcgacctctgcgtggttcccgccactagtagtcctagtagggagtaatcctgaaaaggtgaagccaacagctacctctgcgctggtacccggggctggccgccccggaagtttacctcaatgctggctagttctttcaaaaagaagcctcggatggtgagctcgtccaaaagtggcagctcatgtaacgacgcgcccactggtgtcgtcgtgccagcatcgaaggagagtgtcgagtcacccagtcttgacaagaaagttggatatggttgtgaatttcccggctgtcctagggtattcacaaccaagacgggacgtggggtccaccatcgaaaagcccacgaggattggtatgatgcgcgacagaagcttgactacgtgaaggcgcgctggacaagagaggagtcagccctgatggcgcgtgaggaggctaaggctgggacgcaaagtgctaaaaagatgaaccaggtcctgcagttggtcttgccggacaggacactggagtcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcggcttcgcttaattgttcggtcggttgatgactggtcccgggcacgcctgcaccaggagattggttggtttctccgcgatctcttttggaagccctcgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagcatgctcttcctcctctcgggacagcgccgggaccagattcctttacaccaaaggacttcagggcggtgccgtctgctgtttgggcttgcatatttaacatcttcatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtcactcgacgtggccaaggcatttgactctgtgtcgcacgcagccatccttgatgtacttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 155 - DNA, 1888 bp, Bacillus rossius
  modified_base (895)..(985): a, c, g, or t
ctccctccactggtctggaggttgcggagatagtagttagcaagtagcgacctctgcgtggttcccgccactagtagtcctagtagggagtaatcctgaaaaggtgaagccaacagctacctctgcgctggtacccggggctggccgccccggaagtttacctcaatgctggctagttctttcaaaaagaagcctcggatggtgagctcgtccaaaagtggcagctcatgtaacgacgcgcccactggtgtcgtcgtgccagcatcgaaggagagtgtcgagtcacccagtcttgacaagaaagttggatatggttgtgaatttcccggctgtcctagggtattcacaaccaagacgggacgtggggtccaccatcgaaaagcccacgaggattggtatgatgcgcgacagaagcttgactacgtgaaagcgcgctggataagagaggagtcagccctgatggcgcgtgaggaggctaaggctgggacgcaaagtgctaaaaagatgaaccaggtcctgcagttggtcttgccggacaggacactggagtcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctactggacggtctgcagcccggtccggttgttgatcggcttcgcttaattgttcggtcggtgatgactgggtcccgggcacgcctgcaccaggagattggttggtttctccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggactatggtcgagtccagagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagcatgctcttcctcctctcgggacagcaccgggaccagattcctttacaccaaaggacttcagggcggtgccgtctgctgtttgggcttgcatatttaacatcttcatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtcactcgacgtggccaaggcatttgactctgtgtcgcacgcagccacccttgatgtacttctatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcgatatggttatcgaccgcttgtttactctgttccctcgggatacgggagtatcggtgggagatactgtattgaatggaatgg

SEQ ID NO: 156 - DNA, 1884 bp, Bacillus rossius
gtccctccactagtctggaggttgcggaaatagtagttagcaagtagcgacctctgcgtggttcccgccactagtagccgtagtagggagtaatcctgaaaaggtgaagctaacagctacctctgcgctggtacccggggctggccgccccggaagtgtacctcatgctggctagttcttacaaaaagaagcctcggatggtgagctcgtccaaaagtggcagctcatgtaacgacgcgcccactggtgtcgtcgtgccagcatcgaaggagagtgttgagttacccagtctagacaaagaagttggatatggttgtgaatttcccggctgtcctagggtattcacaaccaagacgggacgtggggtccaccatcgaaaagcccacgaggattggtatgatgcgcgacagaagcttgattacgtgaaagcgcgctggacaagagaggagtcagccctgatggcgcgtgaggaggctaaggctaggatgcaaaatgctaaacatatggaccaggtcctgcagttggtcttgccggacaggacactggattcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcggcttcgcttagttgttcggtcggttgacgactggccccgggcacgcctgcaccaggagattggttggtttttccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagaggtcggacagccgagagaactgagttgtgggacccgatgtcctcgaaggaggttgggctagctcttccccctctcgggacagcaccgggaccagattcctttacaccaaaggacttcagggcggtgccgtctgctgtttgggcttgcatatttaacatctttatgctgtgtggccgactcccggattacctccttgagtcgcgcaccacactgataccaaagagagacagtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtaacagtgggagatactgtattgaatggaatgg

SEQ ID NO: 157 - DNA, 1884 bp, Bacillus rossius
gtccctccactagtctggaggttgcggagatagtagttagcaagtagcgacctctgcgtggttcccgccactagtagccgtagtagggagtaatcctgaaaaggtgaagctaacagctacctctgcgctggtacccggggctggccgccccggaagtgtacctcatgctggctagttcttacaaaaagaagcctcggatggtgagctcgtccaaaagtggcagctcatgtaacgacgcgcccactggtgtcgtcgtgccagcatcgaaggagagtgttgagttacccagtcttgacaaagaagttggatatggttgtgaatttcccggctgtcctagggtattcacaaccaagacgggacgtggggtccaccatcgaaaagcccacgaggattggtatgatgcgcgacagaagcttgattacgtgagagcgcgctggacaagagaggagtcagccctgatggcgcgtgaggaggctaaggctaggatgcaaaatgctaaacatatggaccaggtcctgcagttggtcttgccggacaggacactggattcaataaagagcaacaggagatcggcacagtacaaggaactggtcctgcaggcaatgggtgccttgtcggattcagggaaatgtgctggcccctcccaattagcaaatgctgagcttagtactcctctttcctcggcggtgctgggaaccggtgaaccgggtggtgggggatccggtgagcatgggtcgggtgatgtgccaggcagttcccgtggggaacatctgagtgcgctgctggacggtctgcagcccggtccggttgttgatcggcttcgcttagttgttcggtcggttgacgactggtcccgggcacgcctgcaccaggagattggttggtttctccgcgatctcttttggaagcccttgaccccaaacctggctagggtgtcacttccatctaaagacaaggtgtcacggcgcaaactcaggcgggcggactatggtcgagtccaaagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtaatggtgggagatactgtattgaatggaatgg

SEQ ID NO: 158 - DNA, 1884 bp, Bacillus rossius
gtccctccactagtctggaggttgcggagatagtagttagcaagtagcgacctctgcgtggttcccgccactagtagccgtagtagggagtaatcccgaaaaggtgaagctaacagctacctctgcgctggtacccggggctggccgccccggaagtgtacctcatgctggctagttcttacaaaaagaagcctcggatggtgagctcgtccaaaagtggcagctcatgtaacgacgcgcccactggtgtcgtcgtgccagcatcgaaggagagtgttgagttacccagtcttgacaaagaagttggatatggttgtgaatttcccggctgtcctagggtattcacaaccaagacgggacgtggggtccaccatcgaaaagcccacgaggattggtatgatgcgcgacagaagcttgattacgtgaaagcgcgctggacaagagaggagtcagccctgatggcgcgtgaggaggctaaggctaggatgcaaaatgctaaacatatggaccaggtcctgcagttggtcttgccggacaggacactggattcaataaagagcaacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcggcttcgcttagttgttcggtcgggtgacgactggtctcgggcacgcctgcaccaggagattggttggtttctccgcgatctcttttggaagcccttgaccccaaacctggctagggtgtcactcccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaatggtgccttattgggagagtgtgctgcgctcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtaacggtgggagatactgtattgaatggaatgg

SEQ ID NO: 159 - DNA, 1782 bp, Bacillus rossius
ggtgaagctaacagctacctctgcgctggtacccggggctggccgccccggaagtgtacctcatgctggctagttctttcaaaaagaagcctcggatggtgagctcgtccaaaagtggcagctcatgtaacgacgcgcccactggtgtcgtcgtgccagcatcgaaggagagtgttgagttacccagtcttgacaaagaagttggatatggttgtgaatttcccggctgtcctagggtattcacaaccaagacgggacgtggggtccaccatcgaaaagcccacgaggattggtatgatgcgcgacagaagcttgattacgtgaaagcgcgctggacaagagaggagtcagccctgatggcgcgtgaggaggctaaggctaggatgcaaaatgctaaacatatggaccaggtcctgcagttggttttgccggacaggacactggattcaataaagagccacaggagatcggcacagtacaaggaactggtcctgcaggcaatgggtgccttgtcggattcagggaaatgtactggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcggcttcgcttaattgttcggtcggttgacgactggtcccgggcacgcctgcaccaggagattggttggtttctccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagtgtcagcaccacccgaagaactaatggtgccttattgggagagtgtgctgcgttcgggatcgtcttgtactcccggtcaaagaggtcggacagccgagagaacagagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagggggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtaacggtgggagatactgtattgaatggaatgg

SEQ ID NO: 160 - DNA, 1782 bp, Bacillus rossius
ggtgaagctaacagctacctctgcgctggtacccggggctggccgccccggaagtgtacctcatgctggctagttctttcaaaaagaagcctcggatggtgagctcgtccaaaagtggcagctcatgtaacgacgcgcccactggtgtcgtcgtgccagcatcgaaggagagtgttgagttacccagtcttgacaaagaagttggatatggttgtgaatttcccggctgtcctagggtattcacaaccaagacgggacgtggggtccaccatcgaaaagcccacgaggattggtatgatgcgcgacagaagcttgattacgtgaaagcgcgctggacaagagaggagtcagccctgatggcgcgtgaggaggctaaggctaggatgcaaaatgctaaacatatggaccaggtcctgcagttggttttgccggacaggacactggattcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcggcttcgcttaattgttcggtcggttgacgactggtcccgggcacgcctgcaccaggagattggttggtttctccgcaatctcttttggaagcccttgacccctaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagtgtcagcaccacccgaagaactaatggtgccttattgggagagtgtgctgcgttcgggatcgtcttgtactcccggtcaaagaggtcggacagccgagagaactgagttgtgggacacggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattctcggacatgccagacgtaaccaccgaccggtgcacttggcgtctctcgacgtggccaaggcatttgactctgtgtcgcacgcagccatccttgatgtacttcgatcatttggagtcccggatcaaatggttgagtacattgcgtctgtgtatgcaggatccaggactcggctccagggtgatgggtggcaatcccatgctattcaccccacttgtggggtgaagcagggtgacccgctctcacctatgatattcaatatggttatcgaccgcttgtttgctctgttccctcgggatacgggagtaacggtgggagatactgtattgaatggaatgg

SEQ ID NO: 161 - DNA, 1779 bp, Bacillus rossius
ggagaagctaacagctacctctgcgctggtacccggggctggccgccccggaagtgtacctcatgctggctagttctttcaaaaagaagcctcggatggtgagctcgtccaaaagtggcagctcatgtaacgacgcgcccactggtgtcgtcatgccagcatcgaaggagagtgtcgagttacccagtcttgacaaagaagttggatatggttgtgaatttcccggctgtcctagggtattcacaaccaagacgggacgtggggtccaccatcgaaaagcccacgaggattggtatgatgcgcgacagaagcttgattacgtgaaagcgcgctggacaagagaggagtcagccctgatggcgcgtgaggaggctaaggctaggatgcaaaatgctaaacatatggaccaggtcctgcgttggttttgccggaaggaactggattcaataaagagccacaggagatcggcacagtacaaggaactggtcctgcaggcaatgggtgccttgtcggattcatggaaatgtgctggcccctcccaattagcaaatgctgagcttactactcctctttcctcggcagtgctgggaaccggtgaaccgggtggtgggggatccggtgagcatgggtcgggtgatgtgccaggcagttcccgtggggaacatctgagtgcgctgctggacggactgcagcccggtccggttgttgatcggcttcgcttaattgttcggtcggatgacgactggtcccgggcacgcctgcaccaggagattggttggtttttccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagtgtcagcaccacccgaagaactaatggtgctttattgggagagtgtgctgcgttcgggatcgtcttgtactcccggtcaaagaggtcggacagccgagagaactgagttgtgggacccggtgtcctcgaaggaggttgagctagctcctcctcctctcgggacagcaccgggaccagattcctttacaccaaaggacttcagggcggtgccgtctgttgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagggggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttgctctgttccctcgggatacgggagttacagggggagatactgtattgaatggaatgg

SEQ ID NO: 162 - DNA, 1782 bp, Bacillus rossius
ggcgaagctaacagctacctctgcgctggtacccggggctggccgccccggaagtgtacctcatgctggctagttctttcaaaaagaagcctcggatggtgagctcgtccaaaagtggcagctcatgtaacgacgcgcccactggtgtcgtcgtgccagcatcgaaggagagtgttgagttacccagtcttgacaaagaagttggatatggttgtgaatttcccggctgtcctagggtattcacaaccaagacgggacgtggggtccaccatcgaaaagcccacgaggattggtatgatgcgcgacagaagcttgattacgtgaaagcgcgctggacaagagaggagtcagccctgatggcgcgtgaggaggctaaggctaggatgcaaaatgctaaacatatggaccaggtcctgcagttggttttgccggacaggacactggattcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcggcttcgcttaattgttcggtcggttgacgactggtcccgggcacgcctgcaccaggagattggttggtttctccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagtgtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtggcccgctctcacctatgatattcaatatggttatcgaccgcttgtttgctctgttccctcgggatacgggagtaacggtaggagatactgtattgaatggaatgg

SEQ ID NO: 163 - DNA, 1782 bp, Bacillus rossius
ggtgaagctaacagctacctctgcgctggtacccggggctggccgccccggaagtgtacctcatgctggctagttctttcaaaaagaagcctcggatggtgagctcgtccaaaagtggcagcgcatgtaacgacgcgcccactggtgtcgtcgtgccagcatcgaaggagagtgttgagttacccagtcttgacaaagaggttggatatggttgtgaatttcccggctgtcctagggtattcacaaccaagacgggacgtggggtccaccatcgaaaagcccacgaggattggtatgatgcgcgacagaagcttgattacgtgaaagcgcgctggacaagagaggagtcagccctgatggcgcgtgaggaggctaaggctaggatgcaaaatgctaaacatatggaccaggtcctgcagttggttttgccggacaggacactggattcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaccggtgaaccgggtggtgggggatccggtgagcatgggtcgggtgatgtgccaggcagttcccgtggggaacatctgagtgcgctgctggacggtctgcagcccggtccggttgttgatcagcttcgcttaattgttcggtcggttgacgactggtcccgggcacgcctgcaccaggagattggttggtttctccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagtgtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtatattgcatctgtgtatgcaggatccaggactcggctccagggtgatgggtggcaatcccatgctattcaccccacttgtggggtgaagcagggtgacccgctctcacctatgatattcaatatggttatcgaccgcttgtttgctctgttccctcgggatacgggagtaacggtgggagatactgtattgaatggaatgg

SEQ ID NO: 164 - DNA, 4718 bp, Rhynchosciara americana; identical to SEQ ID NO: 150

SEQ ID NO: 165 - DNA, 3566 bp, Eyprepocnemis plorans
tgactcccaaatgctcgcctgatgcgcaatatatgggccctctcgttccacccctcagcgtctgtgtgataccgggtggatgatggtccgcttagcctctcggtgttgaaatcctagctctggccttcacgtggcgggggtcgtcttcgactgacagagcggggtgtttttcaggcctgggggctaccaccccccttgcccgagttatggttggtccgactacaagaagcaagaagggtaccgggcctcccactggagcgtccgtgccaaccaccgagtcggccagccagtcttccggtgcgggtcgagcgctgctccccgcctcttgcccactgtgccagaggtcctttaccaccgtcaatggactcggacagcatcgtcgtcgtgcccatccagaagtcgtcaatgcagaaatccagacggaccggaagaaagccaggtggtccaaggaggaattgatgcgcctggctcatgctgaggcaaggctggttattgagggttgcagattccttaatcaagaactcctgaagtcttttcccgaccggacgttggactctattaagggccagcgcaaggggaaggcatatagggaatctgtagcctcttttgtaagccagctgaggtcttctgttgcctctgccggaccgtcgggtgcgtcgccagttgcagaagagcctttgcctggatcaccttctgtttctcaagatgatgaggttgatgctgcaatctggtcggctcttgccgacttaccctcatcaggttcgcgcttcaagctggtggatgatattgtggctctcggtcccaataccagcagggatattgtaagatctatgctcccgagtgctttggatgcagttgggagtaaggagcctgctgctcatcctcctcttccctttggagcccgtcgaccacctgacaagaagcgtgctcggcgccggtgggaatatgcggctgtccagcgggcgtttcgcaagaatgctgctcgctgtgtaaacggtctccttgatgggacgctcctccaccaaccgccttccatccctggtttggtggagttttggaaggacttgtttactgctccttgtgcgtcatctcgtccgaggagcaaggagggtctttcacccatgttgttggcgtcatcacaaccggtgtccttccgtgatctgtgggcaccgattacatccgaggaggctgctgccgctctccctccgcgtaattctgctgctgggcctgatgcgcttacacctgcccaactgcgtcgcctaccacatcctgtgtttcttaagatcctcaacctgttccttctcgcccgctcccttccttcccgtctcctgcgggcgagaaccaccctactccctaagaagacgtcaccagcatcccccgctgatttccgaccaataacagtgtgttcggtgctcgctagggcctttcataaggtcctggctgggcgtctcatgcgctactgtgtgttggacgggcgtcagcgggcattcatcccccaggatgggatgttacataacagctttttattggatctggcgatggcccactcccggaggactgcctgctcgctgtatgtggcgtccctggacgtctcgaaggccttcgactcgttggatcatggtgctctcagccctgtgctgagagcccatggtctaccggtcgagttcgtcgagtacgttcgggggtgctaccaggcgagtacgacggttatctgtgggggtgggtcgtcatcagatcttgtgcggccttcgaagggagtgcgtcagggtgatccattatctcctatcctgttcaacctctccattgatcttctcctttcccgtctccctgggtatattggcgcccgcatttttagtcggcgtgttaatgctgctgcgtttgccgacgatatcctcttgtttgccgagacgaaggggggtctgcaggaacttctctccaccgccacgtcggctttgggggaccttggtcttgaggtcaatccctttaagtgcttttctctcgctctggtggcwtcagggcgagagaagaaggtgaaggtcgacaacagtgtcatctttcgcgctggtaataagaacattccggcactggcgatgggagatacctttcggtatttgggcctgcagttttctacgtctggccttagtcagttccacccacgacaagaggttcaggagcagctggacatcattaagcgggcaccactcaaaccccaacagagacttttcgccctccgctctgtcatcctgccgggtacttatcacggcctggccctgggccggactcgtctgggtgccttgaagtcccttgatgtctgcgtgcgtgcagccgtgagagcctggctgcgcctgcctgacgacacgcctatagggtattttcatgctcctgttatctatggagggctgggaatcccagctacccgatggctaggccccttgctgaggaggaggcgtctggcgagcatggagggacttggggtgattgtggatgagccatcccaggatatccttaaacgtgagatctgtcgtcttgataattacctcaagtgggatggcgacgttattaagaccagttaccagcttggtcgtttttgggctcttcgcctccactcgtcggtggatggtgctgccctccgcaggtcagcccagacgccaggacagcacagttgggtgtctaacacccggcttatgctgagtggccgtgactttctcgcctgtgttcgtgctaggattagtgctctaccatctcgagcacgtctcctgcggggaagggaaggtgacaccagatgccgggctggctgtaatgcctctgagaccaacaaccatgttatccagcactgttggcggagccatgaagcacgagtcgagcgccatgatgcggtggcgctgtacatggtgcggggtcttcgccggagaggctatgatgtccatcgggaactgcacttgaggacttcccagggcctgaagaagcctgacattgtagctgtcagtggcaccacagcttttgtcatcgatgcccaggtgattggtgatcaccttgatgctgatagatgtcatagggagaaagttgaagtgtacgaccagcaacctgtgcacacggagatcaagcgcatgttccctgaggtccagatgattacaacaacttcggcgacgctcaactggcgtggagtgtggtcgccagcctctgcgaaggcgctcattggaattggctttaatagtaaccacctttcgacgatggctacaagggcgctactgggcagtataatggcggcgcggcgtttcgactctatgactgcccctcgccgccgcatgatgccccgcactggagttggctgagttcgaactcgttttattttgcgttgctgcctggcgcgataacaggcataatccctgctttgtttccatgtgattacctagttatgtttaagatcctttgtaaacctgttctgcaggtgtatttataactaggaatttttgtgaacatcttttgtgaacctggttaacaggtcctcattattattattattattgtacttgtgttattcacatggtgaataaagccggctttta

SEQ ID NO: 166 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcgggcgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtttactgaagcctgactctgtcatccttcatgacgcgtttactgcggtagtcgttgatgctttggtggctggagaaaggtcggatttagaccgagagcacgaccgtaaggtcagcaagtatgaaccactggaggatttagtaaaagaccggtattttgttgagaaggtgattttctcttccctcacaatcagtgcgcgtggtgtgtggggaggaaaatcctttaagcatctatcaaaactgagactgcttggcatttctgatgccaagatcctgtcaacccgagttcttcttggggggatgggggctgtgcgtgtgtttaatcgccgtacagctgtaggtgggagggtcaatggctggtga

SEQ ID NO: 167 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtttactgcggtagtcgttgatgctttggtggctggagaaaggtcggatttagaccgagagcacgaccgtaaggtcagcaagtatgaaccactggaggatttagtaaaagaccggtattttgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 168 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatttagtaaaagaccggtattttgttgagaaggtgattttctcttccctcacaatcagtgcgcgtggtgtgtggggaggaaaatcctttaagcatctatcaaaactgagactgcttggcatctttgatgccaagatcctgtcaacccgagttcttcttggggggatgggggctgtgcgtgtgtttaatcgccgtacagctgtaggtgggagggtcaatggctggtga

SEQ ID NO: 169 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcaccccttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactacttggcatctctgatgccaagatcctgtcaacccgagttcttcttggggggatgggggctgtgcgtgtgtttaatcgccgtacagctgtaggtgggagggtcaatggctggtga

SEQ ID NO: 170 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtttactgcggtagtcgttgatgctttggtggctggagaaaggtcggatttagaccgagagcacgaccgtaaggtcagcaagtatgaaccactggaggatttagtaaaagaccggtattttgttgagaaggtgattttctcttccctcacaatcagtgcgcgtggtgtgtggggaggaaaatcctttaagcatctatcaaaactgagactgcttggcatctttgatgccaagatcctgtcaacccgagttcttcttggggggatgggggctgtgcgtgtgtctaatcgccgtacagctgtaggtgggagggtcaatggctggtga

SEQ ID NO: 171 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtgcgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagattgcttggcatctctgatgccaagatcctgtcaacccgagttcttcttggggggatgggggctgtgcgtgtgtttaatcgccgtacagctgtaggtgggagggtcaatggctggtga

SEQ ID NO: 172 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgccgccaggcgggatgtgacagcattgagacattacatcatgtgctgcggcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtttactgcggtagtcgttgatgctttggtggctggagaaaggtcggatttagaccgagagcacgaccgtaaggtcagcaagtatgaaccactggaggatttagtaaaagaccggtattttgttgagaaggtgattttctcttccctcacaatcagtgcgcgtggtgtgtggggaggaaaatcctttaagcatctatcaaaactgagactgcttggcatctttgatgccaagatcctgtcaacccgagttcttcttggggggatgggggctgtgcgtgtgtttaatcgccgtacagctgtaggtgggagggtcaatggctggtga

SEQ ID NO: 173 - DNA, 1040 bp, Bacillus rossius
gactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtgcccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtttactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctttgatgccaagatcctgtcaacccgagttcttcttggggggatgggggctgtgcgtgtgtttaatcgccgtacagctgtaggtgggagggtcaatggctggtga

SEQ ID NO: 174 - DNA, 1042 bp, Bacillus rossius
acgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtgggtggagaaaggtcggatttagaccgagagcacggccgtaaggtcagcaagtatgaaccactggaggatatagtaaaagaccggtattctgttgagaaggtgattttctcttccctcacaatcagtgcgcgtggtgtgtggggaggaaaatcctttaagcatctatcaaaactgagactgcttggcatctttgatgccaagatcctgtcaacccgagtttttcttggggggatgggggctgtgcgtgtgtttaatcgccgtacagctgtaggtgggagggtcaatggctggtga

SEQ ID NO: 175 - DNA, 1044 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctccttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttagggagtctaagcaggtggagggccagcatcggtggattactgatgggtctctcatgttgtcgggtcgtgactacattgctagcaatagggtcaggataaatgccatcccgctctcgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 176 - DNA, 1044 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatccgctcgcttacaggatcatggtacgaccatcagtacccgtaatgcctacagagctcgctttgctaggctattacatacctccaaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtacgaaccactggaggatctagtaaaagaccggtattctgttgagaaggtgattttctcttccctcacaatcagtgcgcgtagtgtgtggggaggaaaatcctttaagcatccatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 177 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagcctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcacgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaagtcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 178 - DNA, 1044 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtcccttcgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 179 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagcccgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgaggcattacatcatgtgctgcagcaatgtcatcggacccatgacatgcgaatcaaaaggcatgatgcatgtgtgaagtacttactagatcgccaatgctctcgtggtaaaacggtatttttggaaccgcatttccacacggcaggaggtttactgaagcctgactctgtcatccttcatgacgcgtttactgcggtagtcgttgatgctttggtggctggagaaaggtcggatttagaccgagagcacgaccgtaaggtcagcaagtatgaaccactggaggatctagtaaaagaccggtattttgttgagaaggtgattttctcttccctcacaatcagtgcgcgtggtgtgtggggaggaaaatcctttaagcatctatcaaaactgagactgcttggcggttttgatgccaagatcctgtcaacccgagttttttttggggggatgggggctgtgcgtgtgtttaatcgccgtacagctgtaggtgggagggtcaatggctggtga

SEQ ID NO: 180 - DNA, 1044 bp, Bacillus rossius
aacgactatcagttcgttgaataggcttgatattgcggttcggtccactgtgcgcaagtggctaaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaatggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 181 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcccgaacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 182 - DNA, 1048 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagcgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggaaggccagcatcggtggattactgatgggtctctcatgttgtcgggtcgtggctacattgctagcaatagggtcaggataaatgccatcccgctccgaaagcggactgctcgcggacgtgtccgtgacacccgctgccaggcgggatgtgacagcattgaagacattacatcatgtgctgcagcaaatgtcatcggacccatgacatgcgaatcaaaaggcatgatgacatgtgtgaagtactttactagatcgccaatgctctcgtggtaaaacggtattcttgggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattttgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 183 - DNA, 1039 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgcccgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcacgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 184 - DNA, 1042 bp, Bacillus rossius
aacgactatcagttcgtgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacgcccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggcaggtga

SEQ ID NO: 185 - DNA, 1028 bp, Bacillus rossius
gttgaataggcttgatattgcggttcggtccactgtgcgcaagtggctgaacctaccgcattatgtgcccaacgcgtatattcacgttgacgctcgggatggaggcctttccattccctcctattgttggacagtccccctgcaccgcctccataggctgaaggctctttccgtccctttgtggcgagggagggcccgatgaaatggttgcgagtgtgggggaagagatcaggcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatggaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 186 - DNA, 1040 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 187 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatttagtaaaagaccggtattctgttgagaaggtgattttctcttccctcacaatcagtgcgcgtggtgtgtggggaggaaaatcctttaagcatctatcaaaactgaggctgcttggcaactctgatgccaagatcctgtcaacccgagttcttcttggggggatgggggctgtgcgtgtgtttaatcgccgtacagctgtaggtgggagggtcaatggctggtga

SEQ ID NO: 188 - DNA, 1043 bp, Bacillus rossius
aacgactatcagttcgttgaataggcttgatattgcggttctgtccactgtgcgcaagtggctgaacctaccgcattatgtgcccaacgcgtatattcacgctgacgctcgggatggaggcctttccattccctcctattgttggacagtccccccgcaccgcctccataggctgaaggctcttcccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatggcatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttggtgctttggtggctggagaaaggtcggatttagaccgagagcacgaccgtaaggtcagcaagtatgaaccactggaggatttagtaaaagaccggtattccgttgagaaggtgattttctcttccctcacaatcagtgcgcgtggtgtgtggggaggaaaatcctttaagcatctatcaaaactgagactgcttggcatctttgatgccaagatcctgtcaacccgagttcttcttggggggatgggggctgtgcgtgtgtttaatcgccgtacagctgtaggtgggagggtcaatggctggtga

SEQ ID NO: 189 - DNA, 1042 bp, Bacillus rossius
aagactatcagttcgttgaataggcttgatattgcggttcggtccactgtgcgcaagtggctgaacctaccgcattacgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactccttggcatctctgatgccaagatcctgtcaacccgagttcttcttggggggatgggggctgtgcgtgtgtttaatcgccgtacagctgtaggtgggagggtcaatggctggtga

SEQ ID NO: 190 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcatcgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcagactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctttgatgccaagatcctgtcaacccgagttcttcttggggggatgggggctgtgcgtgtgtttaatcgccgtacagctgtaggtgggagggtcaatggctggtga

SEQ ID NO: 191 - DNA, 1044 bp, Bacillus rossius
  modified_base (686)..(686): a, c, g, or t
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctntctgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattttgttgagaaggtgattttctcttccctcacaatcagtgtgcgtggtgtgtggggaggaaaatcctttaagcatctatcaaaactgagactgcttggcatttttgatgccaagatcctgtcaacccgagtttttcttggggggatgggggctgtgcgtgtgtttaatcgccgtacagctgtaggtgggagggtcaatggctggtga

SEQ ID NO: 192 - DNA, 1048 bp, Bacillus rossius
  modified_base (630)..(630): a, c, g, or t
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagggatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggccgtgactgcattgctagcaatagggtcaggataaatgccatcccgctccgaaagcggactgctcgcggacgtgtccgtgacacccgctgccaggcgggatgtgacagcattgagacattacatcatgtgctgcaggcatgtcatcggaacccatgacatgcggaattcaaaagcaatgatgcatttgtgaagtacttactagatcgcnaatgcttttcgtggtaaaacggtattttttggaaccgcatttccacagggcagaaggtttactgaagcctgattctttcttccttcatgaggcttttattgcggtagtggttgatgctttggtggctggagaaagttcggatttagacggagagcacgaccgtaagttcagcaagtatgaaccactggaggatttagtaaaagaccggtattttgttgagaaggggattttttcttccctcccaaccagtgggggggggggggggggaggaaaatcctttaagcatttttcaaaattgagattgcttggcatttttgatgccaagatcctgtcaacccgagttttttttggggggatgggggctgtgcgtgtgtttaatccccgtccagctgtaggtgggagggccaatggctgggga

SEQ ID NO: 193 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 194 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggacttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 195 - DNA, 1043 bp, Bacillus rossius
  modified_base (940)..(940): a, c, g, or t
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctntgatgccaagatcctgtcaacccgagttcttcttggggggatgggggctgtgcgtgtgtttaatcgccgtacagctgtaggtgggagggtcaatggctggtga

SEQ ID NO: 196 - DNA, 1043 bp, Bacillus rossius
aacgactatcagttcgttgaataggcttgatattgcggttcggtccactgtgcgcaagtggctgaacctaccgcattatgtgcccaacgcgcatattcacactgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggttgattactgatgggtctctcatgttgtcgggtcgtgactacattgctagcaatagggtcaggataaatgccatcccgccccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcatctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgtgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 197 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgcccctttgtggcgagggagggcccgatgaaatggttgcgcgtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacaccatgtgctgcagcaaggtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 198 - DNA, 1042 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgacggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagatggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtggagggtcaatggctggtga

SEQ ID NO: 199 - DNA, 1044 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtgcccgtaatgcctacagagctcgctttgctaggctattacatacctccaaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatccctgatgccaagatcctgtcaacccgagttcctcttggggggatgggggctgtgcgtgtgtttaatcgccgtacagctgtaggtgggagggtcaatggctggtga

SEQ ID NO: 200 - DNA, 1043 bp, Bacillus rossius; identical to SEQ ID NO: 193

SEQ ID NO: 201 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaagctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgctgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 202 - DNA, 1044 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaagggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatctagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 203 - DNA, 1044 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaggcgtgcatctgctcgcttacaggatcatggtacgaccatcagtacccgtaatgcctacagagctcgctttgctaggctattacatacctccaaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagcgcgcgtggtgtgtggggaggaaaatcctttaagcgtctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 204 - DNA, 1044 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccaccagtacccgtaatgcctacagagctcgctttgctaggctattacatacctccaaacgatggagcacctcttaaggagtctaagcaggtggagggccagcatcggtggattaccgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagagaggtcggatttagaccgagagcacgaccgtaaggtcagcaagtatgaaccactggaggatctagtaaaagaccggtattccgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 205 - DNA, 1043 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgggaaggtgattttctcttccctcacaatcagtgcgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggagggtcaatggctggtga

SEQ ID NO: 206 - DNA, 1047 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatccgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcaatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgggggggggggaaggatcctttaagcatctatcaaagctgagactgcttgacatctctgatgccaaggtcctgtcaacccgggttctgctcgggggggatgggggctgtacatgtgtttaatcgccgtacagctgtaagcgggagggtcaatcgctggtga

SEQ ID NO: 207 - DNA, 1040 bp, Bacillus rossius
aacgactatcaattcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcatggtaaaacggtattcttggaaccgcatttccacacggcagaaggtctactgaagcctgattctgtcatccttcatgaccgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaacccgagttcttcttgggggatgggggctgtgcgtgtgtttaatcgccgtacagctgtaggtgggagggtcaatggctggtga

SEQ ID NO: 208 - DNA, 1043 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctccccattccctcctatcgttggacagtcccccggctccgtttccataggctgaaggcgctctctgtcctttgtgacgggggaggtccggatgaaatggttgcgtgtgttggggatgagatcaagcgagcttcggctcgtttacaagatcatggtatggacatcaatacccgtaatacctacagagttcgctttgctaggttattacatacctccaacgatggagcacctcttaaggggcctaagaaggtggagggccagcatcggtgggttaccgatgggtctctcatgctgtcgggtcgtgactacattgcttgcaattgggtcaggatcaactcaatcccgctccgaaagcggattgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcctcacctccctcatcatcagtgcgcgtggtgtgtggggggggaagatcctttaagcatctatcaaagctgagactgcttgacatctctgatgccaaggtcctgtcaacccgggttctgctcggggggatgggggctgtacgtgtgtttaatcgccgtacagctgtaagtgggagggtcaatggctggtga

SEQ ID NO: 209 - DNA, 1041 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgtttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcattggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtggggggaagatcctttaagcatctatcaaagctgagactgcttgacatttctgatgccaaggtcctgtcaacccgggttctgctcggggggatgggggctgtacgtgtgtttaatcgccgtacagctgtaagtgggagggtcaatggctggtga

SEQ ID NO: 210 - DNA, 1044 bp, Bacillus rossius
  modified_base (972)..(972): a, c, g, or t
aacgactatcagttcgttgaataggcttgacattgcgtttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgtttacaagatcatggtatgaacatcaataccccgtaatacctacagagttcgctttgctaggttattacatacctccaaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgacgctttggtggctggagagaggtcggatttagaccgagagcacgaccataaggtcagcaagtatgaaccactggcggatctagtaaaagaccggtactctgtcgataaagtgatcttcacctcccccatcatcagtgcgcgtggtgtgtggggggaagatcctttaagcatctatcaaagctgagactgcttgacatctctgatgccaaggtcctgtcaacccgggttctgnctcggggggatgggggctgtacgtgtgtttaatcgccgtacagctgtaggtgggagggtcaatggctggtga

SEQ ID NO: 211 - DNA, 975 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggcctcgtttccataggctgaaggcgctctctgtcctttgtgacgggggaggtccggatgaaatggttgcgtgtgttggggatgagatcaagcgagcttcggctcgtttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcctcacctccctcatcatcagtgcgcgtgtgtgggggggggggaaagatcctttaagcatctatcaaagctgagactgcttgacatctctgatgccaaggtcctgtcaacccgggttctgctc

SEQ ID NO: 212 - DNA, 1042 bp, Bacillus rossius
aacgactatcagttcgttgaataggcttgacattgcggttcggtctactgtgcgcaagtggctgagcctgccgcatgatttgcccaaacggtacattcagggtgacgttccggatcggggtctctccattcccttccttcggtggacagtcccctggttccgtttccataggctgaaggcgctctctgtcctttgtgacgggggaagtccggatgagatggttgcgtgggttggggatgagatcaagcgagcttcggctcgcttacaagatcatggtatgaacatcaatacccgtaatacctacagagttcgttttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacctgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactccgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtggtcttcacctccctcatcatcagtgcgcgtggtgtgtgggggggaagatcctttaagcatccatcaaagctgagactgcttgacatctctgatgccaaggtcctgtcaacccgggttctgctcggggggatgggggctgtacgtgtgtttaatcgccgtacagctgtaagtgggagggtcaatggctggtga

SEQ ID NO: 213 - DNA, 1042 bp, Bacillus rossius
aacgactatcagttcgttgaataggcttgacattgtggttcgggccaccgtgcgtaagtagctggccttgccgcatgatgtacccaacgcatacatccatgctgacgcttgggatgggggtctctccattccctcttatctttggagcgttcccctgcagcgcttccataggctggaggcgctttccctgctctgcagtgagactgggccggaggacatggttgcgtctgtgggggacgagatcacacgggcaaccgcccgtctgaatgatcatggtacgaccgtcagtacccgtaatgcctacagagctcgctttgctaggttattacatacctcccaatgatggagcacctttaaaagggtcgaagcaggtggagggccagcaccgttggattaccgatgggtcgctcatgttgtctggtcgtgattttattgcatgcaacaggatcaggaccaatgccattccgctgaggaagcgatgtgctagaagacgagaccatgacactcgttgccgtgcgggatgcgacaacacggagacattacatcatgtgctgcagcaatgtcataggacccatgatgcaagaatcaacagacacgatgcatgtgtgaagtacctactagatcggcaacgctctcgcggcaaaaatgttgacagggaaccacatttccgcacggcagatggtcttttgaagcctgactcagtcatcctttatgacgcgtctactacggtagtcgttgatgctttggtggccggtgagagggctgatctagaccgagagcatgaccgtaaggtccagaagtatgcaccattggccgatctagttaaggcagtgtactctgtcgaaaaggtggtcttctcttccctcacaatcaatgcatggggggtgtggggaggaagatcattgaggagtctatcaaagccaggactgcttagtgtctctgatgctagggtcctgtcaactcgagttctgctcggggggcaggggctgtacatgtgtttcatcgccgtacaggaatcggtgggagagcttatgtctggtga

SEQ ID NO: 214 - DNA, 976 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgagatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactccgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtgggggggaagatcctttaagcatctatcaaagctgaaactgcttgacatctctgatgccaaggtcctgtcaacccgggttctgctcggg

SEQ ID NO: 215 - DNA, 987 bp, Bacillus rossius
aacgactatcagttcgttgaataggcttggcattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgagatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactccgtcatccttcatgacgcgtctactgcggtagttgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtgggggggaagatcctttaagcatctatcaaagctgagactgcttgacatctctgatgccaaggtcctgtcaacccgggttctgctcggggggatgggggc

SEQ ID NO: 216 - DNA, 1039 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccatttccataggctgaaggcgctctctgtcctttgtgacgggggaggtccggatgagatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattcttggaaccgcatttccacacggcagaaggtctactgaagcctgactctgtcatccttcatgacgcatctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgtgcgtggtgtgtggggaggaaaatcctttaagcatctatcaaaactgagactgcttggcatctctgatgccaagatcctgtcaacccgagttcttcttggggggatgggggctgtgcgtgtgtttaatcgccgtacagctgtaggtgggaggtcaatggctggg

SEQ ID NO: 217 - DNA, 1024 bp, Bacillus rossius
aacgactatcagttcgttgaataggcttgacattgcggttcggtccactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagggcacggccataaggtcagcaagtatgaaccactggcggatctagtaaaagaccggtactctgtcgataaagtgatcttcacctccctcatcatcagtgcgcgtggtgtgggggggggggaagatcctttaagcatctatcaaagctgagactgcttgacatctctgatgccaaggtcctgtcaacccgggttctgctcgggggggatggggggctgtacgtgtgtttaatcgccgtacagctgtaag

SEQ ID NO: 218 - DNA, 1045 bp, Bacillus rossius
aacgactatcagttcgttgaataggcttgacattgcggttcggtccactgtgcgcaggtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtggggggggaagatcctttaagcatctatcaaagctgagactgcttgacatctctgatgccaaggtcctgtcaacccgggttctgctcgggggggatgggggcctgtacgtgtgtttaatcgccgtacagctgtaagtgggagggtcaatggctagtga

SEQ ID NO: 219 - DNA, 1023 bp, Bacillus rossius
aacgactatcagttcgttgaataggcttgacattgcggttcggtccactgtgcgcaagtggctgagcctgccgcatgatgtgcccaacgcgtacatccacgctgacgctcgggatgggggtctctccattcccccctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtggggggggaagatcctttaagcatctatcaaagctgagactgcttgacatctctgatgccaaggtcctgtcaacccgggttctgctcggggggatgggggctgtacgtgtgtttaatcgccgtacagctgtaagtg

SEQ ID NO: 220 - DNA, 1023 bp, Bacillus rossius
aacgactatcagttcgttgaataggcttgacattgcggttcggtccactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcgtgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtgggggggaagatcctttaagcatctatcaaagctgagactgcttgacatctctgatgccaaggtcctgtcaacccgggttctgctcggggggatgggggctgtacgtgtgtttaatcgccgtacagctgtaagtgg

SEQ ID NO: 221 - DNA, 1046 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacccccaacgatggagcacctcttaaggggtctaagaaggtggagggccagcatcggtgggttaccgatgggtctctcatgctgtcgggtcgtgactacattgcttgcaattgggtcaggaccaactcaatcccgctccgaaagcggactgctcgcggacgtgtccgtgacacccgctgccgggcgggttgtgacagcactgagacattacatcatgtgatgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgttttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggggtgggggggggggaaagatcctttaagcatctatcaaagctgagactgcttgacatctctgatgccaaggtcctgtcaacccgggttctgctcggggggaatgggggctgtacgtgtgtttaatcgccgtacagctgtaagtgggagggtcaatcgctggtga

SEQ ID NO: 222 - DNA, 972 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgatgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgttttggtggctggagagaggtcggatttagaccgagagcacgaccataaggtcagcaagtatgaaccactggcggatctagtaaaagaccggtactctgtcgataaagtgatcttcacctccctcatcatcagtgcgcgtgtgtgtttggggggggaaaaatcctttaagcatctatcaaagctgaaactgcttgacatctctgatgccaaggtcctgtcaacccgggttct

SEQ ID NO: 223 - DNA, 974 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgatgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgttttggtggctggagagaggtcggatttagaccgagagcacgaccataaggtcagcaagtatgaaccactggcggatctagtaaaagaccggtactctgtcgataaagtgatcttcacctccctcatcatcagtgcgtgtgtgtgttgggggggggaaagatcctttaagcatctatcaaagctgagactgcttgacatctctgatgccaaggtcctgtcaacccgggttctgc

SEQ ID NO: 224 - DNA, 968 bp, Bacillus rossius
aacgactatcagttcgttgaataggcttgacattgcggttcggtctactgtgcgcaagtggctgagcctgccgcatgatgtgcccaacgcatacatccacgctgacgctcgggatgggggtctctccattccctcctatcgttggacagtcccccggctccgtttccataggccgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacggcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatctcaatgcgcgtgtgtggggggggggggaaagatcctttaagcatctatcaaagctgaaactgcttgacatctctgatgccaaggtcctgtcaacccgttc

SEQ ID NO: 225 - DNA, 1044 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcgatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgggctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtgaaagaccggtactctgtcgataaagtgatcttcacctccctcatcatcagtgcgcgtggtgtgggggggggggaagatcctttaagcatctatcaaagctgagactgcttgacatctctgatgccaaggtcctgtcaacccgggttctgctcggggggatgggggctgtacgtgtgtttaatcgccgtacagctgtaagtgggagggtcaatggctggtga

SEQ ID NO: 226 - DNA, 1044 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgccgccgggcgggttgtgacagcactgagacattacatcatgtgatgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgttttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgttggggaaggaagatcctttaagcatctatcaaagctgagactgcttgacatctctgatgccaaggtcctgtcaacccgggttctgctcggggggatgggggctgtacgtgtgtttaatcgccgtacagctgtaagtgggagggtcaatcgctggtga

SEQ ID NO: 227 - DNA, 1043 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcgatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtgaaagaccggtactctgtcgataaagtgatcttcacctccctcatcatcagtgcgcgtggtgtggggggggggaagatcctttaagcatctatcaaagctgagactgcttgacatctctgatgccaaggtcctgtcaacccgggttctgctcggggggatgggggctgtacgtatgtttaatcgccgtacagctgtaagtgggagggtcaatggctggtga

SEQ ID NO: 228 - DNA, 1043 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcgatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtgaaagaccggtactctgtcgataaagtgatcttcacctccctcatcatcagtgcgcgtggtgtgtggggggggaagatcctttaagcatctatcaaagctgagactgcttgacatctctgatgccaaggtcctgtcaacccgggttctgctcggggggatgggggctgtacgtgtgtttaatcgccgtacagctgtaagtgggagggtcaatggctggtga

SEQ ID NO: 229 - DNA, 1019 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgatgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgttttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtggggggggggggaagatcctttaagcatctatcaaagctgagactgcttgacatctctgatgccaaggtcctgtcaacccgggttctgctcggggggaatgggggctgtacgtgtgtttaatcgccgtacagctgt

SEQ ID NO: 230 - DNA, 881 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctgggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatggcgcgtctactgcggtagtcgtcgatgctttggtggctggagagaggtcggatttagaccgagagcacgaccataaggtcagcaagtatgaaccactggcggatctagtgaaagaccggtactctgtcgataaagtgatcttcacctccctcatcatcagtgcgcgtg

SEQ ID NO: 231 - DNA, 878 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtatcctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgc

SEQ ID NO: 232 - DNA, 1043 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtggggggggaagatcctttaagcatctatcaaagctgagactgcttgacatctctgatgccaaggtcctgtcaacccgggttctgctcggggggatgggggctgtacgtgtgtttaatcgccgtacagctgtaagtgggagggtcaatggctggtga

SEQ ID NO: 233 - DNA, 975 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccggtactctgtcgataaagtgatcttctcctccctcattatcagtgcgcgtggtgtgtggggaggaagatcctttaggcatctatcaaaactgagactgcttgacatctctgatgccaaggtcctgtcaacccgagttctgcttgg

SEQ ID NO: 234 - DNA, 1028 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccggtactctgtcgataaagtgatcttctcctccctcattatcagtgcgcgtggtgtgtggggaggaagatcctttaggcatctatcaaaactgaaactgcttgacatctctgatgccaaggtcctgtcaacccgagttctgcttggggggatgggggctgtacgtgtgtttaatcgccgtacagctgtaagtgggaagg

SEQ ID NO: 235 - DNA, 529 bp, Bacillus rossius
cccttttatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcttgtgtgggggaaaaaatcaacccagcttcagcccccttacaagatcatggtacgaccatcaatacccgtaatgcctacagatttcgctttgctaggttattacatacctccaacgatggaccacctcttaaggggtctaagaaggtggagggccagcaccggtgggttaccgatgggcccctatgctgtcgggacgcgacaacattgcttgcatacgggccaggataatcgcactcccgctccgaaagagaattgctctcggacgtgtccttgactccctctgccgggcgggatgtgacgcat

SEQ ID NO: 236 - DNA, 1045 bp, Bacillus rossius
aacgactatcagttcgttgaataggcttgacattgcggttcggtctactgtgcgcaagtggctgagcctaccgcatgatgtgcccaacgcgtacatccacgctgacgctcgggatgggggtctctccattccctcctatcgttggacagtcccccggctccgtttccataggctgaaggcactctctgtccttggtgacgagggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccagtactctgtcgataaagtgatcttctcctccctcattatcagtgcgcgtggtgtgtgggggaggaagatcctttaggcatctatcaaaactgagactgcttgacatctctgatgccaaggtcctgtcaacccgagttctgcttgggggggatggggggctgtacgtgtgtttaatcgccgtacagctgtaagtgggagggtcaatggctggtga

SEQ ID NO: 237 - DNA, 1022 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtccctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcacgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccggtactctgtcgataaagtgatcttctcctccctcattatcagtgcgcgtggtgtgtgggggaggaagatcctttaggcatctatcaaaactgagactgcttgacatctctgatgccaaggtcctgtcaacccgagttctgcttggggggaatgggggcctgtacgtgtgtttaatcgccgtacagctgtaa

SEQ ID NO: 238 - DNA, 1022 bp, Bacillus rossius
aacgactatcagttcgttgaataggcttgacattgcggttcggtctactgtgcgcaagtggctgagcctaccgcatgatgtgcccaacgcgtacatccacgctgacgctcgggatgggggtctctccattccctcctatcgttggacagtcccccggctccgtttccataggctgaaggcactctctgtccttggtgacgagggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcacccgtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccgttactctgtcgataaagtgatcttctcctccctcattatcagtgcgcgtggtgtgtgggggaggaagatcctttaggcatctatcaaaactgagactgcttgacatctctgatgccaaggtcctgtcaacccgagctctgcttgggggggatggggggctgtacgtgtgtttaatcgccgtacagctgtaa

SEQ ID NO: 239 - DNA, 1021 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgggatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcacgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtccactgcggtagtcgtcgatgctttggtggctggagagaggtcggatttagaccgagagcacgaccgtaaggtcagcaagtatggaccactggtggatctagtaaaggaccggtactctgtcgataaagtgatcttctcctccctcattatcagtgcgcgtggtgtgtgggggaggaagatcctttaggcatctatcaaaactgagactgcttgacatctctgatgccaaggtcctgtcaacccgattctgcttgggggggatggggggctgtacgtgtgtttaatcgccgtacagctgtaa

SEQ ID NO: 240 - DNA, 1044 bp, Bacillus rossius
aacgactatcagttcgttgaataggcttgacattgcggttcggtctactgtgcgcaagtggctgagcctaccgcatgatgtgcccaacgcgtacatccacgctgacgctcgggatgggggcctctccattccctcctatcgttggacagtcccccggctccgtttccataggctgaaggcactctctgtccctggtgacgagggaggtccggacgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcacgacgcgtctactgcggtagtcgtcgatgctttggtggctggagagaggtcggatttagaccgagagcacgaccgtaaggtcagcaagtatggaccactggtggatctagtaaaggaccgttactctgtcgataaagtgatcttctcctccctcattatcagtgcgcgtggtgtgtggggaaggaagatcctttaggcatctatcaaaactgagactgcttgacatctctgatgccaaggtcctgtcaacccgagtctgcttgggggggatggggggctgtacgtgtgtttaatcgccgtacagctgtaagtgggagggtcaatggctggtga

SEQ ID NO: 241 - DNA, 990 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttactaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcacgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccggtactctgtcgataaagtgatcttctcctccctcatcatcagtgcgcgtggtgtgttggggaaggaagatcctttaggcatctatcaaaactgagactgcttgacatctctgatgccaaggtcctgtcaacccgattctgtttggggggaaaggggggc

SEQ ID NO: 242 - DNA, 1042 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccggtactctgtcgataaagtgatcttctcctccctcattatcagtgcccgtggtgtgtggggggaggaagatcctttaggcatctatcaaaactgagactgcttgacatctctgatgccaaggtcctgtcaacccgttttgcttggggggatggggggtgtacgtgtgtttaattcccgtacaactgtaagtgggagggtcaaagggtggtga

SEQ ID NO: 243 - DNA, 527 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttccgcccgcttacaagatcatggtatgaacatcaatacccgtaatacctacagagttcgctttgctaggttattacatacctccaacgatggaccacctcttaaggggtctaagaaggtggagggccagcatcggtgggttaccgatgggtctctcatgctgtcgggtcttgactacattgcttgcaattgggtcaggatcaactcaatcccgcttcgaaagcggactgctcccggacgtgtccgtgacacccgctgccgggccggatgtgaca

SEQ ID NO: 244 - DNA, 739 bp, Bacillus rossius
aacgactatcagttcgttgaataggctcgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaagtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgat

SEQ ID NO: 245 - DNA, 740 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaagtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcattccacacggcaggaggtctactgaagcctgactctgtcatccttcatgacgcgtctactgcggtagtcgtcgatgc

SEQ ID NO: 246 - DNA, 744 bp, Bacillus rossius
aacgacatcagttcgttgaataggctcgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggcaagacggtattctgggaaccgcatttccacacggcaggaggtctactgaagccctgactctgtcatccttcatgacgtgtctactgcggtagtcgtcgatgcttt

SEQ ID NO: 247 - DNA, 744 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgtcggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgcccgcggacgtgtccgtgacacccgctgccgggcgggatgcgacagcactgagacattacatcatgtgctgcagcaatgtcatcggactcatgacatgcgaatcaaaaggcataatgcatgtgtgaagtacttactagatcgccaacgccctcgtggtaagacggtattctgggaaccgcatttccacacggcaggaggtctactgaagcctgactctgtcatccttcatgacgcgtctactgcggtagtcgtcgatgcttt

SEQ ID NO: 248 - DNA, 762 bp, Bacillus rossius
aacgactatcagttcgttgaataggcttgacattgcggttcggtctactgtgcacaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtc

SEQ ID NO: 249 - DNA, 764 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaagtggagggccagcatcggtgggttaccgatgggtctctcatgctgtcgggtcgtgactacattgcttgcaattgggtcaggatcagctcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacagcaggaggtctactgaagcctgactctgtcatccttcatgacgcgtctactgcggtagtcgtcgatgctttggtggctggagagaggtcgg

SEQ ID NO: 250 - DNA, 766 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaagtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcatagtgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggat

SEQ ID NO: 251 - DNA, 766 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaatatcaatacccgtaatacctacagagttcgctttgctaggttattacatacctccaacgatggagcacctcctaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcgctgagacattacatcatgtgctgcagcaatgtcatcggactcatgacatgcgaatcaaaaggcataatgcatgtgtggagtacttgctagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggat

SEQ ID NO: 252 - DNA, 822 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggccgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctaggaaccgcatttccatacggcaggaggtctactgaagcctgactctgtcatccttcatgacgcgtctactgcggtagtcgtcgatgctttggtggctggagagaggtcggatttagaccgagagcacgaccataaggtcagcaagtatgaaccactggtggatctagt

SEQ ID NO: 253 - DNA, 589 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactccatcccgctccgaaagcggactgctcgcggacgtgtccgtgacacccgctgccgggcgggatgtgacagcactgagacattacattatgtgctgcaccaatgtcatccgacccatgacatgcgaatcaaa

SEQ ID NO: 254 - DNA, 683 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgcccacgctctcgtggtaagacggtattctgggaaccgcatttcccacggcaggaggtct

SEQ ID NO: 255 - DNA, 713 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgctaacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggaccgctcgcggacgtgtccgtgacacccgctgccgggcgggatgtgacagcactgagacattacatcatgtgctgcagcaatgtcatcggactcatgacatgccaatcaaaaggcataatgcatgtgtgaagtacttactagatcgccaacgctctcgtggtaagacggtattctgggaaccgcacttcccacacggcaggaggtctactgaagcctgactctgtcatcctttct

SEQ ID NO: 256 - DNA, 770 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgcttttggtggctggagagaggtcggattta

SEQ ID NO: 257 - DNA, 823 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacaccttctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagta

SEQ ID NO: 258 - DNA, 846 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatggaccactggtggatctagtaaaggaccggtactctgtcgataa

SEQ ID NO: 259 - DNA, 866 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaggatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtatcctgggaaccgcatttccacacggcaggaggtctactgaaagcctgactctgtcatccttcatgacgcgtctactgcggtagtcgttcgatgctttggtggctggagagaggtcggatttagaccgagagcacgaccgtaaggtcagcaagtatgaaccactggtggattctagtaaaggaccggtactctgtcgattaagtgatcttctcctccc

SEQ ID NO: 260 - DNA, 861 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttacgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttggaccgagagcacgaccgtaaggtcagcaagtatggaccactggtggatctagtaaaggaccggtactctgtcgataaagtgatcttctcctt

SEQ ID NO: 261 - DNA, 861 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgcctactgcggtagtcgtcgatgctttggtggctggagagaggtcggatttagaccgagagcacgaccgtaaggtcagcaagtatgaaccactggtggatctagtaaaggaccggtactctgtcgataaagtgatcttctcctc

SEQ ID NO: 262 - DNA, 1042 bp, Bacillus rossius
aacgactatcagttcgttgaataggcttgacattgcggttcggtctactgtgcgcaagtggctgagcctgccgcatgatgtgcccaacgcgtacatccacgctgacgctcgggatggggggctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatgaaccactggtggatctagtaaaggaccggtactctgtcgataaagtgatcttctcctccctcattatcagtgcgcgtggtgtgtggggaggaagatcctttaggcatctatcaaaactgagactgcttgacatctctgatgccaaggtcctgtcaacccgagttctgcttggggggatgggggctgtacgtgtgtttaatcgccgtacagctgtaagtgggagggtcaatggctggtga

SEQ ID NO: 263 - DNA, 668 bp, Lepidurus apus
gtcaaagtgaagaaattcaacgaagcgcgggtaaacggcgggagtaactatgactctctctttttggggtagcaattgatcaattcccgcctcctcgttgcgctaccctgggatagcctcaaagaaatttgacggtaaagctaagaggaattgatcacccaaggcagttcatcggccttcctgcaggagatctgataaagatattagtgagttagtctgttgaagctcgctagttcattcccctgatgtcagaggaaagcaaaacaaagcagacggtctccaagagtggaaccgccgtggagaagactatgatgagtgggacctacgtttgtactttatgtggtaggagttttgagaagtcggtgggtttgacactccacacgaaccgaatgcaccccgaagctaacaataagctgaaagaggctaagaaacctgttttgaagaaggcgcgatggtcggagtaggaagtcttcctcctagcgcagaaggaagcggagctctcgttcattggaggaattaagttcatgaacattgagctgcataaaatttttccagagcgtgagttggagggaatcaagggccaaagaaagaacccaacatacaaagcgcaagtcgtcagcttattagctgagatacgagagtctatggccaatgattcctcttcatct

SEQ ID NO: 264 - DNA, 668 bp, Lepidurus apus
gtcaaagtgaagaaattcaacgaagcgcgggtaaacggcgggagtaactatgactctctctttttggggtagcaattgatcaattcccgcctcctcgttgcgctaccctgggatagcctcaaagaaatttgacggtaaagctaagaggaattgatcacccaaggcagttcatcggccttcctgcaggagatctgataaagatattagtgagttattatgttgaagctcgctagttcattcccctgatgtcagaggaaagcagaccaaagcagaaggcctccaagagtggagccgccgtggagaaaactatgatgagtgggacctacgtgtgtactttatgtggtaggagttttgagaagtcggtgggtttgacactccacacgaaccgaatgcaccccgaagcttacaataagctgaaagaggctaagaaacccgttttgaagaaggcgcgatggtcggaggaggaagtcttcctcctagcgcaaaaggaagcggaactctcgttcattggaggaattaagttcatgaacatcgagctgcataaaatttttccagagcgtgagttggagggaatcaagggtcaaagaaagaacccaacgtacaaagcgcatgttgtcagcttattagctgagaaacgagagtctaaggccaatgactcctcttcatct

SEQ ID NO: 265 - DNA, 668 bp, Lepidurus apus
gtcaaagtgaagaaattcaacgaagcgcgggtaaacggcgggagtaactatgactctctctttttggggtagcaattgatcaattcccgcctcctcgttgcgctaccctgggatagcctcaaagaaatttgacggtaaagctaagaggaattgatcacccaaggcagttactcggccttcccgcaggagatctgataaagatattagtgagttagtctgttgaagctcgctagttcattcccctgatgtcagaggaaagcaaaacaaagcagacggtctccaagagtggaaccgccgtggagaagactatgatgagtgggacctacgtgtgtactttatgtggtaggagttttgagaagtcggtgggtttgacactccacacgaaccgaatgcaccccgaagctaacaataagctgaaagaggctaagaaacctgttttgaagaaggcgcgatggtcggagtaggaagtcttcctcctagcgcagaaggaagcggagctctcgttcattggaggaattaagttcatgaacattgagctgcataaaatttttccagagcgtgagttggagggaatcaagggccaaagaaagaacccaacatacaaagcgcaagtcgtcagcttattagctgagatacgagagtctaaggccaatgattcctcttcatct

SEQ ID NO: 266 - DNA, 667 bp, Lepidurus apus
  modified_base (137)..(137): a, c, g, or t
gtcaaagtgaagaaattcaacgaagcgcgggtaaacggcgggagtaactatgactctctctttttggggtagcaattgatcaattcccgcctcctcgttgcgctaccctgggatagcctcaaggaaatttgacggtnaagctaagaggaattgatcacccaaggcagttcatcggccttcctgcaggagatctgataaagatattagtgagttagtctgttgaagctcgctagttcattcccctgatgtcagaggaaagcaaaacaaagcagacggtctccaagagtggaaccgccgtggagaagactatgatgagtgggacctacgtttgtactttatgtggtaggagttttgagaagtcggtgggtttgacactccacacgaaccgaatgcaccccgaagctaacaataagctgaaagaggctaagaaacctgttttgaagaaggcgcgatggtcggagtaggaagtcttcctcctagcgcagaaggaagcggagctctcgttcattggaggaattaagttcatgaacattgagctgcataaaatttttccagagcgtgagttggagggaatcaagggccaaagaaagaacccaacatacaaagcgcaagtcgtcagcttattagctgagatacgagagtctatggccaatgattcctcttcatc

SEQ ID NO: 267 - DNA, 667 bp, Lepidurus apus
gtcaaagtgaagaaattcaacgaagcgcgggtaaacggcgggagtaactatgactctctccttttggggtagcaattgatcaattcccgcctcctcgttgcgctaccctgggatagcctcaaagaaatttgacggtaaagctaagaggaattgatcacccaaggcagttcatcggccttcctgcaggagatctgataaagatattagtgagttagtctgttgaagctcgctagttcattcccctgatgtcagaggaaagcaaaacaaagcagacggtctccaagagtggaaccgccgtggagaagactatgatgagtgggacctacgtgtgtactttatgtggtaggagttttgagaagtcggtgggtttgacactccacacgaaccgaatgcaccccgaagctaacaataagctgaaagaggctaagaaacctgttttgaagaaggcgcgatggtcggagtaggaagtcttcctcctagcgcagaaggaagcggagctctcgttcattggaggaattaagttcatgaacattgagctgcataaaatttttccagagcgtgagttggagggaatcaagggccaaagaaagaacccaacatacaaagcgcaagtcgtcagcttattagctgagatacgagagtctatggccaatgattcctcttcatc

SEQ ID NO: 268 - DNA, 663 bp, Lepidurus apus
gtcaaagtgaagaaattcaacgaagcgcgggtaaacggcgggagtaactatgactctttttgggttagcaattgatcaattcccgcctcttcgtggcgctaccctgggatagcctcaaagaaattttacggtaaagctaagaggaattgatcacccaaggcagttcatcggccttcctgcaggagctctgataaagatattagtgagttattctgttgaagctcgctagttcattcccctgatgtcagaggaaagcagaccaaagcagacggcctccaagagtggagccaccatggagaaaactatgatgagtgggacctacgtgtgtactttatgtggtaggagttttgagaagtcggtgggtttgacactccacacgaaccgaatgcaccccgaagcttacaataagctgaaagaggctaagaaacccgttttgaagaagacgcgatggtcggaggaggaagtcttcctcctagcgcaaaaggaagcggaactctcgttcattggaggaattaagttcatgaacatcgagctgcataaaatttttccagagcgtgagttggagggaatcaagggccaaagaaagaacccaacgtacaaagcgcaagttgtcagcttattagctgagatacgagagtctaaggccaatgatttctcttcatc

SEQ ID NO: 269 - DNA, 664 bp, Lepidurus apus
gtcaaagtgaagaaattcaacgaagcgcgggtaaacggcgggagtaactatgactctttttgggttagcaattgatcaattcccgcctcctcgtggcgctaccctgggatagcctcaaagaaattttacggtaaagctaagaggaattgatcacccaaggcagttcatcggccttcctgcaggagctctgataaagatattagtgagttattctgttgaagctcgctagttcattcccctgatgtcagaggaaagcagaccaaagcagacggcctccaagagtggagccgccgtggagaaaactatgatgagtgggacctacgtgtgtactgtatgtggtaggagttttgagaagtcggtgggtttgacactccacacgaaccgaatgcaccccgaagcttacaataagctgaaagaggctaagaaacccgttttgaagaaggcgcgatggtcggaggaggaagtcttcctcctagcgcaaaaggaagcggaactctcgttcattggaggaattaagttcatgaacatcgagctgcataaaatttttccagagcgtgagttggagggaatcaagggccaaagaaagaacccaacgtacaaagcgcaagttgtcagcttattagctgagatacgagagtctaaggccaatgattcctcttcatct

SEQ ID NO: 270 - DNA, 663 bp, Lepidurus apus
gtcaaagtgaagaaattcaacgaagcgcgggtaaacggcgggagtaactatgactctttttggggtagcaattgatcaattcccgcgtcctcgtggcgctaccctgggatagcctcaaagaaatttgacggtaaagctaagaggaattgatcacccaaggcagttcatcggccttcctgcaggagctctgataaagatattagtgagttattatgttgaagcttgctagttcattcccctgatgtcagaggaaagcagaccaaagcagacggcctccaagagtggagccaccgtggagaaaactatgttgagtgggacccacgtgtgtactttatgtggtaggagttttgagaagtcggtgggtttgacactccacacgaaccgaatgcaccccgaagcttacaataagctgaaagaggctaagaaacccgttttggagaaggcgcgatggtcggaggaggaagtcttcctcctagcgcaaaaggaagcggaactctcgttcattggaggaattaagttcatgaacatcgagctgcataaattttttccagagcgtgagctggagggaatcaaaagccaaagaaagaacccaacgtacaaagcgcaagttgtcagcttattagctgagatacgagagtctaaggccaatgattcttcttcatc

SEQ ID NO: 271 - DNA, 663 bp, Lepidurus apus
gtcaaagtgaagaaattcaacgaagcgcgggtaaacggcgggagtaactatgactctttttggggtagcaattgatcaattcccgcgtcctcgtggcgctaccctgggatagcctcaaagaaatttgacggtaaagctaagaggaattgatcacccaaggcagttcatcggccttcctgcaggagctctgataaagatattagtgagttattctgttgaagctcgctagttcattcccctgatgtcagaggaaagcagaccaaagcagacggcctccaagagtggagccaccatggagagaactatgatgagtgggacctacgtgtgtactttatgtggtaggagttttgagaagtcggtgggtttgacactccacacgaaccgaatgcaccccgaagcttacaataagctgaaagaggctaagaaacccgttttgaagaaggcgcgatggtcggaggaggaagtcttcctcctagcgcaaaaggaagcggaactctcgttcattggaggaattaagttcatgaacatcgagctgcataaaatttttccagagcgtgagttggagggaatcaagggccaaagaaagaacccaacgtacaaagcgcaagttgtcagcttattagctgagatacgagagtctaaggccaatgattcctcttcatc

SEQ ID NO: 272 - DNA, 666 bp, Lepidurus apus
gtcaaagtgaagaaattcaacgaagcgcgggtaaacggcgggagtaactatgactctctttttggggtagcaattgatcgattcccgcctcctcgtatcgctaccctgggatagcctcaaagaaatttgactggaaagctaagtggaattgatcacccaaggcagttcattggccttcctgcaggagctctgataaagatattagtgagttattctgttgaagctcgctattttcttcccctgatgtcagaggaaagcagaccaaagcagacggcctccaagagtggagccgccgtggagaagaacatgatgagtgggacctacgtgtatacattatgtggtaggagatttgagaagtcggtgggtctgacactccacactaactgaatgcatcctgaagcttataataagctaaaggaggctaagaaacctgttttgaagaaggcgcggtggtcggaggaggaaatatttctcttagcacagaaggaagctgaactctcgttcattggagaaattaagttcatgaacattgagctacataaaatttttccggagcgagagttggagggaatcaagggacaaagaatgatcccgacgtacaaagcgcaagttataagcttacttgctgaaatccgagagtccagaacaaatgattcctcttcatct

SEQ ID NO: 273 - DNA, 669 bp, Lepidurus apus
gtcaaagtgaagaaattcaacgaagcgcgggtaaacggcgggagtaactatgactctctctcttttggtgtagcaattgatcaattcccgcctcctcgtggcgctaccctgggatagcctcaaagaaatttgacggtaaagctaagaggaattgatcccccaaggcagttcatcggcctttctgctggagctctgataaagatattagtgagttattatgttgaagctcgctagttcattcccctgatgtcagaggaaagcagaccaaagcagaaggcctccaagagtggagccgccgtggagaaaactatgatgagtgggacctacgtgtgtactttatgtggtaggagttttgagaagtcggtgggtttgacactccacacgaaccgaatgcaccccgaagcttacaataagctgaaagaggctaagaaacccgttttgaagaaggcgcgatggtcggaggaggaagtcttcctcctagcgcaaaaggaagcggaactctcgttcattggaggaattaagttcatgaacatcgagctgcataaaatttttccagagcgtgagttggagggaatcaagggccaaagaaagaacccaacatacaaagcgcaagtcgtcagcttattagctgagatacgagagtctaaggccaatgattcctcttcatct

SEQ ID NO: 274 - DNA, 668 bp, Lepidurus apus
gtcaaagtgaagaaattcaacgaagcgcgggtaaacggcgggagtaactatgactctctctcttttggtgtagcaattgatcaattcccgcctcctcgtggcgctaccctgggatagcctcaaagaaatttgacggtaaagctaagaggaattgatcccccaaggcagttcatcggccttcctgctggagctctgataaagatattagtgagttattatgttgaagctcgctagttcatacccctgatgtcagaggaaagcagaccaaagcagaaggcctccaagagtggagccgccgtggagaaaactatgatgagtgggacctacgtgtgtactttatgtggtaggagttttgagaagtcggtgggtttgacactccaaacgaaccgaatgcaccccgaagcttacaataagctgaaagaggctaagaaacccgttttgaagaaggcgcgatggtcggaggaggaagtcttcctcctagcgcaaaaggaagcggaactctcgttcattggaggaattaagttcatgaacatcgagctgcataaaatttttccagagcgtgagttggagggaatcaagggtcaaagaaagaacccaacgtacagagcgcatgttgtcagcttattagctgagaaacgagagtctaaggccaatgattcctcttcatc

SEQ ID NO: 275 - DNA, 691 bp, Lepidurus apus
gtcaaagtgaagaaattcaacgaagcgtgggtaaacggcgggagtaactatgactctcttaagtagactaagtaactatgactctctttggggtagcaattgatcaattcccgcctcctcgtggcgctaccctgggatagcctcaaagaaatttgacgggaaagctgagtggaattgatcacccaaggcagttcatcggccttcctgcaggagctctgataaagatattagtgagttattctgttgaagctcgctagttcattcccctgatgtcagaggaaagcagaccaaagcagacggcctccaagattgaagccgccgtggagaagaacatgatgagtgggacctacgtgtatacattatgtgtaggagttttgagaagtcggtgggtctgacactccacacgaaccgaatgcaccccgaagcttacaataagctgaaagaggctaagaaacctgttttgaagaaggcgcgatggtcggagtaggaagtcttcctcctagcgcagaaggaagcggagctctcgttcattggaggaattaagttcatgaacattgagctgcataaaatttttccagagcgtgagttggagggaatcaagggccaaagaaagaacccaacatacaaagcgcaagtcgtcagcttattagctgagatacgagagtctaaggccaatgattcctcttcatct

SEQ ID NO: 276 - DNA, 313 bp, Lepidurus apus
  modified_base (212)..(212): a, c, g, or t
gtcaaagtgaagaaattcaacgaagcgcgggtaaacggcgggagtaactatgactctcttaaaactattaaacttcggattaatggtattccaactcgttcaagatttgctcggggtcgcgaaacgaagaaccgtgcatgtcgtgtgggctgtttagatctgactcaattgccggcaattgagtcactaaaccatatctctcagtccttttntaggactcatgttgccagaattaaacgtcacgaccacattgtgcaattcctgagtgacaatctgaagaggaaacatccgaagagtaccatattagttgaat

SEQ ID NO: 277 - DNA, 306 bp, Lepidurus apus
gtcaaagtgaagaaattcaacgaagcgcgggtaaacggcgggagtaactatgactctcttaaaactattaaacttcggattaatggtattccaactcgttccagattagctcggggtcgcgaaacgaagaaccgtgcatgtcgtgtgggctgtttagatctgactcaattgccggcaattgagtcactaaaccatatctctcattccttttctaggactcatggtgccagaattaaacgtcacgaccgcattgtgcaattcctgagtgacaatctgaagaagaaacatccgaagagtaccataaat

SEQ ID NO: 278 - DNA, 313 bp, Lepidurus apus
gtcaaagtgaagaaattcaacgaagcgcgggtgaacggcgggagtaactatgactctcttaaaactattaaacttcggattaatggtattccaactcgttcaagattagctcggggtcgcgaaacgaagaaccgtgcatgtcgtgtgggctgtttagatctgactcaattgccggcaattgagtcactaaaccatatctctcagtcctcttctaggactcatgttgccagaattaaacgtcacgaccacattgtgcaattcctgagtgacaatctgaagaggaaacatccgaagagtaccatattagttgaat

SEQ ID NO: 279 - DNA, 310 bp, Lepidurus apus
gtcaaagtgaagaaattcaacgaagcgcgggtaaacggcatgagtaactatgactctcttaaaactattaaacttcggattaatggtattccaactcgttccagattagctcggggtcgcgaaacgaagaaccgtgcatgtcttgtgggctgtttagatctgactcaattgccggcaattgagtcactaaaccatatctctcagtccttttctaggactcatggtgccagaattaaacgtcacgaccgcattgtgcaattcctgagcgacaatctgaagaggaaacatccgaagagtaccatattagttg

SEQ ID NO: 280 - DNA, 310 bp, Lepidurus apus
gtcaaagtgaagaaattcaacgaagcgcgggtaaacggcatgagtaactatgactctcttaaaactattaaacttcggattaatggtattccaactcgttccagattagctcggggtcgcgaaacgaagaaccgtgcatgtcgtgtgggctgtttagatctgactcaattgccggcaattgagtcactaaatcatatctctcagtccttttctaggactcatggtgccagaattaaacgtcacgaccgcattgtgcaattcctgagtgacaatctgaagaggaaacatccgaagagtaccatattagttg

SEQ ID NO: 281 - DNA, 310 bp, Lepidurus apus
gtcaaagtgaagaaattcaacgaagcgcgggtaaacggcatgagtaactatgactctcttaaaactattaaacttcggattaatggtattccaactcgttccagattagctcggggtcgcgaaacgaagaaccgtgcatgtcgtgtgggctgtttagatctgactcaattgccggcaattgagtcactaaatcatatctctcagtccttttctaggactcatggtgccaggattaaacgtcacgaccgcattgtgcaattcctgagtgacaatctgaagaggaaacatccgaagagtaccatattagttg

SEQ ID NO: 282 - DNA, 310 bp, Lepidurus apus
gtcaaagtgaagaaattcaacgaggcgcgggtaaacggcgggagtaactatgactctcttaaaactattaaacttcggattaatggtattccaactcgttccagattagctcggggtcgcgaaacgaagaaccgtgcatgtcgtgtgggctgtttagatctgactcaattgccggcaattgagtcactaaaccatatctctcattccttttctaggactcatggtgccagaattaaacgtcacgaccgcattgtgcaattcctgagtgacaatctgaagaagaaacatccgaagagtaccatattagctg

SEQ ID NO: 283 - DNA, 308 bp, Lepidurus apus
gtcaaagtgaagaaattcaacgaagcgcgggtaaacggcgggagtaactatgactctcttaaaactattaaacttcggattaatggtattccaactcgttccagattagctcgggtcgcgaaacgaagaaccgtgcatgtcgtgtgggctgtttttatctgactcaattgccggcaattgagtcactaaaccatatctctcagtctttttctaggactcatggtgccagaattaaacgtcacgaccgcattgtgcaattcctgagagacaatctgaagaagaaacatccgagagtaccatattagttg

SEQ ID NO: 284 - DNA, 310 bp, Lepidurus apus
gtcaaagtgaagtaattcaacgaagcgcgggtaaacggcgtgagtaactatgactctcttaaaactattaaacttcggattaatggtattccaactcgttccagattagctcggggtcgcgaaacgaagaaccgtgcatgtcgtgtgggctgtttagatctgactcaattgccggcaattgagtcactaaaccatatctctcagtctttttctaggactcatggtgccagaattaaacgtcacgaccgcattgtgcaattcctgagtgacaatctgaagaagaaacatccgaagagtaccatattagttg

SEQ ID NO: 285 - DNA, 310 bp, Lepidurus apus
gtcaaagtgaagaaattcaacgaagcgcgggtaaacggcgggagtaactatgactctcttaaaactattaaacttcggattaatggtattccaactcgttcaagattggctcggggtcgcgaaacgaagaaccgtgcatgtcgtgtgggctgtttagatctgactcaattgccggcaattgagtcactaaaccatatctctcagtccttttctaggactcatgttgccagaattaaacgtcacgaccacattgtgcaattcctgagtgacaatctgaagaggaaacatccgaagagtaccatattagttg

SEQ ID NO: 286 - DNA, 639 bp, Lepidurus arcticus
gtcaaagtgaagaaattcaacgaagcgcgggtaaacggcgggagtaactatgactctcttaacgaagtaactatgactctcttaactatgactctcggggtagcaattgatcgattcccgcttcctcgtggcgctaccctgggtaatactatgaggaattgatcacaccgtggcgaacgtcatcagtcacagctgcacgaatccagatagaaatataacagacgagtaattcttttaaaagctcgtcagtaatcttcccagatgtctggaaagagcagcaaaccgagaactgtatccagtggatccggttcccaagagactcctccaagtgggtccaacgcatgtgatatatgcgggaaatgcttcatgaaaccggtcggtttgtccagagtccatcctagtcaatatcatgcacgcttagaaaagaaccaacctaaagcgaagaagttcagatggactgatgaggatttgtattttttagcgaaaaaagaagcggaacttttacattagggcggcattaaatttgtgaataaagaactggcagaattctttccggagaaatctgtcgaccaaatcaaaggccaaagacgttctgagacgtacaaacagcaagttttatctatccattctgaactgctc

SEQ ID NO: 287 - DNA, 639 bp, Lepidurus arcticus
gtcaaagtgaagaaattcaacgaagcgcgggtaaacggcgggagtaactatgactctcttaacgaagtaactatgactctcttaactatgactctcggggtagcaattgatcgattcccgcttcctcgtggcgctaccctgggtaatactatgaggaattgatcacaccgtggcgaacgtcatcagtcacagctgcacgaatccagatagaaatataacagacgagtaattcttttaaaagctcgtcagtaatcttcccagatgtctggaaagagcagcaaaccgagaactgtatccagtggatccagttcccaagagactcctccaagtgggtccaacgcatgtgatatatgcgggaaatgcttcatgaaaccggtcggtttgtccagagtccatcctagtcaatatcatgcacgcttagaaaagaaccaacctaaagcgaagaagttcagatggactgatgaggatttgtattttttagcgaaaaaagaagcggaacttttacatttgggcggcattaaatttgtgaataaagaactggcagaattctttccggagaaatctgtcgaccaaatcaaaggccaaagacgttctgagacgtacaaacagcaagttttatctatccattctgaactgctc

SEQ ID NO: 288 - DNA, 639 bp, Lepidurus arcticus
gtcaaagtgaagaaattcaacgaagcgcgggtaaacggcgggagtaactatgactctcttaacgaagtaactatgactctctgaactatgactctcggggtagcaattgatcgattcccgcttcctcgtggcgctaccctgggtaatactatgaggaattgatcacaccgtggcgaacgtcatcagtcacagctgcacgaatccagatagaaatataacagacgagtaattcttttaaaagctcgtcagtaatcttcccagatgtctggaaagagcagcaaaccgagaactgtatccagtggatccagttcccaagagactcctccaagtgggtccaacgcatgtgatatatgcgggaaatgcttcatgaaaccggtcggtttgtccagagtccatcctagtcaatatcatgcacgcttagaaaagaaccaacctaaagcgaagaagttcagatggactgacgaggatttgtattttttagcgaaaaaagaagcggaacttttacatttgggcagcattaaatttgtgaataaagaactggcagaattctttccggagaaatctgtcgaccaaatcaaaggccaaagacgttctgagacgtacaaacagcaagttttatctatccattctgaactgctc

SEQ ID NO: 289 - DNA, 639 bp, Lepidurus arcticus
gtcaaagtgaagaaattcaacgaagcgcgggtaaacggcgggagtaactatgactctcttaacgaagtaactatgactctcttaactatgactctcggggtagcaattgatcgattcccgcttcctcgtggcgctaccctgggtaatactatgaggaattgatcacaccgtggcgaacgtcatcagtcacagctgcacgaatccagatagaaatataacagacgagtaattcttttaaaagctcgtcagtaatcttcccagatgtctggaaagagcagcaaaccgagaactgtatccagtggatccagttcccaagagactcctccaagtgggaccaacgcatgtgatatatgcgggaaatgcttcatgaaaccggtcggtttgtccagagtccatcctagtcaatatcatgcacgcttagaaaagaaccaacctaaagcgaagaagttcagatggactgatgaggatttgtattttttagcgaaaaaagaaggggaacttttacatttgggcggcattaaatttgtgaataaagaactggcagaattctttccggagaaatctgtcgaccaaatcaaaggccaaagacgttctgagacgtacaaacagcaagttttatctatccattctgaactgctc

SEQ ID NO: 290 - DNA, 639 bp, Lepidurus arcticus
gtcaaagtgaagaaattcaacgaagcgcgggtaaacggcgggagtaactatgactctcttaacgaagtaactatgactctcttaactatgactctcggggtagcaattgatcgattcccgcttcctcgtggcgctaccctgggtaatactatgaggaattgatcacaccgtggcgaacgtcatcagtcacagctgcacgaatccagatagaaatataacagacgagtaattcttttaaaagctcgtcagtaatcttcccagatgtctggaaagagcagcaaaccgagaactgtatccagtggatccagttcccaagagactcctccaagtgggtccaacgcatgtgatatatgcgggaaatgcttcatgaaaccggtcggtttgtccagagtccatcctagtcaatatcatgcacgcttagaaaagaaccaacctaaagcgaagaagttcagatggactgatgaggatttgtattttttagcgaaaaaagaagcggaacttttacatttgggcagcattaaatttgtgaataaagaactggcagaattctttccggagaaatctgtcgaccaaatcaaaggccaaagacgttctgagacgtacaaacagcaagttttatctatccattctgaactgctc

SEQ ID NO: 291 - DNA, 639 bp, Lepidurus arcticus
gtcaaagtgaagaaattcaacgaagcgcgggtaaacggcgggagtaactatgactctcttaacgaagtaactatgactctcttaactatgactctcggggtagcaattgatcgattcccgcttcctcgtggcgctaccctgggtaatactatgaggaattgatcacaccgtagcgaacgtcatcagtcacagctgcacgaatccagatagaaatataacagacgagtaattcttttaaaagctcgtcagtaatcttcccagatgtctggaaagagcagcaaaccgagaactgtatccagtggatccagttcccaagagactcctccaagtgggtccaacgcatgtgatatatgcgggaaatgcttcatgaaaccggtcggtttgtccagagtccatcctagtcaatatcatgcacgcttagaaaagaaccaacctaaagcgaagaagttcagatggactgatgaggatttgtattttttagcgaaaaaagaagcggaacttttacacttgggcagcattaaatttgtgaataaagaactggcagaattctttccggagaaatctgtcgaccaaatcagaggccaaagacgttctgagacgtacaaacagcaagttttatctatccattctgaactgctc

SEQ ID NO: 292 - DNA, 639 bp, Lepidurus arcticus; identical to SEQ ID NO: 288

SEQ ID NO: 293 - DNA, 639 bp, Lepidurus arcticus; identical to SEQ ID NO: 289

SEQ ID NO: 294 - DNA, 639 bp, Lepidurus arcticus; identical to SEQ ID NO: 290

SEQ ID NO: 295 - DNA, 639 bp, Lepidurus arcticus; identical to SEQ ID NO: 291

SEQ ID NO: 296 - DNA, 700 bp, Lepidurus couesii
gtcaaagtgaagaaattcaacgaagcgcgggtaaacggcgggagtaactatgactctcttaactatgactcttttggggtagcaattgatcgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcgaagctcgtcagtaatcttcccagatgtctggaaagagcagcaaaccgagaactgtatccagcggatccagttcccaagagactcctccaagtgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagttcatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagc

SEQ ID NO: 297 - DNA, 700 bp, Lepidurus couesii
gtcaaagtgaagaaattcaacgaagcgcgggtaaacggcgggagtaactatgactctcttaactatgactcttttggggtagcaattgaccgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcgaagctcgtcagtaatcttcccagatgtctggaaagagcagcaaaccgagaactgtatccagcggatccagttcccaagagactcctccaagtgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagttcatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagc

SEQ ID NO: 298 - DNA, 699 bp, Lepidurus couesii
gtcaaagtgaagaaattcaacgaagcgcgggtaaacggcgggagtaactatgactctcttaactatgactcttttggggtagcaattgatcgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcggagctcgtcagtaatcttcccagatgtctggaaagagcagcaaaccgagaactgtatccagcggatccagttcccaagagactcctccaagtgggtccaacgcatgtgatatatgcgggaagtgcttcatgaaaccagttggtttatcactacacatgtccaagtccatcctactcagtaccatgcacgcttggaaaagaatcaaccgaaagccaagaaatttagatggacggatgaagatttgtattttttagcgaagaaggaagctgaacttttacttttgggtggcattaaattcatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagc

SEQ ID NO: 299 - DNA, 700 bp, Lepidurus couesii; identical to SEQ ID NO: 296

SEQ ID NO: 300 - DNA, 700 bp, Lepidurus couesii; identical to SEQ ID NO: 296

SEQ ID NO: 301 - DNA, 699 bp, Lepidurus couesii
gtcaaagtgaagaaattcaacgaagcgcgggtaaacggcgggagtaactatgactctcttaactatgactcttttggggtagcaattgatcgattcccgcctccacgtggcgctaccctgggataacctcaaagaaatttgacggtaaagctaagaggaattgatcacaccgcgacgaatatcatcagtcacagctgcacgaatccagatagatatataacaggcgagtaattcttttcgaagctcgtcagtaatcttcccagatgtctggaaagagcagcaaaccgagaactgtatccagcggatccagttcccaagagactcctccaactgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgagaaggaagctgaacttttacttttgggtggcattaagttcatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagc

SEQ ID NO: 302 - DNA, 700 bp, Lepidurus couesii
gtcaaagtgaagaaattcaacgaagcgcgggtaaacggcgggagtaactatgactctcttaactatgactcttttggggtagcaattgatcgattcccgcctcctcgtggcgctaccctgggataacctcaaagaaatttgtcggtaaagctaagaggaattgatcacaccgtgacgaatatcatcagtcacagctgcacgaatccagatagatatataacaggcgagtaattcttttcgaagctcgtcagtaatcttcccagatgtctggaaagagcagcaaaccgagaactgtatccagcggatccagttctcaagagactcctccaagtgggtccaacgcatgtgatatatgcgggaagtgcttcatgaaaccagttggtttatcactacacatgtccaaagtccatcctactcagtaccatgcacgcttggaaaagaaacaaccgaaagccaagaaatttagatggacggatgaagatttgtattttttagcgaagaaggaagctgaacttttacttttgggtggcattaagttcatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagc

SEQ ID NO: 303 - DNA, 700 bp, Lepidurus couesii
gtcaaagtgaagaaattcaacgaagcgcgggtaaacggcgggagtaactatgactctcttaactatgactcttttggggtagcaattgatcgattcccgcctcctcgtggcgctaccctgggataacctcaaagaaatttgacggtaaagctaagaggaattgatcacaccgtgacgaatatcatcagacacagctgcacgaatccagatagatatataacaggcgagtaattcttttcgaagctcgtcagtaatcttcccagatgtctggaaagagcagcaaaccgagaactgtatccagcggatccagttcccaagagactcctccaagtgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagttcatgaacaaggaactggcagaattctttccggagaaatctgttgaccaaatcaaaggccaaggacgttccgagacatacaaacagcaagttgtatcaattcactctgaactgcttaagttgcaggctgtagctgattctcctccaccatcgagaattccagc

SEQ ID NO: 304 - DNA, 700 bp, Lepidurus couesii
gtcaaagtgaagaaattcaacgaggcgcgggtaaacggcgggagtaactatgactctcttaactatgactcttttggggtagcaattgatcgattcccgcctcctcgtggcgctaccctgggataacctcaaagaaatttggcggtaaagctaagaggaattgatcacaccgtgacgaatatcatcagtcacagctgcacgaatccagatagatatataacaggcgagtaattcttttcgaagctcgtcagtaatcttcccagatgtctggaaagagcagcaaaccgagaactgtatccagcggatccagttcccaagagactcctccaagtgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagttcatgaacaaggaactggcagaattctttccggagaaatctgttggccaaatcaaaggccaaagacgttccgagacatacaaacagtaagttgtatcaattcattctgaactgcttaagttgcaggctgtagctgattctcctccaccatcgagaattccagc

SEQ ID NO: 305 - DNA, 700 bp, Lepidurus couesii
gtcaaagtgaagaaattcaacgaagcgcgggtaaacggcgggagtaactatgactctcttaactatgactcttttggggtagcaattgatcgattcccgcctcctcgtggcgctaccctgggataacctcaaagaaatttgacggtaaagctatgaggaattgatcacaccgtgacgaatatcatcagtcacagctgcacgaatccagatagatatataacaggcgagtaattcttttcgaagctcgtcagtaatcttcccagatgtctggaaagagcagcaaaccgagaactgtatccagcggatccagttcccaagagactcctccaagtgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagttcatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagc

SEQ ID NO: 306 - DNA, 701 bp, Lepidurus couesii
gtcaaagtgaagaaattcaacgaagcgcgggtaaacggcgggagtaactatgactctcttaactatgactcttttggggtagcaattgatcgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcgaagctcgtcagtaatcttcccagatgtctggaaagagcagcaaaccgagaactgtatccagcggatccagttcccaagagactcctccaagtgggtccaacgcatgtgatatatgcgggaagtgcttcatggaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagttcatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagca

SEQ ID NO: 307 - DNA, 700 bp, Lepidurus couesii
gtcaaagtgaagaaattcaacgaagcgcgggtaaacggcgggagtaactatgactctcttaactatgactcctttggggtagcaattgatcgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcgaagctcgtcagtaatcttcccggatgtctggaaagagcagcaaaccgagaactgtatccagcggatccagttcccaagagactcctccaagtgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagtttatgaacaaggaactggcagaattctttccggagaaatctgttgaccaaatcaaaggccaaagacgttccgagacatacaaacagcaagttgtatcaattcattctgaactgcttaagttgcaggctgtagctgattctcctccaccatcgagaattccagc

SEQ ID NO: 308 - DNA, 700 bp, Lepidurus couesii
gtcaaagtgaagaaattcaacgaagcgcgggtaaacggcgggagtaactatgactctcttaactatgactcttttggggtagcaattgatcgattcccgcctcctcgtggcgctaccctgggataacctcaaaaaaatttgacggtaaagctaagaggaattgatcacaccgtgacgaatatcatcagtcacagctgcacgaatccagatagatatataacaggcgagtaattcttttcgaagctcgtcagtaatcttcccagatgtctggaaagagcagcaaaccgagaactgtctccagcggatccagttcccaagagactcctccaagtgggtccaacgcatgtgatatatgcgggaagtgcttcatgaaaccagttggtttatcactacacatgtccaaagtccatcctactcagtaccatgcacgcttggaaaagaatcaaccgaaagccaagaaatttagatggacggatgaagatttgtattttttagcgaagaaggaagctgaacttttacttttgggtggcattaagttcatgaacaaggaactggcagaattctttccggagaaatctgttgaccaaatcaaaggccaaagacgttccgagacatataaacagcaagttgtatcaattcattctgaactgcttaagttgcaagctgtagctgattctcctccaccatcgagaattccagc

SEQ ID NO: 309 - DNA, 728 bp, Lepidurus couesii
gtcaaagtgaagaaattcaacgaagcgcgggtaaacggcgggagtattcccgcctcctcgtggcgctaccccgggatagcctcaaagaagtttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccagg

SEQ ID NO: 310 - DNA, 728 bp, Lepidurus couesii
gtcaaagtgaagaaattcaacgaagcgcgggtaaacggcgggagtattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccagg

SEQ ID NO: 311 - DNA, 752 bp, Lepidurus couesii
gtcaaagtgaagaaattcaacgaagcgcgggtaaacggcgggagtaatttttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccagg

SEQ ID NO: 312 - DNA, 753 bp, Lepidurus couesii
gtcaaagtgaagaaattcaacgaagcgcgggtaaacggcgggagtaatttttggggtagcaattgatcgattcccgcctcctcgtggcgctaccccgggatagcctcaaagaaatttgacggtaatgcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccgcacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccaggt

SEQ ID NO: 313 - DNA, 752 bp, Lepidurus couesii; identical to SEQ ID NO: 311

SEQ ID NO: 314 - DNA, 787 bp, Lepidurus couesii
gtcaaagtgaagaaattcaacgaagcgcgggtaaacggcgggagtaactatgactctcttaaagagagtaactatgactctctttttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagggcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccagg

SEQ ID NO: 315 - DNA, 787 bp, Lepidurus couesii
gtcaaagtgaagaaattcaacgaagcgcgggtaaacggcgggagtaactatgactctcttaaagagagtaactatgactctctttttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccagg

SEQ ID NO: 316 - DNA, 787 bp, Lepidurus couesii
gtcaaagtgaagaaattcaacgaagcgcgggtaaacggcgggagtaactatgactctcttaaagagagtaactatgactctctttttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgagcatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccagg

SEQ ID NO: 317 - DNA, 783 bp, Lepidurus couesii
aagtgaagaaattcaacgaagcgcgggtaaacggcgggagtaactatgactctcttaaagagagtaactatgactctctttttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccagg

SEQ ID NO: 318 - DNA, 779 bp, Lepidurus couesii
gaagaaattcaacgaagcgcgggtaaacggcgggagtaactatgactctcttaaagagagtaactatgactctctttttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagctgagatccgagagtctaaggccaatgattcctcttcatcttcctcatcctcctcctcttgtgattcggcctctttgggcattagcaattggcttgaatttctgctagctctcccgaagacctccaaccaattccagg

SEQ ID NO: 319 - DNA, 785 bp, Lepidurus couesii
gtcaaagtgaagaaattcaacgaagcgcgggtaaacggcgggagtaactatgactctcttaaagagagtaactatgactctctttttggggtagcaattgatcgattcccgcctcctcgtggcgctaccccgggatagcctcaaagaaatttgacggtaaagcaaagaggaatcgatcacccaaggcagtacatcggccttcctgcaggagctctgataaagatattagtgagttattctgttgaagctcgctatttcattcccctgatgtcagaggaaagcagaccaaagcagacggcctccaagcgtggagccgccgtggagaagactatgatgagtgggacctacgtgtgtactttatgtggtaggagttttgagaagtcggtgggtttgtcactccacacgaaccggatgcaccctgaagcttacaataagctgaaggaggctaagaaacctgttttgaagaaggcgcgatggtcagaggaggaggttttccttctagcgcagaaggaagcggagctctcattcattggaggaattaagttcatgaacatcgagctgcataaaatttttccagagcgtgagttggagggaatcaaaggccaaagaaagaacccaacgtacaaagcgcaagtcgttagcttattagatgagatccgagagtctaaggccaatgattcctcttcatcttcctcatcctcctcctcttgtgattcggcctctttgggcattagcaattggcttgaatttctgctagctctcccgaagacctccaaccaattcca

SEQ ID NO: 320 - DNA, 1467 bp, Tenebrio molitor
gccttcgccgacgatttggtgctccttgctgacagtgccaaggacgccaataggctgttatcggaggcctcgcagttctttgcggatcggggactcgaattgaacgttgccaagtgctgtgccttgtcaacaggtgtagttccgtccaaaaagaagtgttcagctcgacttagatcttattccaggctgaacggtgcccacatccgtcaagtggcgattggcgatgtcttcaagtatctgggcaatcacttcgctttcgatggcgttagtgacataagcttggaggaactaaactctcaaattaataatttgatgaaagccccgttaaactctcaaattaataatttgatgaaagccccgttaaagccttggcagaagttcaaaattctgaggcaaacatctgataccatcgggtggatacactgccttcagagcccttctgtttcgaataaagtcctaagggaggctgacaggaaaattaagagagcggttaaatcgattcttcacttaccggttactattgccgactcgtcgatctatgcaagccagcgcgatggtggtctcggggtcttctgcttctcaaggaagattcctgtcattcttcgctcgcggtgggagtcgctacaggagatggctgatcccgcgcttggcgctgttctcctgcaatcggagagatgcatggatagagtctcgagactaattaaagaggactggagatctgacagcgaaatcaagaacagttttaggcggagccttgagaattcttggtgcgggggtggaatccatcaagtagggataatcaagcttgcaagtaaatatctgctgcacccccctgccttttggacaggaagggactatgtgtccacaattcagctgaggctgaacgcgcttccttccagaggtttaccatccaacccccccgaccagcgtatgtgtaggactggatgtggcagatctgagtccctatcacacatcttacagagatgtggattcgttcagggccatcgaatatcacgccacaaccatgtcgcaaggaaaattaggaggttggccgagtctaaggggtgggaagttagggaggagcctactatccgcaccaatgaacaggttttcaaaccggatctacttctgattcgcgataatgaattaatagtgtgcgatgtctccattaactgggaaggtccgtcccactttccacacactatcaggataaatttaataagtatgccactccaggtgttatccaatggctgcaacaacgattttccccgacaaactgtcagattccttccctttatattgggtgctaggggatcttggtgtggcgacaacaggagtttagttgacgcgcttgaactcacacagcgcaatatagaagatctaatacttacatgtctcactgggagccttatcatctataagagcttcatgaagtcggtctggaggaggactgtcgcgggtgactaa

SEQ ID NO: 321 - DNA, 1410 bp, Tenebrio molitor
gcctacgcggacgatatcatcctgcttgcagataacgtcgagactgcgcaaagacttctcaacgcctccacaagattctttgaagaccgggggctcgacatcaaccccgcgaagtgcgagtctctagtgatgcgtactctcccgtcaaagaagaaggtcttcactgtgacaactccgcaattctacgttaaggctgaaccgatcaagccaatagaagttggaaaggcttttaaatatctggggcagcagttcacatgcacgggttcaaccaactgctcaaccaaagatctaagcgaacagctacttagaataaagaaggccccactgaagccccaacaaaaaataaacatcatcaaaacgtatctgatgccggcctacatccactcaatgcagaacccagccgtcaacaaaaagatattacgagaagtggataggaaaatcagaatggtcgttaaggggatactacatcttccactccatttgtccaacaccgcaatatatgccccggcgaaaatgggaggtctaggaatgttttccttttcaagaaagatccccatcattgtactaaaacggttaaacaacttaagccgtacttgctcgaacttccaccttgtgttgcgagaggccgccccatgggtcaatagattaaagaaaatggtaaggccagacgtaacgacaaaagagcaagtggacagagcaaatggggtggaacatgagggttcgtactacggcggcggtacgatgcaatgtcggaacgactctgcttcaaatacttggatcaacacccccccaaggtattggaccggatcggattacgtgaaagcggttcagctaagactgaattgcctggccaccagaggccttccctataacccgccggaacaaagaagatgcagagcgggatgcgacagggttgaaagcctgtcgcacgtcttacagaaatgccctctaggacacacaatgaggatgagaaggcacaattacatcgttaaaaggcttaagaccatggctctgaagaagggatggacggtggaggaggagccgatatgcgatgcgcgcggtgtactgaggaagccagaccttatcctcagcaatgaagagacggccctagtagtggacgccatggtgtcctgggagtgccccagagaccttgcagagacattcgattgcaagaggctggtatatgaccagcctgagtttaccagcgtactcgaatctaaataccatccaaggaatatcagagtactacccttcatcatcggcgcaagaggtatgtggtgcagacagagcaccgaaacactagaagcgatgaaggtgaacaatgtgagcaatcgaagggaactggtccatacaacactgagaggaagctggagtatacatcgagaatttacgaggagaagctgggaatag

SEQ ID NO: 322 - DNA, 1565 bp, Hippodamia convergens
gcgtttgcggacgacgtaatcctctgcggcaccacttcttggggactacagagaaatctggaaatcttcgaggaggagctccgaagaagcggactttccttaaatcctgggaaaagtaagtgcgtttcccttgttgcttctggaagggaaaagaaggttaagctagtgatgaccccgacattcagagcgtcgggtagttggcttagccaggtcgatgggaccaccttctggaagtacttgggattacagtttaggggttgtgggatggccggttgtggttcggacgatgtagctgagtgcttggagcggctcactcgtgcgccgttgaagcctcagcagcggatgcacttgctgcgggtcttccttttgcccagattttatcacgtctggacatttggaagactcaatgcgggcatcctgcgtcgtctggacattcgtgttcggaatgccatccggacatcggtgcgcctaccccacgacgtaccggtgggatacttccacgcgccgactaacgccgggggactcggtattccgcaattgtcgcgcttcattccgctgttgcgtcttaagaggtttgagcgtttggctcactcctccgtcgaaagcgttcgggaatgcgcgaggaccgaacctgccgtggcgaaggtccggtggtgtcgggagcggttagcggacgtcgtagaccgggtcgcggatggaacgcagagtcttcgcgaattttggacgcgtgagctttatcggtcgatggatgggagggcgcttagggagtctgtgagagagactccgagtacacagtggctccgctgctgtacccgtgtcataccagccagagactggctcaattacatctccgttcacattaatgcattaccatcgcgtgttcgaacatcacgtggcagacgtgacggcgtggatgtgacctgtaggggcggatgcttgacagctgaaacccctgctcactgcatccaggtttgtcaccgaacccacggcgggcgggtgttgcgacacgatgccatcgcgaaggcgctgtcagtacatcttacgcagcggggttggagtgttaggagagaagtctcctatcagacggttgttggagtccgacgacccgacattgtgcttcttgcggggcgagaaatcgccgtcgtggacgtgcaagttgtcgcacctaacccttctctggacagcgcacaccgcaaaaaggtcgccaagtatcgtgacgaggctcagctcgccacgtgcttggtgcgaggagcttcggtacaaccaaggaggagagcggaagaagaaacgcaagtgcgatttgccagcgcaaccatctcgtggcgaggtgtctggtcttccgagtccgcgcggtccctgcgtgagctggggctgacggaccgggagctggcacaatacagcacctacgacctgcgtggctcctggatgaactgggtaaggtttggtgcgtctacgtctactcggatggcgtggcgcccgtaaaatctccaaaggtaatcgccaaaccgtttggtttctacatctgcgttcccttcaggaacggactcggtttcatcatttcctaa

SEQ ID NO: 323 - DNA, 1172 bp, Bacillus rossius
tgggggatccggtgaacatgggtcgggtgattgcccaggcagttcccgtggggaacatctgagtgcgctgctggacggtctgcagcccggtccggttgttgatcggcttcgcttaattgttcggtcggttgatgactggtcccgggcacgcctgcaccaggagattggttggtttttccgcgatctcttttggaagcccttgaccccaaacctggctagggtgtcacttccatctaaagacaaggtgtcacgccgcagactcaggcgggcggactatggtcgagtccagagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagattctgtattgaatgtaatgg

SEQ ID NO: 324 - DNA, 1172 bp, Bacillus rossius
tgggggatccggtgagcatgggtcgggtgatgtgccaggcagttcccgtggggaacatctgagtgcgctgctggacggtctgcagcccggtccggttgttgatcggcttcgcttaattgttcggtcggttgatgactggtcccgggcacgcctgcaccaggagattggttggtttctccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagtggtcggacagccgagagaactgagttgtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggcagactcccggattatctcctcgagtcgcgcaccacactgataccaaagagagacggtgcttgtaaccctgaagatttccggccgataaccgtttcctctgttgtggttagatgctatcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 325 - DNA, 1172 bp, Bacillus rossius
tgggggatccggtgagcatgggtcgggtgatgtgccaggcagttcccgtggggaacatctgagtgcgctgctggacggtctgcagcccggtccggttgttgatcggcttcgcttaattgttcggtcggttgatggctggtcccgggcacgcctgcaccaggagattggttggtttctccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagagggcggacagccgagagaactgagttgtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 326 - DNA, 1172 bp, Bacillus rossius
tgggggatccggtgagcatgggtcgggtgatgtgccaggcagttcccgtggggaacatctgagtgcgctgctggacggtctgcagcccggtccggttgttgatcggcttcgcttaattgttcggtcggttgatgactggtcccgggcacgcctgcaccaggagattggttggtttctccgcgatctcttttggaagcccttgaccccaaacctggctagggtgtcacttccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctttggatggttgttcagagggagtcttcttgctggacttcattcttgcacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 327 - DNA, 587 bp, Bacillus rossius
taacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcgatatggttatcgaccgcttgtttactctgttccctcgggatacgggagtatcggtgggagatactgtattgaatggaatgg

SEQ ID NO: 328 - DNA, 587 bp, Bacillus rossius
taacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagtcgtaaccaccgaccggtgcacttggcgtctctcgacgtggccatggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtatcgaatggaatgg

SEQ ID NO: 329 - DNA, 587 bp, Bacillus rossius
taacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 330 - DNA, 587 bp, Bacillus rossius; identical to SEQ ID NO: 329

SEQ ID NO: 331 - DNA, 587 bp, Bacillus rossius; identical to SEQ ID NO: 329

SEQ ID NO: 332 - DNA, 587 bp, Bacillus rossius; identical to SEQ ID NO: 329

SEQ ID NO: 333 - DNA, 587 bp, Bacillus rossius; identical to SEQ ID NO: 329

SEQ ID NO: 334 - DNA, 587 bp, Bacillus rossius; identical to SEQ ID NO: 329

SEQ ID NO: 335 - DNA, 587 bp, Bacillus rossius; identical to SEQ ID NO: 329

SEQ ID NO: 336 - DNA, 587 bp, Bacillus rossius; identical to SEQ ID NO: 329

SEQ ID NO: 337 - DNA, 713 bp, Bacillus rossius
gtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 338 - DNA, 713 bp, Bacillus rossius
gtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgttacctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtacgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggactgg

SEQ ID NO: 339 - DNA, 713 bp, Bacillus rossius
gtgggacccggtgtcctcgaaggaggttgaacaagctcttcctcctctcgggacagcaccgggaccagattcctttacaccaaaggacttcagagcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggcgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 340 - DNA, 713 bp, Bacillus rossius
gtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcactcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 341 - DNA, 713 bp, Bacillus rossius
gtgggacccggtgtcctcgaaggaggttgagcaagctcttcctcctctcgggacagcaccgggaccagattcctttacaccgaaggacttcaaggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 342 - DNA, 713 bp, Bacillus rossius
gtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggctagatgctttcataaggtgatcgccaacaggatgtccaggcgcattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcggggtggcccgctctcacctatgatattcaatatggttatcgaccgcttgtttactctgttccctcgggattcgggagtatcggtgggagatactgtattgaatggaatgg

SEQ ID NO: 343 - DNA, 713 bp, Bacillus rossius
gtgggacccggtgtcctcgaaggaggttgagcaagctcttcctcctctcgggacagcaccgggaccagattcctttacaccaaaggacttcagggcggtgccgtctgctatttgggcttgcatatttaacatctttatgctgtgtggccgactcccggattatctcctcgagtcgcgcaccacactgataccaaagagagacagtgcttgtaaccctgaagatttccggccgataaccgtttcctctgttgtggttagatgctttcataaggtgatcgccaacaggatgtccaggctcattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 344 - DNA, 713 bp, Bacillus rossius
gtgggacccggtgtcctcgaaggaagttgagcaagctcttcctcctctcgggacagcaccgggaccagattcctttacaccaaaggacttcagggcggtgccgcctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatttctggatggttgttcagagggagtcttcttgctggacttcattcttggacatgccagacgtaaccaccgaccggtgcacttggcgtctctcgacgtggccaaggcgtttgactctgtgtcgcacgcagccatccttgatgtgcttcgatcatatggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 345 - DNA, 713 bp, Bacillus rossius; identical to SEQ ID NO: 337

SEQ ID NO: 346 - DNA, 713 bp, Bacillus rossius; identical to SEQ ID NO: 343

SEQ ID NO: 347 - DNA, 823 bp, Bacillus rossius
gagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcaggcatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtaacggtgggagatactgtattgaatggaatgg

SEQ ID NO: 348 - DNA, 823 bp, Bacillus rossius
gagtcagcaccacccgaagaactaatggtgccttattgggagagtgtgctgcgttcgggatcgtcttgtactcccggtcaaagaggtcggacagccgagagaactgagttgtgggacccggtgtcctcgagggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttcaggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtaacggtgggagatactgtattgaatggaatgg

SEQ ID NO: 349 - DNA, 823 bp, Bacillus rossius; identical to SEQ ID NO: 348

SEQ ID NO: 350 - DNA, 823 bp, Bacillus rossius
gagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatcttcttgagtcgcgcaccacactgataccgaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggggtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttttcgaccgcttgtttactctgttccctcgggatacgggagtaacggtgggagatactgtattgaatggaatgg

SEQ ID NO: 351 - DNA, 823 bp, Bacillus rossius
gagtcagcaccatccgaagaactaatggtgccttattggaagagtgtgctgcgttcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgagtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtaacggtgggagatactttattgaatggaatgg

SEQ ID NO: 352 - DNA, 823 bp, Bacillus rossius
gagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctatttgggcctgcatatttaacatctttatgctgtgtggccgactcccggattatctccttgagtcgcgcaccacactgataccaaagagagacggtgcttgcaaccctgaagatttccggccgataaccgtttcctctgttgtggttagatgccttcacaaggtgatcgccaacaggatgtccaggcacattcagttggaccctcgccagaaagcttttcgatctctggatggttgttcagaggaagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatctaatggttgagtacattgcatctgtgtatgcaggatccaggactcggctccagggtgatgggtggcaatcccatgctattcaccccacttgtggggtgaagcagggtgacccgctctcatctatgatattcaatatggttatcgaccgcttgtttactctgttccctcgggatacgggagtaacggtgggagatactgtattgaatggaatgg

SEQ ID NO: 353 - DNA, 823 bp, Bacillus rossius
gagtcagcaccacccgaagaactaatggtgccttattgggagagtgtgctgcgttcgggatcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgttcagagggagtcttcttgctggacttcattcttggacatgccagacgtaaccaccggccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtaacggtgggagatactgtattgaatggaatgg

SEQ ID NO: 354 - DNA, 823 bp, Bacillus rossius
gagtcagcgccacccgaagaactaatggtgccttattgggagagtgtgctgcgttcggggtcgtcttgtactcccggtcaaagaggtcggacagccgagagaactgagttgtgggacccggtgtcctcgaaggaggttgagctagctcttcctcctctcgggacagcaccgggaccagattcctttacaccaaaggacttcagggcggtgccgtctgctgtttgggcttgcatatttaacatctttatgctgtgtggccgactcccggattatctccttgagtcgcgcaccacactgataccaaagagagacggtgcttgcaaccctgaagatttccggccgataaccgtttcctctgttgtggttagatgctttcacaaggtgatcgccaacaggatgtccaggcacattcagttggaccctcgccagaaagcttttcgatctctggatggttgtttagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatgggtgagtacattgcatctgtgtatgcaggatccaggactcggctccagggtgatgggtggcaatcccatgctattcaccccacttgtggggtgaagcagggtgacccgctctcacctatgatattcaatatggttatcgaccgcttgtttactctgttccctcgggatacgggagtgacggtgggagatactgtattgaatggaatgg

SEQ ID NO: 355 - DNA, 577 bp, Bacillus rossius
taacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattg

SEQ ID NO: 356 - DNA, 587 bp, Bacillus rossius
taacatctttatgctgtgtggccgactcccggattatctcctcgagtcgcgcaccacactgataccaaagagagacggtgcttgtaaccctgaagatttccggccgataaccgtttcctctgttgtggttagatgcttccataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcagggtccaggacacggctccagggtgatgggtggcaatcccttgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 357 - DNA, 587 bp, Bacillus rossius
taacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgccggacttcattcttggacatgccagacgtaaccaccgaccggtgcacttggcgtctctcgacgtggccaaggcatttgactctgtgtcgcacgcagccatccttgatgtgcttcgatcatttggtgtcccggatcaaatggttgagtacattgcatctgtgtatgcaggatccaggacacggctccagggtgatgggtggcaatcccatgctattcaccccacttgtggggtgaagcagggtgacccgctctcacctatgatattcaatatggttatcgaccgcttgtttactctgttccctcgggatacgggagtatcggtgggagatactgtattgaatggaatgg

SEQ ID NO: 358 - DNA, 1456 bp, Ciona savignyi
ggtctcaaggttcagccaagtaaatgtcactcccttgggatcagccacacccggggaaaaacatctgtgacacgggtaagagtcaacccattcctcaacatcgatggcaccgacctgcccgttgtccccccgggaagctggataaagttcctcggcatcatgatcggaccccatggatcctgcagactgcagcgaaacaccatctccgaagctctcaagcgtctgatgggggccaagctgaagcctcagcaaaagatctacatgctgaagaaccatctgattcccaggtggagatacagtctatccatatcagaacaaactcaacagacactctactgggtggaccgagaggtcaggcgcacagttaaaaagatcttgcacgcgcctgggtgcctctcggacaacttcatacacctggatagccgcaatggaggactgggcatttgctcgatgactgaatggacgtatgtcgcaaaaatgcgtcttagaagcaggctcgccgactccttggatccggcaatatccgttctggcgcctaccatctacagcagaacccacgctgtgataggcgccaggttaaagcggatgctaggagaggaacctaccatcaagtccctacagcaacaccgtaagaagaccctctccgagcaggtccaaggatacggctcagagcattttaataacagttattctaacagctggttatcaggatcgaccagattgatctctggccggaactacgtgcaagcctgtgcactacgcacgcaaactctaccaacccgagaggcagtttccaggggaagatccggcaccaataacatctgccgaaactgcgggttggaagaggagacattatcccacattctgcagaactgccatcgaactaataagataaggatacatcgacacaacgcagttctgcagatattaactcaacatctttgcaggaggaattggagaatccaagaagagccactgatcccaactcctgggggtaatgttattaagccagatgtcttggcgacggatccggagggaaacctctatgtcatagacgcagcgtgcccgtacgaagggggaggcgactccctctcgagggccgctgcggcgaaagtggaaaaatactccgcctacgaaacatctattcggcggtacatagggaggaccccacgaaagaccatcttcgtcggattcgtggtgggggctcgtggcgccatgccacctcagacacaagagttctgcaagcaggtaggtcttggtaagggcaaattacatcttatgtcagtacgggccatagaaggaagcctcaaaatcttccgattatttatggccctgtagtgttaaaactcgggtacgcacccacggagtatacgcaagtggtacttcggtaatgcgaaaagacaaggtgttaaggatcctaaccccatggtaaggaacctatataccacgtcataca

SEQ ID NO: 359 - DNA, 2418 bp, Ciona intestinalis; identical to SEQ ID NO: 149

SEQ ID NO: 360 - DNA, 2338 bp, Ciona intestinalis; identical to SEQ ID NO: 148

SEQ ID NO: 361 - DNA, 3721 bp, Ciona intestinalis; identical to SEQ ID NO: 151
  modified_base (449)..(449): a, c, g, or t

SEQ ID NO: 362 - DNA, 1882 bp, Triops longicaudatus
ctagcattcgcagacgacctagcattgatatcaggttctgagataggtatgcagcaacttctcttacttacagaaaagtttctctcttgtcgaaggcttgagctcaatgtgaagaaatgtgtcgctatttgtctccggaaagcaggaaaagcgaaaaagtctcagattgctgattcaactgttaagaatccaccagtcttgacaattaagaatgagccaatccgtctactcggagtgaatgaacaatgtaaatatcttggaattcattatacacctctcggtgcagtagacacaagggcatcagtgtctaaactacgtttagcattgacatcattaatgaaagcgccgttgaaaccgcagcaaaaagtggtgatgcttcggatgcatctcataccaagattcatacacacatttacatacagtgaatgttacccgaagcttctgagtcaactagaccgactcgttcgacggtggctcaagactgcactaaaattgcccacatcacttagtagtgattttttctatcttccaattaaagaaggaggtttgggtatcggcaagctctatgatattgtaggcttcgctaaagttcgtctgtacaacatgttcgcgcgttcaggagatgtgtgtttgcaatatcttgttgatacgcaaggatcctcgatgcatgcaagatggtgtcaggcaatgaaggttagctaccgaccaccactagccgaactcaatcagaggaagatagttgtaagagatgaaggtcgtgacaggttcatcaagacagtacatggtagcggacacgaagtgtttcaatcgagcccgataaccaatcaatggttgtctggtcagaccagaatcatgagaggtagtacgttcatcagatctattcaaatgagaacaaatactattccaactcgtgtttcaacgtcccgtggtcgtaattcggttaaaacttgccgtcgttgtggactggctgatgaaactttgatccacgtattacagacatgtccaatcactcatggcatgcggtgtcaaagacacaataatgtttgtcgaaaagtagccgataagttacggtcgaaaggattccaagtgttctcagaacaaggcataccatcgccaggattgcagacgaacatcagtcgacctgatctaatcgcaattcgagctgaacaaggtcttgtgctggacataacgtgcgtcttcgaatctagtaggaatagtctaactgacgcctatcgtcgtaaagtaacccgttatgagagcttggcggaaactatcaaagagaaatataaaatcgagaccgtacaatttcatgggttgtgtatcggcagcagaggggcgattgaaccaagacatctttcaatttggcactcgatcgggttttcgggtagcgaattgagtgtacttgcagtaggcgtgatggaagactcactaaggacaatcacattatttaataatgcaaatcgaatccgcgtttaacacagatttgagatgcttgttgtataatgttggttaggtgagagaagagggcttatgatggttgcggtcatggtattgatgttaggtgtatcatctacaggtgaatgtgtgtggtgaaattctatcaatcatctgctccagtgaggcaacgacatgactttttgatgttccgcaaggaacggaatgtatgcgaccccaactgacccgatgattgattcaatattcaaatgttattgctgttaattatttcacatctaatatatcgaatgatataattgtaaattctcttttctcttgtcttccttctttcttcttacgtctcgttttcttcttgtcttcacctttacggctggacaggtcttacttgcgggccacccaaaaatgcaagaaagtttttattaataaa

SEQ ID NO: 363 - DNA, 2106 bp, Procambarus clarkii
gccctggcgttcgccgacgacctggttgtggcagcggaaacggctgccggactacagacactcataaccagtatttgccgcacgctgcgcggctctggtctcaaagtaaacgccgcaaaatgccggacgctgagcatagcgattgatgcgcatcggaagacatggcatgtccccaccaggaaggcatattatgtcggagacgatgcaatcggtactatgagtgtggcggacgagtacaagtacttagggatactgatcggagccgggggcagacgcttatcctatggttccctgtttgaggacggcctgaccaacatcaccaaggcgccgctcaaaccccaacagaggttatacctactaaagcaccacctaatccccaaaatgaaccaccgccttgtcctcggacacgtggctaaaacggagttggcgaggttggaccggcggctgcgacacgccactcgtggctggctgcggctgccccatgacacccccaacgcctttatccacgccgacgtcaaggacggcggactagggatacccgactttgccacatcgatccggctacaaaagaacaagcggctcggggcgctgaccggatcagcggacccagtggtggtggcagcggctctcctacccgcattccaagcgagaatgcgccggtgggtagacccggccacggccgctggaacgccatccagcaggacgaccgagtgcgctagaagatggagggcaaaactgtacagcatggtcgacggcgccggcctcgcttcctcttgtgaggtcccatcctgtcacaagtgggttgcgtccggcacccgtttgctaagcgggggagattttgcccacgccgtccaaattagggcaaacgctgtagccacgccgtctagggcggccaggggtagacccgaggcttctggtctctgtgacgcttgtcggaaaccaggaaccctgggccacatatcccaggcctgccataagacacacggggctcgggtgaaacgtcacgacgacatcacccggttcgcagctggccgattgcggcaaagaggctttgaggtggagcgtgaggtccgtataccagacggagggaccttctgcaagccagatattatagcttgcaaaggtgatgaggccttcatattagacacccaggtctcagctgataacttcccactctcccgtccacatcagagcaagtgcgacaaatacggcacccccgagatcctgcagaaggtccgggagtataccggtaagcccacagtatccgcctcctcaataacccttaattggagaggtggatggtgcaaggagagtgcgcgtggtctacaaggtatgggtctcaccaagagcgatctcgagatttgctccgtgaaggccctgacctggacatattcgatatacagaatatggtccaaggccacgtcaaggggcaggcccccctagccccggggtcactgtgcacagggtgcataagggtaactatagtcacgcttaggtgaaccgcagccaagtcagctggtagccaactatctaagcagtttcgtcatctggagtaccacttctcctaatggcgtctcacaagagggtggatgacctggcagagcccgcgagtagataaggcggcgtccggagggaccccatgcgcatacatgataaccctcccgctccggggccgagttaggagcatccactgtgtctagttttccatgtatgccgatgtcaaatcatcatccctgccgattgggcagcctgctgctttggccttcagcgtttgtttgttctttttacatgttatactgtgcacccctacctatgtgtgctgtgtcccatatagcaaaaaccaaacacaaaagaattttccatyaatatttttgtttattttcagggtattattatgtattattagtatcatcttaactcttgtgggtgtgatgagatctgccatatatgtttattttaggtttgggcgtgttagggtattaggtatgcttaggggtccgtctcgccatgccctgtggctggggggatcgggctccgaagctacataaaaaccctatacccccccgaagtggcaaggggagttaggggacacaaaaaaaaaaaaaa

SEQ ID NO: 364 - DNA, 1901 bp, Hasarius adansoni
gccctagcgtttgccgacgacctgatgatcttcggcgagagcccgcaagacgcccaagaaagactgcaagtcacacagaagtacctgagcgccttgggtatggaagtcgcggcctccaagagcgtcgccttccacatccgggcgcgccacaagacctggtcgcttgaagacccagacgcgcaaatttttggtggggcaatcccgggcctacgcagtgaccagtcgctgcgttatctcgggataagttattcgccatggcggggcttcgacgccctggacctgccggcgaattttgaagacgcgctgggcagggttaaaggtgcagctctgaagccttaccagaagctgcacctgtggcaggcctatatccagccgcattttctacaccagctagcactcgcaatgccaccccgcggtgcgctggagcggctggacgttgctgtacgcgctatggtgaagtcaatctttcacctacctcgctgcatcaccgacggcgtgctgtactgcaggccgcgcgatggcggcctgggactccagaggctctcgcaactggtgccccgggtcgccctcgcgttgggctgtaggatggcgcgctcagaagactccttctgcggggacatcctccgatgtcaagaaactgaatcccgcctgaagcgggcggctgccgcctcccgcatcatctggccctgcaaccttgaagatgtggtatccttgaagaaacgacagctgaaggcggagttcgcgaggtggactagcctcggctgccagggtaaagcggcgctggcacatggcaacgacccggtgggcaatgcgttcctcgcaaagcctaccctgttgaagcagtgtcgcctggtgacagcactccaactccgcacggacaccgcggggaacagaaccgcactcaacagggccatcccgcagaaggacgtctcatgcaggcgatgtcacgctgcgcccgagacgctggggcacatcctgggcctctgcgtctgcaccaagtcggcgcgcatccaccggcacgatgaaattaagcatttcatcgaggcgcgcctcttggagcaacgggggacgacggtgtcgaccgaagtctctctcagtcttcctgacgggtccaaactcaaacctgacctcatcgtgttgaatgaggaaggggccttcgtggtcgatgtaacagtccgccatgagggtggggatgggctcgaaaggggggctgcggagaagattaggaagtaccgtccagctctcccggtcgcggcgcagctcctgagggcagagagcgcaagcgtgctccctatcgttgttggcgatacgggggccatgcctccgcagaccatcgcggcgctcaagcggctcggcatctcggcagacatgcacatgaggacaatctctctcgtggctctccggtcctcgatagagatttaccacatgttcatggactacgatggtgtcgggtaagtacagcagcgggccaaacatgtaaatagccttcattgctatccatctttttcctatgtactttaactatccactagctttcaacttccaccttttttcatcttggagctcccatggtgggcggcaacgaacatcatgggatgcgagtcttgcggcaacgcaaggcggcgggtggccgaacactctaagtgtgaggcctgtggggcacctccgcgtggttttccctgggggctcctcaagccgccaagacccctccagctgtgctggcccgcttcctaatttttccaagtccgctgcctcggcagtgggtttgcagtggtagatttcaccgggcgagggaatctcgttgtcccatgtgatggaagattcgtgcaacaccatgggcaatctagaaagcactacggtaccccgccgttattgggggaaatgcgcttcggcgtagagtt

SEQ ID NO: 365 - DNA, 1756 bp, Metacrinus rotundus
ctagcattcgcagacgacctagcgctggtgagcagaacaccaagagggctacagagcaacctgaacagactctctgagagcctgcgtctgagtggtttgattgtgtcggctggtactggaggtaaatcggcctcaatgaggatagacattgacgggcgtgcgaagaaacacatagtgaatccgagtgcgtacctgtctgtcgacggagaaaatgttcccgcaatctccataacgaagacatacaagtacctgggtatacaggtcggagcgcacggaacacgcgctgaagtgaaggaaaagctggttgccggtctggcaaacctgacaagagcacctctgaaaccgtttcagaggctccacatattgcgtgtccagctaatgccttcgctaacacatcagcttgttctggccggtgtaaccaaggggtacttgaaagacctggataggcttgttagagcagcatcacggagctggctcaaactgccgcacgacacacccaatgcgttcctccacgccaactacaaagatggggggctgtccatagactcattgagtctgaccattccctttctgaaaggaaagcggtttggcaaactgacagtttcatcagacgataccgtgttggcagcgacagagacgaatagtttcaaacgaatgcataagaaatggagagaggcgcaagtgaaagagggcgctcttatgaattctaaagcggctattcgtcgcggatttgctgcccagttacatggcactctggatggtgcaggcttaaggtcgatgccacagagtggccatattcaacgatggatcacggatccatgtccgccctgtaatgggagaaactttacggggcgcgtaaaagttcgcgcaaacgcgcttcttacaaagacgcgagcgagtaggggcagaaatggcgtcgatgtgagatgcgattgttgtggacggccggaatctctgggccacattttgcaggtctgtgcgcggtgccacggaaagagggttgcacggcacgataagattgtgcaaaagatgagagaacgggcaagcaaggcggggttcgaggtgagagtggaaccccgcattaggggcgagagcggaacgcttgtgccggatattgtcatggtcaagggtaggaaggcctacgtgctagaccccactattgtggcggacaatgccgacttggacgaccaggtcaatgcgaaacaaactaaatatagcgttggttcagtgaggaaatggattcggagcgagttcaagaaccaggacctagaagtggtggcgaaaggtctggttttgaattggagaggagctatggctgccgagtcatacgccttgctgacgcaagagctgaagtttggtttgagcttttgcaggatgctggtgagcatagttttggaggagagcttctatatgtacacgcattttatgcaaagtacttttagatgctctcaggccacgcgggccaggaacgctcgatgacgttcttagatcgagctttacgggtgcatgagtgcgagaatgtgactcaatgacgctttctacctaaagcctccgggacggtagttgtgccgaaaagactccgaagctccctcagccgcggtgtagcgaccgcctttgcaaatacgcaaaacccatcccgtcgggtgtttaatccgaacggctaacggtgcttcgttataatcatattaatttacgaggtacgagtaatttaacgccgagcgtgccaccttttgcaccgttccgtgcccgatgggat

SEQ ID NO: 366 - DNA, 1766 bp, Mauremys reevesii
ctcgcattcgcagacgacctggtcatgctgagtgacacctgggaaggtatgaataaaaatatagaaatattggaagccttctgcaagctatgtggtctaaaagtacaagctaaaaagtgctacgggtttttcttaagtcctacccacgactcatatacaatcaacaactgtgatacctggaatatagataaagacagtttgaatatgatcctaccaggcgagtcggagaaatatcttggacttaaagttgacccttggattgggttctccaaacccttacttgcagaaaggctcgctatctggcttaaaagacttactaaagcgccactaaagccttcacaaaagttaacaatgctgaacatctatacaatcccacgaatcatctacctggctgaccacacagcaaggtcttcttggtatctatcttcattggatgataacatcagaaccgtcataaaaaggtggctccatctaccacctgatacttgtaatagcttcatctatacaagaactgggaatggtgggctgggagtgacgagactcgctagcctcatcccttcaattcaagcacggcgattgcatattattgcaaattctgaagatgagacaattcggtctattgtactggcaaacaacattgatgaagaatttcaaaacctatggataactgccggtggaaaagaagatgaaatctctagaataacagatccagtatctattgattatagactaccccgacggatcctggaacttctcaatgaatgggaaaaaccagctcccaagaaaatatacccaatcccatgcaattggagagaaacggatctggcccattggaagaatctgccatgccagggcagtggaattgaacattttgaaaatgatataataagtagcgactggctacaattccatcatggattctcagaaggacaattccttataggcctcaaactcagagcaaacgtgtaccccaccagagaatatcaaggacgtggcaggatgaacaagaaagtgaattgtagatcctgcactgcctcctatgaatctctatcccacatcttagggcagtgtcctgcggtacaagaaacccgcatacgaagacacaacaagctatgcaacatattaaaacgaaaagccaaagatttgaaatgggttgtttacgaagaacctcacctgctcaccacggagaaggaattgaggaaacctgacctcattttcgttaagaaagagatcgccctggtggtggacgtcactgtctggtacgaatacatggagaaagtttttgaggatgcagcagcagaaaaggtgagacactacaaagatctgacaagtcagataaaagaactaactggagccaaagaaattgaatactacgggttccccctaggcgcaaggaggaagtggccaaagataaatgagaaagtcctgacagcccttggcatgccggactaccagcaaaaaagaactgctaaatgttttagtaaaagaactttgttatattccattgatgttataaacacctttgaaagcattggaaaaaacaataaaaacactgttccatgaggtcctgtccctcatgtgctgaatttcttttctaacctatctcttatccaaactatatacccaccccaccttttcatgggaatctcgtaatgattacaataattcatgaccgctcactggacacgcgcaactctggttggatgggccaccaggggtgtacactccgaataacccgaaaaagaaacccgcgagggtttttaaaa

SEQ ID NO: 367 - DNA, 1775 bp, Mauremys reevesii
gcactggcgtttgcggacgatttggttatgttgagtgacacctgggaaggtatgaataaaaatattcaaatattggaagacttttgtaagttatcaggcctgaaagtacaagccaaaaaatgttatgggttttttgttagtcctactcatgactcttatacaatcaataattgtgagtcctggaatatagacaatgatagtttgaatatgattttaccaggcgagtcggagaaatatcttggacttaaagttgatccatggattggattttctaaacccttgcttgaagaaaaacttgctgtttggcttgaaagattgactaaggcaccattaaaaccttcgccaaagttaacaatgttgaacacttataccataccacggatcatctatttggctgatcatacagataccaaaaagaccttgctatcgtcattagatgataccatcagaaccgtcgtcaaaggatggctccatctaccacttgatacctgtaatggttttatatataccagaattaggaatggtggattgggagtggcgagactcgctagtctcatcccttcgattcaagcgcggcgattatgtagaattgcaaattctgatgatgagataattcggtctatcgcattggcaaataacatcgatgaagagtttaaaaatctatggataactgctggtggaaaggaagataaaattcctggaataacagatccagtttttattgattatggacttccccgacagatcctggaatctctcaatgaatgggaaaagccagctcccaagaaaatttatccaatcccatgtaattggggagaagtagaattggttcattggaaagatttgccgtgtcagggcagtggaattgaacattttatcaatgatacaataagtaatgactggttacaatttcatcctgaattttcagaaagacaatttcttataggccttaagcttagagtgaatgtatatcccactagagaatatcaagggtgtggtaggatgaataagaatgtgaattgtagacactgcactgcaccctatgaatccctttctcatattttagggcaatgttctgcggtgcaggaagcccgtatacgacgacataataaattatgtggtctgttaaaacaaaaagctaaagatctgaaatgggttgtctatgaagaacctcacctgcaaactatagagagggaattgaggaaacctgattctatctttgttaaggaagatgttgtcctggtggtggatgttactgtccggtccgaatatatggagaaagtttttgaagatgctgcagcagaaaaggtgagacattataaaaatctgacaagtcaaataaaagaattgactggagctaaagaggtagaatattatgggttccccctaggtgctagggggaaatggccaaaaatcaatgagaaagttctaacagcccttggcatcccgacttatcagcataaaagaattgctcaacgttttagtaaaagaactttgctatattccattgatattataaacacctttgaaagcattggaaaaaacaaacaatttactgttccatgaggttctgtccctcttgtgtcttgaatttcttttctgatatctttttcttatccacactatatacctatcccttttcttgggaatctcgtgatgattattataattcatgaccgctcactggctatgacaaaactttggttggacgggccacctggggtgtttattcactccgaataactcgaaaaagaaacccatgtgagtttttaaaa

SEQ ID NO: 368 - DNA, 1725 bp, Mauremys reevesii
gccctggcgtttgctgacgacttggtcatgctcagcgactcgtgggaaggtatgactgctaatatcaaaatccttgagtccttctgcacactctctggactcaaagtgcaagctaagaaatgccatggattccaagtaacccccacccatgactcattcacaatcaacaattgtgaagcctggaaaatcggagacgacaccttaaatatgatcattccaggagagtctgaaaagtacttgggggtgaaggtcgacccatggattggctttgccaaaccggcattatccgaaaagcttgacacttggcttgagaggatcaacagggcccctctcaaaccttccccaaaattagcgatgttaaataccttcacagtatcacgagtcatctacttggctgaccacaccgattgtaagatagcccacctctccaccctagacgacaaaatcagaagggctgtcaaagagtggttgcacttgccggccaacacctgtaatggtttcctgtatgccagatccagggatggaggactgggagtaacaagactcgccagcctcatcccatccattcaggcacgacggctacacagaattgcacactctaaagatgaaacaatccggtgcatcgcattggctaatgatatcgagagcgaataccgaaagctgtggctggctgcaggtgggaccctagatactatgcctgcaataacagacccggtgatcatggatcaccaattgccacagcacgtcctggaacaactgaccgagtgggagaagccggctcccagggcgatatacccaatcccatgtaactggagaaccgctaaattctcccagtggaaagatctaccatgccaaggcagtggggtgagtcacttcgaaaacgatcctaccagtaatgactggctgactcaccacaaagggttctcccaacgccaattcctaactgctttaaaactgcgagcgaacgtatatcccaccagagaatacctagggcgtggcaaaagtaattccatcgtagggtgcaggcactgcagcgcatcatatgagtctttgtctcatatcctgggacaatgtccggcagtacaaggggctcgtattcgcagacataacaagctttgcgacattctaacacgggaagctcgtaagcttcaatggaaaatctataaagagccaaacctgcgaactgccaacaatgaactgcgcaaacctgaccttatctttgtcaaagaaggaaaagctctggtggtcgatgtcaccgttcgcttcgaatataaagagaaaactttctcagatgcagctgcagagaaagtgagacactaccaacctctcacagaggaaattaagaaactgactaatgccagcgaggtcagttactttgggttgccccttggtgctcgtggcaaatggcctaccatcaatgagagggtactctcatcccttggtctgtcagagagcgcgcaaaaaaggacggcaagactacttagtcgaagggccatcctttactcgacagacatactgagcacatttgaaagcataggtaagggcctctcaaacccagctgacgccaagcccgaagggactccaacccgacagaggggaatcttgtaatgattacaataattcatgatcgcgatcacaggatgggaccaacagggttggacgggccacccggggtttggtacaccccaaataactcgaaacagaaacccgcgtgggtttgttaaa

SEQ ID NO: 369 - DNA, 1647 bp, Oryzias latipes
gccctagcgtttgccgacgatctggtgctggtgagtgactccgaggaaggcatggggaggagtctcgggattttggagaagttttgccaactgactgggctgagggttcagcccaggaagtgtcacggtttctttatggacaagggcgtggtgaacggctgtggaacctgggaaatctgtgggtcaccgatccacatgattcccccgggggaatcagttcgttatttgggagtccaggtaggcccggggcgcggcgtgatggaaccggatcttatccctacggtccacacgtggatcgaaaggatctcggaggctcctctaaagccctcacaacgcatgagggttttgaactcattcgctctcccccggataatttaccaggccgatctagggaaggttacggtaaccaaattggcccagatagatgggattgtccggaaggctgtgaagaagtggctccatttgtcaccatccacgtgcaatggactgctgtattcacggaaccgcgacggtggtttgggcctcctaaagctggaaagactaatcccatccgtgcgcacgaagcgtatctatcggatgtccaggtctccggatatctggacacggcgaatgaccagccattctgtgtcaaaatctgactgggagatgttgtgggtccaagcgggaggtgagaggggcagtgcacctgtaatgggtgccgtggaggctgccccgaccgatgtggagagatcgccagactacccagactggcggcgtgaggaaaacctggcatggtcggccctgcgggtgcagggtgtgggtgcagaccagtttcgaggcgacaggaccagcagctcttggatcgccgagcccgcttcggttgggttcgcgcagcgccactggttggctgccctggcgctgagggctggggtgtatccgactcgggagtttctggctcggggtaaggaaaagtcaggagcagcttgcagacgctgcccggccaggttggaatcatgttcacacatacttgggcaatgtccgttcgttcaggcgaacagaattgcgaggcacaacaaggtgtgtgtgctcttggccacggaggcggagaggttcggctggacggtaataagggagttccgtcttgaggacgccgctggcggtctcaagatacccgacctggtttgcaagaaggccgacacagttctcattgtcgacgtgaccgtccggtacgagatggatggagagacgctaaaaagggccgcatcggagaaggtggaacactatctcccagtagggcaacagattacggacaaggtcggagggcgttgctttaaagtcatggggttccctgtaggtgctaggggaaagtggccggcgagcaacaacacagttttggctgagttaggcgtccctgcaggtcggatgaggacctttgccaggctggtgagccggaggactcttctttattctttggatatattgagggacttcatgcgtgagccggccggcaggggaactcgggttgctctcatccctgcggcaacgggtgccgcgaattgaggaggacagctgggagtctcggcatgattacagatcttgcgctacactcggatgtcgtccccgtgacggacacattaatccggaaagcgagtggtgactcgcctcaag

SEQ ID NO: 370 - DNA, 2492 bp, Tanichthys albonubes
gccctggcgtttgcggacgacttggtactgatcggaggatcttggagtgacatggcagtgaacctcaagttgcttgatacattctgtcgggactcaggcttggcagttaacacggggaaatctcggggtttcctcctgcagccatgcagcggctcctacacagtcaatgactgtgccccatgggttctggggcaagggacgctgcaatttaccaccatcgatgagtctgtgaaatacctcggattgcggctcagtccttgggatggcataacaaaaacagactgggtgggggtcctagatgggtggatcggcaacatcagtagatcactccttaaaccatctcagaaggtggtcctccttaatcagtacgcgcttccccgcctgttctaccagatggacctggcggaggcaagtgacggtgtgctccggaccttggacggaaagatcaggggggctgtgagggcgtggctacaccttccacagtccacctgtgaagggctattgtatgcaaggaaccgggacggtggactgggtctttgcaaactttctcgacacattccgtccatgagtgtgagaagactcttccacctctctcactcctcaagttccgtagtgagggccctgttgcgaagctcagaggggcaatcaaggttcgaaagggcatggctaagagctggcggaacggctgacaacctccctcaactggttgagggaggatcgaacgatagaggagacaccgccagctcgttgacgccaatgtgcccagtcccatgtgactggaggcgggaagaatttgtgaggtgggcaggtctactaacccagggtgtgggtgtcctcggcttctatggctcgtctgcgagcaacgcgtggctgagggggccggtgcgactgtctgaaaaacagttcgtagcggcgctccagttgcgagccggggtctaccccaccctggaattcagatgtaggggcaggagcaagacagttgcagcctgcagacactgctcagccacattggaatcctgttcgcacatactggggcaatgtccggcaatgcaaaaagccagaattgcccggcacatgaaattgtgccgtctcctcgcggctgaggcggagaagctcggatggacaacacaccgggaatgggcgttcaggactcctgaaggggccctgcgacggttagacctggtgctcgtccgggacggactcgccttggccgtggacgtggcagtccgctatgagtttgcgcctgactccctacaggtcgcggccaagcacaaagtggactactacgggcccttcaagaaaacgatagcccgggagctgggagttcgggaggtgcaggtcttcgggttccctctgggagctcgagggctgtggcacaccaacaataacaggttgctgctggtgatgggccttagtaaggcgaggatgaaatcctttgcagaattgatgagtcggaggtgtctcctctactcgttggatatcctgcgggggttctccgcgtccctgagacctcggatccagcagacataaacggagctcggtgacccaaatgttggaccaaattaaaaaccaaccaacatgtcaaagttaagtccattgggatccctctgcaagagatctcgggtggtggggtccggccggaggaactgccccgggggggccctggcttggaggcggcctgggtaacttcggggtggggagagccggtcgggcttctgctgcccgccttggcctctccgtcggggggtactcctgctcacgctactatggtcctccctacttggcaggtcgccggcgtgggtggggggccccttggtgggggggttgaggagaagatcaacctcggccgggaagaaccggtctataaacggccggggatgccccgtctggggccttgtgtcaggttagctgccccccgggtcgcgcttcggcgcggcctttcgggtgggtggcggagcttggcaatgatgctcgacagacatcggggagggagtaagtccagtcggtatcctcggttgaccagtggacgggagcctaagggcaagagattggttccccgggaccagtctctaagggcgagtgatcggtgataggtttaagggcgtaccggaacataatggtctgtcttctcgttacaggacaaggacggtggctgtggatagcaacgggaggtcggcagatcagggacagctgggacctcgtgatgattataattctgcgcgaccgcccacttgaacaatgcctcggcactaaagaaaccaactcgcggtctacatccattcatgtctatacggtgacggtaagtatactaccttgggaattagcgtttacgtttgcgtcaagcatgctgttgctccaagagtaataagcgtgagagtaacagcgtgctggtagtctgggagacgggctcccttatcaacccggaaagctgtaccccctggtaccgttccaggaacggtatcagctcagactcggtggtatggcctcaccag

SEQ ID NO: 371 - DNA, 2016 bp, Eptatretus burgeri
gccctggcgtttgcggatgacctcgtcttgtgtgcgcgcacgtcgtccgggctccggagatctatggatgcggtgcaaacccgtctgtctgcggccggtctggtgttgaacgtggagaaatccgcgactctagcgattaccatcgacgcaaaggcgaagcgatacgtagtggacacttctgaagtgttctacctcggacagcaaaacctaggcgtgctggatgctgcgagtcagttaaagtatctgggtatccagttccttccccgcggagcggcgccatctgatggctccgccctcgagaaggggctgaggaacctaaggcgagcccccataaagcctcaacagagaatgtttatgctgcgagaccacctcataccccagctccagcacggcctagtcctgggagcagccagaagagggactctccgcaagttggatgtgcaaatgcgccatcatactagactgtggctgaggttgccaaaggatactcctgtggcgtactttcatgcccggtcggcggatggcggactgggcttgccccagttctcagtgacgattcccatcttgcgagagagaaggatgcgagggcttgaacaatcggacagcccatacgtaagggctgtcatcagaacgaaactgggtgatgtggtgaggagccggaacacgtacaacctgcattacggtggagagcgtcccaggtctatcaagcaggcggacgttatcacggctaaacttttgcaccaagctgtggacgggcgaggtctactggaagcgagcagagtaccggagccaaatgactgggttcttggtcgatctaggctccaatccggtagagccttcatcgactcggtgaaagtgaggggcaatctgctccccaccggatccaggtcgagccgtggtagacggggacagggaagtgaaggatggtgtgatgcgggttgtcgtgcaaaggaatctctaaatcacatctcccaagcatgtattcgaacccatggtggaacggtccagcgacatgacgcagtctcgcgcttcgcatgtggtcggctgcgacagcgtgggttcgtggttattgaggagccgaggattccaacaccggcgggtatccgaaaaccggatattattgcagaaaagaacggcaaaccggtgatactggatacccaaataaaaagtgatactctcaagttgtcggacgagcatgtcagaaaaaggaattactacgacactccggaagtcctcgactgggtaaggaacaagtttgaaagtgaaaatgtgccacttgtctctaccatcaccctgagttggcgcggagtttgggcgccggaatcggctaccttgctccgcgaacttggtctcacaaaaaccgacctaagactcatctctgtgatggtcgtagaaaagaccgccttgatgttccgatggttcaagcggtccgcgcttacgcgcaacgcgccgcgccagtagaaggtccatctcaatccaaaattgtgccgcgtgattaaaaggacgtacggattgacacctgagaagtgatatgtcccatgttcgattctggtcaaatcgatcgagggacagttgaaaggcagagcgatcgctgggaggatacacggtgcgcctgcgtcaagcggggcacgcaccgggccacccagcgaaccctgcgagcggagattggcaggacacacgatgcgcccgatggaggagccgtctttccccgcccagaccgggatggcgaatggaagactgcccattgggtacgcatcggacttccaggcaattctccgctaggtattgtgtgtcaagacggtagggagatgggtgctggcgattccttgcctctataccgaggggtttaatggcgagtcagcacgaacaggtgcaaagtggcggtacgaagatggattgatagaatgtatatggcgccttgaatgttcagcgggggtaatgagttattctcttaccccgaggagaaaaagtagtatgtgctcatgaccaagaccaggtctgcgggcacaactatca

SEQ ID NO: 372 - DNA, 2055 bp, Aedes aegypti
atgattacagaagaggacaaatttccgttgatgtcatggaatgcgcgtggatgctgcgaggcccgaaagagagaattgatggaccaacatttctttcagaatggttaccgtattgtagcactccaagaaacaagaatggcggagtgtacggtagaaaccgataattatttttggttcaacgtcaacagtggtacgataagagatcgaataggtggtggaatagctattctggtggcaaaggcagtgtataaagaaaaccgatttaaaagaataagtccgaattcctgctcctacttggctgacgtgttcggggaaaaagttctgatcatatcgacttatattagatcagaaaaacaaatggaaaatccggagtttcaaatacttttcagatacattgttaatcttcctcgtgctattaaagaccaattaatcatcgttggggacttcaacgctcatatcggcaaaaaggatttcacaacggaggacgccgaagtaataggaaagagtttactacatgaatactgtaatgaaaatggaattggtctgaaaaacttcttgcatggactgcgactcaaaaactactcgacattcagcacatcatcctcagtaataacaacatggacaaacggaaaatcaagctcccagctggatcatgtaattatgtccaaaatgaagttcatgaaactcccgaacataagagcctattacacttcccatctgaagagtgatcacaaaatgatggaatgcgtcttgaaaaaagagaatagcacgacagatcaacgagagcgcataaatagcaaaggagcgaagcgcataagatttgatgtagaatctctaaagaacaatgaagacgaacggaccagattccaagcaagaatcaatcatcatctacaaagacaacagtcgattgttgtgggaaataatgtagaagacaagtggactagcatcaaagacgcaatgtacaaggctgccaaagttgttcttcaaaaaccaggatcgccaccaacaccgcgtcgggtaaacgcatcgaagaactactttattgcacatcagagacagctgggcgatagaacaaaccaggtactcaaagcagaagcaaaacaggctagaaaacttagaaggcaagcgtacctcgatcatttcaacgacaaaatcgcaattgcaatgcaatccactatcgcaatgacgaaaactttccgtttcataaagaaacacaaacggaatcacacatcccgaaagagccgatatattcaaattcaacactggacgcaaaaattaaaagagtctgcaactctcctgccagatcatgttagtcgagtgtatttggaggatgacgacaaggacgctgaggaagagcctacaaaagaggagattagatcgattatttggaacagtagaaataacttcgccccgggtctagataaactgcacagcgactttttgaattatggaaccgaggaattgctagatgaattgacacaacttctcaaacaagtgttcagaacaaacgtcgtcccaaaagagtggaaggaaactgtccaaattcctataccaaaaacgtctaatcctcaatccattgatgacttcaggtgtataaccctatgctcaactgtttataaaatatacgcgaaaattcttctggatcgtctaaagcagcaaattgagccaattctggcttaccagatggcattccaagcaaaacgaagtgccgctgaccaaatttttgtgcttagaaggattttggatgaacggtggagaaaaggttgcgaaacaatcctggtgtccctagatattgaacaagcgttcgacaagttggatatatccaaagccggtgagattttgatagacatggacgtatccaaagcattagtgaacagaataattgaagcatgcttacacgaaataacatctgttcagtggtatggacaaaggacgaggtctttcaagaaaatgaaaggcgtaaaacaaggttgtccattgagccctcaactattcatattgatgttacaccatgttctggcatcagtgcaacaattcattccagagcttaaacta

SEQ ID NO: 373 - DNA, 1074 bp, Aedes aegypti
atgggaaaccctctctccccgtttttgtgcgaactattcatggcgaattttgaggaaaatttaaagaaacaaggagtattaccggttaaatggtggagatatgtcgacgacattttcagcgttatcaagcggaatgatctggctaaaattttggatacaatcaacagcgtacacaaggatatcaagttcacccacgaggaggagaaggatggaaaactaccatttttggatctacttgtcaccagggaagaaagttcaacttacaacttcgaaatctacaggaagcctacaaacacccagcgagttatcccttacacatcgaatcattcgttccagcataagatggcagcgtttcaccacatgatccacaggatgcagactctacccctcagcgaagacggaaagaccaaggaactggaatatatctatgagacggcaaggatcaacggatacaaggaaaggacgataaaagctatcatcgacaaaaaggaaagacagcgaattcggaatgctttgacgacactaacccccatcaccgaacccacgaagagagtctccatcccatacgacgtacacatcagcaaacagctccgcccaaagctaaggaatttcggaatcgatttggtattttccagcagagacaaccaacttagaacttcgttaggctctaccaaggatccggtaaacacactaaacaaggctggtgtttacaaaatcagctgttcccactgcagcaaggtctacgttggtcaaacaaagcggtctctcgaggttagattcaaggaacacttagcggaaataggaaaagctcagaagacgatagacaaggggatgacatacgatttcaaatctaaggtggcagaacatatcttttcagaaggacatacaattacgacggccgatatcaaaattttgagaaatgtttcttctccttggaaactggatgtggcggagagtctggaaatttgcaaacaggtacctacgacgctactcaacagagacaacggcaacggcaatacatggctattcaacttgatacctactaatcgttcccgtgatgtacctttcagcatt

SEQ ID NO: 374 - DNA, 4474 bp, Kalotermes flavicollis
gagaggtcactgttgctgatcagctggacacctagctgactgcgtgcatgcgtgcaagccgcgcgccgcctcctcgtagtaccgctggtaaagcagggtcactgagacaacctgcggctaaaagcgcgcgcgagggattgtaagtccaccacctccacgtggttccccgcgggcaacggcatagttcatctgccggccaagcgtggcgtttcctcgatccccctctgattacggataggaggggggcggtggctaccgccgacgacctggcaaacaccttggacacggtaaggtaataggccgtcctccgggccggccgaatcataagcacataatggaagaccctctaacatcaagcctcggatctggggcaacccaagctcccggaaccccagaattattaggggagcacaccgttgaacgacctggccatgatcaaggacattcctatggtttgttaatggatgacgtagagctgccggtgaggttaccatttttggggtctctcatatgcccaggatgcacgacgctgctcacatctgaggaaacgcttgtcagccatcataggagggtccactctgatgcccggacgaggagggtctgctatggttgtgatgccccatttatgacataccgggccattaaatgtcacttacctaaatgctctggcaggaaggtagtgacaggggatcacatctgtaatggctgcacaaagcggtttgagtctcagagaggtctctcactgcataaaaggagagcccatccggatcttcggaacgaggaaatgcttgagcctcctgtgagagctgagcgacgccctaacgcacataaatcctcaatatggagcattgatgagattcgtatcctggagcaatatgaggctgcctacgtcggcgatctccacatcaacatgaagatagctgctcacctgccgttcaaaaccaataaacaagtgagcaactatcggaacgatcgccgtaaaaagtccagaacggcgactgacgcgagccaacagggacctagtcccaatgacggcattagaggaattgtccccagcgggcagtcatccccgttatttttagagggctctgacgccgagggggacgaggatgtttttaatgtcctagtgccgcccaccctagggggtcttgaacctgctggacaggttcattcactctctgagggggaaacttcgccgctggtcggcgaagcggatccctgttttatgggtggcacgccgtctgccggagaggcctcgggctcaaccttgttgggtccggatcccaccccggcagatggatgttctctggtcaggaaagacttacagctcagtgtgcagacatccccgttattagcagtgggctctgtcggcactgagtctgtgcaatttgaacgtggggtgttatcgtgcggtacgcccccagactttttacacccggaacagtttgcacattgtgcaaacaatgacccggttttgaacgcgtcagaggagcaggtggacgccccactaggggaagaagccgatgacctccctgacaacaaccatccgtcggagcagggggttgaccccgaagacccgacgtgtagtcccgcaacgaaacaggtccaacccgcttctgaggaagaagccgatgacccgttagcgcaactcaaggcgtggcgaagaagggtggcttcctatgccttgaagatcgagaccggggtttttccagcccaagtagatgacctcattcggagactgagggatggggacacaaattctaaggtaacgtgcgaggaggtggaggaagtggtcttatccctcactagaacgatcctaggtggcacggcacccaaaaagcgcgttgagggtcgaacgaagaggacgtacaaaagtcgaaacaaccatgaggctcgcaagcgtataatgtacgctatatgccaggactcatatcgcaggcctcagcgactggtgcagtggcccgtcggataccaggcggagaaatctcttcttgacaaccaagatgagagaccgtccaacgcagcctttgaaactttctatactgggctctggggtaagtccggtcaatgcaatatcacaatgcctcctggtgtgcctcggcacaccgggcaagtactgggggaagttacgccaaaggacatctactcgaggctgaggaaactaaagaaagactatgcacccggcccggatggcgtaactaaattgaaggtgcagagcatgggagcatatccctcagttcttgcaaaggtatataatctggtgatgctaaccggttacttccccagttgttggaaggaacataagacctctcttattcccaaggatagaggaagcccaatggatgtcagtaattggagaccgattacgattggctccttactcagtcggatttatacgggtctcatagaacggaggctgaggacagtttctgacatccaccaaaggcaggtagggtttatgcccgtcaatggttgtgccgccaacttgtttatatttgatgaatgcatccgacaagccaaaaaagaggggacaattgtcggcagtcttatagacgtcgccaaagcatttgataccgtaccccatgaagccatcctacgggcgttgagctcgcaaggtgtagatgagcacacgatggctcacataagagacatgtattccggtatccgtacgcggatcaacggcaaagggagcgatatccctctggtgagaggagtgaagcaaggtgatcctctatccccaatgctctttaatatggcgatggaccctctcatacgagacctacagaggaagggcttcagaattggcggccacgagaccggggcgttggcctttgcggatgatatcgtcttgttggcggactccattgatggggcccatgaccatgaagatcaggttcggtgctacatgaataaactgggcatgaccctcaatccacgaaaatcgtcctccttcctcatcactgcgatgaggaagacctggataagtagggacccgggcttgtcaagaggggagactaaggttcctggcgccagacccacctctgcatttaaatatcttggagttaactacacactctcggaaggcctggagagtggtgctttgatagacaagctcatgcaggccgttaacagagcacgaggtttggcccttaaaccgctgctaagggtcaacctcatacttgaacgaataatccccaaatttttgtatggaattatccttggcggacctagcttgactaggctgaatccagccgacaagtgtgtcagaatggctgtaaaggagatcgtgcacctccatcctagtacaacagatcatgtactttatgccagaaaaaacgttgggggaatggggattccccggttggctcaccttgactgcctagtcagtatcaggttggggttagctctgttagcgagtgaggacgttgctgttcaagcagcggggatggcgggcgacctggaaggccggtgcaagaaggtcgcaaattccttgcggctgatttggccggtgacgctgaaagatgtggtgagagccaggaataatttcaaatctcaagggtcgaaagaatgggagaaggtggtttcccaggctcatggagtcaaggacttccgagatgactcacttgggaattgttggctctatgatccgacggtgttgtccagcagcagatacactgatgctctcaggctgaggactaacacgttcggcgccaacgttgccctaaggggagccgacaaggacctcgaggtcaattgtcggcgatgccatgggaaaccggaaaccttagggcacgtgctcggagagtgtgtggccactaaaggtatgaggatacgacacgaaaagatggcggcctttgtggctataaattgtgaagaaaaggggtaccagacgacccgcgaacagctattgtccatcgagcagcgaagactcaaacctgacctcgtcgtaatggacagggaaagggctctcattgtcgacgtaacagtccgctttgagagtggggacgccctctcacggggagcctctgagaagatcgagaagtatcagcctttggctgactactttgtctctcagggggctgaccgagaagccagcgtgttaccgattgtcgtcggttcccggggagcaatcactcaggccaccatgaagaccctatttatgagagtgttagatgtagaacgtgttagcaattacctcgccatatctgccgttgcttcaagcgttcagatctcatgtatgaacctggattacacataatcccttctgacttgcccccacctgcctaaagtaactggcaggtaagagcgtgaaatgtgccatagaaatatggttatccgggtcaagtcactagcaatatgggacttctccgggtccgtgcgttccttccaacctgagctggacgtagtccactctctgtgttgaacgttacgggggcgaatctcccccggaagaggtcgcctaggcgacttagaa

SEQ ID NO: 375 - DNA, 2291 bp, Reticulitermes balkanensis
atttttgactgggggatatcctgagtgttggaagcggaacaggaccgtcttcataccgaagatcgggaaagatctgagtgaggtgggaggatggagaccgctgacaattggctccctattagctcggatgtattcagccttcctagagaggaggattagaagcgtgacctccttgtcctcgtcacaaaggggctttacgagtattcaaggttgtcacgttaatttgactatcctcaaagaaggcattcgacaggccaaagttaagaacgggggagttatagtctcagtagacatagagaaggcttttgacacaatccctcattctgtaattttttcccgtttggcgtctcaaggtgttcctccccatcttaggaaaattatatccaatatgtataaggatgtctacactgtgattgagggacagtgtattccaataaagagaatagttaaacaaggggatcctctttctccactacttttcaatattgccatcgatcctgtgttgcgcagtttggaggagtttcaggggggtctcccacttggtaactcggctattaagatcttggcctttgctgatgatattatattaggagctagttcggcgggtcaggcgcagcagatggtggatatgttgggaataggacttacttcgtgtgggttgggagtatcccatagaaaatgttttggatttcaaatcgtgaataaaaacaagacctgggcaattgttgacccaatgatcacactcaatggttcttcattacccttctcagggccagaagacaggctgccttatctcggggtggatataaacccatgggataggaaatcacggtatgacactggacagagacttatttcggctgccaaacgaggctctcaactatcccttaagcctcagcaaaagataaatttaataacaacttttctcttgccgaagtttttgtacattctgattgaagatccgccttcgcctgcctatctgaaatccatcgatcatgacctgaggcagatatataagaatattttgcacctccctaactgtgtgtcaaccgcctttatgtactctcccaagagggatggtggcttggggctaccgcgtctgtcctgtcttgttcctcttgcccatacaaaagccgggatcaagcttggttccctccaagattctttggttagggaaattaccacctcagacaggtttgtacgtacgatgggttcggtagctcactccattggggcatcatggcctctaacgttgcaggatatctataaacttaagtccgcactgaaacgtagggaagctaaggcatgggagagttgtgtgtctcagggacaaggagcagcgcaatttcgcggggactcaattggaaacaactggctccataatccgggaacctttcgacctggacagtatatcgaagcacttaagcttcgtgctaattcaacaggggttagagtcaacttgaagcgttcaggctataatgttccaataacttgtaggttctgtaaggatatacctgaaacgcaggctcatgttcttggactttgtccaaagaccaagggaatgagaatacaaaggcacgactcaattgtgaatagggtgcgagataaacttaagactaagtcgcccgttgctctcatgcatgagcaaaacttcaccgttgaggaaggccaggtgttcaaaccagatatagtgacgattttgggagaggtgggttacgtaattgatgtgacggtacggtatgaggatagagattacatcaaggatgcctctgtggaaaaaatcaggaaatacgaggcccttaaagggtacctgaaggatttatatccacagctgaataaggtagaggtattgcctcttgtctttggtagcagaggggccgtgccaggtagtactgttcacaacatgggattgttaggttttacgaaacgtgaaatggtccacatctctcgcaaagttatagccgactcactgataataatctctaattttttagaggtttattgagttagatatatatgacgactgattcttccctaactaaaatataatttggaatgtgcattacttatactttattgtatttattgacatccgtagtagtctgtttagtggatttagatagttaaccattctgtgacgtcgctgatgtctacatgtaccagtggcagaatgctgactaagaacaaaataattttaaacaatagacagcactaagaaattctgcaaactggaacgtggcccacggtaggccaatataccggaaagggaaaatgacaaatccccccttaaa

SEQ ID NO: 376 - DNA, 2291 bp, Reticulitermes grassei
attttcgactgggggatatcctgagtgttggaagcagaacaggaccgtctttatacccaagattgggaaagatctgagtgaggtgggaggatggagaccacttacaattggttccctattagctcgtatgtattctgcctttctagagaggaggattaggagggtgacctccttgtcctcgtcacagaggggatttacgaatatccaaggttgtcatgtcaatctgacaatccttaaagaaggcattcgacaggctaaagtcaagaacgggggagttatagtctcagtagacatagagaaagcttttgacacaatccctcattctgtaattttctcgcgtttagcgtctcaaggtgttcatcccgttcttagaagaataatctctaatatgtatgagggtgtttacaccgtgatcgagggacagtgtattccaataaagagaggagttaagcaagaagatcctctctctcccttacttttcaatattgccatcgatcctgtgttgcgcagtttggatgagtttcaggggggactcccacttggtaactcggctattaagatcttggcctttgctgttgatattatattacgagctagttcggcgggtcaggcgcagcagatggtggatattttgggaatcggacttacgacgtgtgggttgggagtatcccataaaaaatgttttggctttcaaattgtgaataagaacaagacctgggcaattgttgatccgatgatcacactcaatggttcttcattacccttctcagggccagaagataggttgccttatctcggggtgaatataaacccatgggataggaaatcgcagtatgacgctggacggagacttatttcggcggccaaacgaggctgtcaactatcacttaagcctcaacaaaagatcaatttaataacaacttttcttttaccaaagtttctgtatattctgattgaagatccgccttcgcttgcctatttgaaatccatcgatcatgacttgagacagatatttaagaatattttgcacctccctagctgtgtgtcaaccgcctttttgtactctcccaagagggatggtggtttggggctgccgcggctatcctgtctggtcccacttgcccatttaaaagccgggatcaagcttagttccctccaagactctttggttagggaaattaccaactcagacaggtttgtacgtacgatgggttcggtagctcactcccttggggcatcatggcctctaacgttgcaggatatctataaacttaagtccgcactgaaacgtagggaagctaaggcatgggagagttgtgtgtctcagggacaaggagcagcgcaatttcgcgggaactcaattggaaacaactggctccataatccgggaacttatcgacctggagagtatatcgaagcacttaagcttcgtgctaattcaacaggggttagagtcaacttgaagcgttcaggctataatgtcccaataacttgtaggttttgtaaggacataccggaaacgcaggctcatgttcttggactttgtccaaagaccaagggattgagaatacaaaggcacgactcaattgtgaatagggtgcgagataaacttaagactaagtcgcccgttgctctcatgcatgagcaaaacttcaccgttgaggaaggccaggtgttcaaaccagatattgtcgcgattttaggagaggtgggttatgttattgatgtgacagtacggtatgagtatagagattacatcaagaatgcctctgtggaaaaaattaggaaatacgaggcccttaaagggtacttgaaggatctgtatccacagctgaataaggtagaggttttgcctcttgtctttggtagcagaggggccgtgccaggtagtactgttcacaacatgggattgttaggttttacgaaacgtgaaatggtccacatctctcgcaaagttattaccgactcactgataataatctctaattttttagaggtttattgagttagatatatataacgactgattcttccctaactaaaatataatttggaatgtgcattactgatactttattgtatttattgacatccgtagtagtcagtttagtggatttagatcgttaaccattctgtgacgtcgctgatgtctatatgtaccagtggcagaatgctgactaagaacaaaataattttaaacaatagacagcactaagaaattctgcaaactggaacgtggcccacggtaggccaatataccggaaagggaaaatgacacattcccccttaaa

SEQ ID NO: 377 - DNA, 5020 bp, Reticulitermes urbis
cacactgctgtcatgccattgttaattcgttgggtgatggcgggtgatgggagacgagttacagcagagctggcttcacgggggggctgtagtggcccgaaccagtctgcttctgagtgcccccaagtggcctcgctggaaacgtcggagctgcttacggttaacccgtagacaactccggcggccaaactcagaaaacggccttactaccagggccatcccttgcggttgcgctaagaccttactgtatgtactacggactacagttgagtagcgcgggagagcactcgatgtgagggtagcaacttgttgcttcttcgactgtctccctgaagagttccgaagaggtgccgcaagtccatgggggcgacccggctgtgggagttatcctgcacccgggaagccctcagtggataaatactccaaaatggcttagccacctcacgtggagagaggggaattaggggtttactcctaagggccgatgcctccaatcggatttcccagggcaacggctattatcagccggctaagttcggaccctcatctaccgatgggatactctctctccccccgcctgcgtgattaattgggaatgcacgagggcgggtgattctgacaagcccagcccaaaagttcttaccacgacgtacccgggggtgtcacccgaactaatatattttccaccgatcggttcgctgtggggggatgtcggggcctggtggccaggaaccgtcagccgctctttgagtgtcctgcgtaacccggaggcggtgacgtcgaagggctaggctagcacggtccagacccctgaacgcctggggagacgggcccaccacctgtgtaggagtgggtcctttacctcatttgaggtgtctcctcggtctagtagggggcgaaggacgagggatgcatccgtccctccaggatgctggtggtttccgtctggtgggctcatgctgaaacccgcaggtgccgatttgtcgaagaggacatatggggtaacccatagaacctaggcaggagtaatcccttagctgggggggtcagctggtgggtcctgtcaatttatcctcccctccatgccagagccggtccgaggttagagacggactcattttctcctttttatatgtcatgatggccgattataataattctgttgatcatgcacttgaggatgatactagatttatatttgcgcgtgattcagtacttgcgagagtatgtggacatttcgataacttgaagtgtgagttatgtggagtgctccttacgtcccttcagggcgttcgggagcattgccaccggtcgcaccataacttggatttgacttttcaatgtactaaatgcgataaagggttttcctcgtataggggaatttgttgtcatttttcgaagtgtagaggagctcgtatatctgtttcagagggcccccttagttgttcagaatgtgagaggaaatttgactctaaaagagctctttcaacccacgagaggcatatgcacccagggattaggaatgctaagaggctcaaagattttaatccgcgggggggtggtaaaactattcacggcaatactaagtggaccgaagaggaggtccaattgcttgtatcacttagcaagagatttgaagggtataagtctatcaataaagaaattagccttattttaacatcaaaaacttgtaaacaaatttctgataaacgtcgctatttaaatttgcataatggaaatggggggctagcggcagcggaagctgtattagtattttgtgatgatagtcaccttgaagttactgacagcgatggggcggtgctttctgaaatcatggatgaggaatattatcagtcatcgctaactatgaggtcaagcatcgtacatggcgacattggtcgtgaggttcaagggaaggatttggtccggatcccgcctgataatagtgtaatggggaattgtgttgttctacttagaaaacttgctactgaaaaaagaagtgatttggacttgagtaaggataaagagttgcgcattgacattgagaaggcgacgaaagctaacagagaaagcgcagatggtagggtaattcaatctgtggctgataatgagatcgatcccgatacttttcaatggaaagaattgcttcttgggcaggtacgggggtttccacgagttgatgagaactctgaattatttgatttggatgacaaattgactagtgaattatcttccgacagccccgtgtggaatgacaactgcgaacttattgtgtcggacttatgtcacgtcttatgcaaaaataaatatgagttaggtaggcagcatcacgttaggaaaggaaagaggcatcggggtatacatcataagagggagaaatttagggaatgccagaagatatttagaaagtcccccagaaagcttgccgaatatctctaccgcgataaggacctgtctcatatcagtaaagacgttagcactccgcagggtatagagcaatactattctcagttatgggggaaacctgaattactagaatccaacacaactgaagaaatgttaccttccagttccttatttgactgtcttcctcccatcacgccggaggaggttgaggggagaatccataagattcgaccgtcttccgccccagggttggatggggtaggcaagatccatcttgtcggtaaagggataaccctggtccttgctaaactctacaacttgctatttttgactgggggatatcctgagtgttggaagcggaacaggaccgtcttcataccgaagatcgggaaagatctgagtgaggtgggaggatggagaccgctgacaattggctccctattagctcggatgtattcagccttcctagagaggaggattagaagggtgacttccttgtcctcgtcacagaggggctttacgaatattcaaggttgtcacgttaatttgactatcctcaaagaaggcattcgacaggccaaagttaagaacgggggagttatagtttcagtagacatagagaaggcttttgacacaatcccccattctgtaattttttcccgcttggcgtctcaaggtgttcctccccttcttaggaaaattatttccaatatgtataaggatgtttacaccgtgattgagggacagtgtattccaataaagagaggagttaaacaaggggatcctctttttccactacttttcaatattgccatcgatcctgtgttgcgcagtttggaggagtttcaggggggtctcccacttggtaactcggctattaagatcttggcctttgatgatgatattatattaggagctagttcggcgggtcaggcgcagcagatggtggatatgttgggaataggacttacttcgtgtgggttgggagtatcccatagaaaatgttttggatttcaaatcgtgaataaaaacaagacctgggcaattgttgacccaatgatcacactcaatggttcttcattacccttctcagggccagaagacaggctgccttatctcggggtggatacaaacccatgggataggaaatcacggtatgacgctggacagagacttatttcggctgccaaacgaggctctcaactatcccttaagcctcagcaaaagataaatttaataacaacttttcttttgccgaagtttttgtacattctgattgaagatccgccttcgcctgcctatctgaaatccatcgatcatgacctgaggcagatatataagaatattttgcacctccctaactgcgtgtcaaccgcctttatgtactctcccaagagggatggtggcttggggctaccgcgtctgtcctgtcttgttcctcttgcccatataaaagccgggatcaagcttggttccctccaagattctttggttagggaaattaccacctcagacaggtttgtacgtacgatgggttcggtatctcactccattggggcatcatggcctctaacgttgcaggatatctataaacttaagtccgcactgaaacgtagggaagctaaggcatgggagagttgtgtgtctcagggacaaggagcagcgcaatttcgaggggactcaattggaaacaactggctccataatccgggaacctttcgacctggacagtatatcgaagcacttaagcttcgtgctaattcaacaggggttagagtcaacttgaagcgttcaggctataatgttccaataacttgtaggttctgtaaggatatacctgaaacgcaggctcatgttcttggactttgtccaaagaccaagggaatgagaatactaaggcacgactcaattgtgaatagggtgcgagataaacttaagactaagtcgcccgttgctctcatgcatgagcaaaatttcactgttgaggaaggccaggtgttcaaaccagatatagtgacgattttgggagaggtgggttacgtaattgatgtgacggtacggtatgaagatagagattacatcaaggatgcctctgtggaaaaaatcaggaaatacgaggcccttaaagggtacttgaaggatctgtatccacagctgaataaggtagaggtattgcctcttgtctttggtagcagaggggccgtgccaggtagtactgttcacaacatgggattgttaggttttacgaaacgtgaaatggtccacatctctcgcaaagttattaccgactcactgataataatctctaattttttagaggtttattgagttagatatatataacgactgattcttccctaactaaaatataatttggaatgtgcattacttatactttattgtatttattgacatccgtagtagtctgtttagtggatttagatcgttaaccattctgtgacgtcgctgatgtctacatgtaccagtggcagaatgctgactaagaacaaaataattttaaacaatagacagcactaagaaattctgcaaactggaacgtggcccacggtaggccaatataccggaaagggaaaatgacaaatccccccttaaa

SEQ ID NO: 378 - DNA, 4120 bp, Schistosoma japonicum
atcccgctccatcgatatctgctgcatctctgaaacgcgtatacaggatccaagcacagtcattcgcttgacttcaccttgtgaaaataaggaaccggctcagttcactcttcgtgtttccggggaccccaccgctaccactcgaggccttgctggtgtaggtatagcactaagtttaaaagctgaacaggctctcctcgactggattccaatagacagtcgattgtgcgctgtccgtctaaatggaacggtaaggactcgtaaagatagggacacacgccgttgtctctttgttgtctctgcctatgctcccactgattgcagctcagatgaaatgaaagatgaattttacaggaagctttatgaccttctatgtaaagctaagcgcactgatgtagtaatagtggcaggtgattttaatgcccaagtaggtagactagaggaaaccgaaaggcacctaggtggatcatatggtgttgaggctcaacgaacagacaatggcgaccggttactacaactttgttcagacaagcgtttatttctcgcaagcaccaactttaagcataaggaaagacatcggttgacatggcggcctccgaaatcaacccaacgctggactcaaatagaccacattgctattagccatcgttggagaggctcgatagaagactgccgctcgttttggagcacatgtttagactcagatcatgccttagtgcgagcgcgtattagtctgcgactcactggacgtaaaagatccactacaaggatcccccacagagttcaatttaatgatgaaaaagtcaagaatacattccaggaacaactaaaaaaccaattagtaaacggcgtaaactgttctcaacctgagctagcctggaatgatatccaaaaagccgtcgaaagagcagtaatatctactaataaactagacctaaaggttaggaaaactcagtggatttcagctgcatctactgaactgatagatcctcggcaacacatcccgtctggttctgaacatgatgagcaacgtaggcaacttagacacaaactaatcaaaagcttacgcaatgatcgtgagcagtggtgggtggcgaaagctaaagagatggaaaaggcagcggcaataggtaacagtaggcaactgttcagacttatcaaggaaacgggtatcaggaacccaactgtaagtgaaactatctccgaaaaagatggctccattattcactgtcaatccagaagattagaccgatgggcagaacactttagggaacagttcaactggcccacggcgtcatccctgctgcccaccatccccaaacaatctgaatggcaaattaacattggtcccccaagtctcagtgaagttgtgaaggctattggaaacttaaagcgagggagagcggcaggaccagatggattgacccctgagatatttaaggaaggtggtccagtcttagcggcgagattaactgagatcttggctagaatttgggaactagacgtaatcccatctgactggtctcgaacactaaccattccggtctttaagaaaggacagaagtcctcgtgtgacaattaccgaggaatcagtttaacgaatatagtgtctaaaatactagcttcaataatacttcgacgtttaactaaagctcatgaagagcaaactcgagaaaaccaaggtggcttcagacccggacgtggttgtatagaccaaatattcacacttagacaggttctggaacataggcacactttcagacgcccaacaatagctgtattccttgaccttaaggcggcgtttgactctattgatcgtaaggttatgtggcaatgtctgtcattgaaaggtgtaccggagaagtacattaaccttatacaagctctctactcgaacaccacatgtcgtgttagagcttatggcagattgtcttcggaattgaccacttctagtggtgttcgtcaggcttgtccgctatctccatttttatttaattttatcattgacatacttttagagttaacattgtcatcgtctgatttccctggggttgacctctttccaggagataaacttactgacttagaatatgccgatgatatagttctactgagtgaagatgctgataaaatgcaggattttttgaccaccttaaacatgaatgtaagcatgcttgggatgcgattctccccatccaaatgtaaaatgttacttcaggactggcttaattcggcaccaaagttagtgatagggcgtgaaactattgaatgcgttaaccgctttacttatctagggagcctcatcagtcctaacggtctggtgtccgatgaaatctcggcccgtatacataaggcccgatcggcttttgccaacctgcgtcacttgtggcgtaggcgagacattcgtttaatgacaaaaggacgcgtttattgtgcagcagtcagatccgttttaccttatggatgtgaaacatggcctttaagagtagaggatattcgtaggatcctagtattcgatcatagatgtctccgaaacattgctcgtgtttgctgggacaaccgagtaagcaatgcatgggttaggaatagagtactagggaaatacggtaagtctattgatgaagtagtgaatcttcaccggctgaggtggttaggacatgtgttgcgtatgcctgaccaccgtctacctcgacgagcaatgttgtctgttgtgggagtaggctggaagaaagctaggggtggccaaacgaaaacatggcaccaatccatgaagtcattgacgattggactgagccatgttaatagatgtagactacctggttggggcccacacgatgatcgtaacaaatggttagagactttaggtgatatggctcaaaatcgattgcaatggcgcaggtgcatccactccttgtcttcctccgaattctaatttttgagcttctcataattttctctttactgaatcactttttatctcaaatcttatctatgatctctatgccttcccgttagtacttactctgttactacctcccctactttgggatttggtccgacaatttaatctttatctgctaattgaggcatggcaacttgaactgatgtacgcatgtacaaagttctatgttgtaactgactgactgactgaatttactaaatttccttcgtgctatgtgtctaaccgtagtagtgtttactcgatggtcctagcaaacgtaattaaagtttcgcagacatctgcagtcaaatactagtaacctgttaatgtcttcttacaaaggccacgtttcccaaccataaaatgtactactgaacagtatactcgttctgtgagtgactggcaggcatcgcatttaaattggaaacagttgaacagactacttgatgatgagacttccaagataaacatagtggtgaacacgcccaaaccacttcactccttatcgatcagttgcctgcggctggtagctcgatgactagaattccaccaacccacttacgatttagacagcgagtttgaattactagccatcatatatgtatagtatgatgattcaaggttgaatgcatgagtaaatcactacgattgtatatacaatgagtttcgttttgttatttatggtactattagtgaagcaccactaaaaacttgtgcaaaacgatcagttgtcttatgcagcaattcattgttaatttattggaaatagatcctatcacattttcgaaacatgactacttgaattgcctcataatttcctgaacattttgattagttagtctcctcatgactcagaatttcatattttgagcttatttttttatttttgttttaacaatgctagaaatggattctatccgttatttggatgtcactgggatgcttaccaaggcgaggaagaagataatacgttttctaattatgcgggagtttcagggtacccttctagtaatggtcttgcaagtaacctatcaaatacaagtggtactgttaagaatgattcatctacttcagtcataaatccttctacttgtacatcaactacttcaagtgcttgtgctgcatgtaaaacctctactacaacaaagcttacagatttccctattggttcacagttga

SEQ ID NO: 379 - DNA, 3528 bp, Drosophila mercatorum
gcccagtgctctgaatgtcaaagtgaagaaattcaagtaagcgcgggtcaacggcgggagtaactatgactctcttaaggtaagggagtaaatgggtttctggtttacttgtaaatcattaatcaagtcgactcgtagacacactgtgtcccacaaagttgtcatgtggcctcctcgtggtgtctcccggaagttatttggctaggcgtttcctggtcaaataaactaattcgagcggcgaactggtcccgttggttacctgccctcagggatcgaaaaactgatggtacaaatgttcaataatgagcctcggatagctgaaaataactcagttgaatatactcctacggttactcgcctaggagaccatcaggtacggaacgcagatgctaatttgcagactatgtttccgtgcagagaatgtgaacgatctttcagaacgaagatcggcttgggtgttcacatgagacatcgacacaaagacgaactggatacagcgcgtcggcgtgtcgatgtcaaagcacggtggaatgaggaagaactgtctatgatggcaaggaaggaacttgagctcacagcaaatggtgagaggttcataaataaaaaactagcggagatctttacaaaccgcagcgtcgatgctatcaaaaagtgtcgacagagagataattacaaggcgaaaatcgagcagctacaggggcaagcagctcttatctcagaagcaaatgaacctcctaccacacagcgccgccctagtttaagtgagctcgaggtaactccctcatcgtcacattcagttccaatcgctccaccaccgatacattcggatgatatcctcttgcaggagcttcagggcatgtcgcctgtcgcagtaagaagatcttggagagtcgaggtcttgcaatctatcattgatagagcgcatatctcgggcaaagaagcaactctccagtgtttgtctaactatctcttggaaatatttccgaatcgaaacgaccgccccagttccgcgacggtccccgcccggcgccctcgcaatagaagaattagtagaaggcagcagtacgccagatgcataaaatccttgcttgatggaaccgacgagtcggcattgccaaaccagagtattatggagccttattggagacaagtcatgacacagccgagccccagcctttgcagcaacaccgttccccgtaaagggaacatgcaagagggggtatggtcaccgattacgtctagggacctacaagtgcataaagtgccattgacttcgtcgccagggcccgatggaattacttcacaaactgccagaagtattcctatcggaataatgcttcgcattgttaacctaatactttggtgcggagatttgcccgtacccttccgaatggctcgaaccattttcattccgaaaacggtaagagcaaacagaccgcaagactttcgtccgatatcggttccttcgatcgtggtgagacagcttaatgccatcttggcatcccgactaacggccgccgttagttgggatccgagacagcgaggctttctacccacggacggatgcgctgataacgcgacgatagtcgacttagtcctgagggatcaccataagcgttatgcgtcatgctacattgccacgctagatgttagcaaggcatttgactctgtagctcatgacgcggtattcaacaccgtaaccgcttatggtgccccaaagagcttcgtcgactacgtacgtagatggtacagtggaggtggcacctacttcaatggtggagattggaggtcagaggaattcgtccctgctagaggtgttaagcagggtgaccctctgtcccccgtactgttcaacttgatcatcgatcggttgctcaggtctcttcccaaagacatcggtgtccatgtcggaaatgctaaagttaatgcttgtgcttttgcagatgatttgatgctgtttgcttccactccaaaggggcttcaggaactcttgaataccacagtaaagtttctatcttctgttgggctaacccttaacgctgataaatgtttcacgatcagtattaaggggcaaccaaagcaaaaggttacggtggtcgaacaacgtaccttttgtataggtcgcgcacgtgtccagctgaagcgttcggaggagtggaaatatctcggcattcatttcactgcagatgggagggctcgttacaatccttcggaggacattggtccaaagttggagagattaatgcagtccccccttaaaccacaacagaagttattcgccctcagaactgtcctggtgcctcaactctatcacaagctcacgcttgggagtgttgctctaggcgttctgagaaagtgtgacaagctggtacgatcattcgctaggaagctgctgggtcttccgttggatgtgtcagttgcgttctaccatgcccctcacagttgtgggggtctcggtataccctcggtaagatggatagctccgatgttgcgcactaaaagattggcaggaattaactggccccatctcgaacaatccgaggtggccagtgcctttcttagtgaggagctccgacgggcccgggatagagcgaaggctggagttaacgagctgctatcacaaccaaagattgatacgtactgggcggatagattgtacacgtctgttgatgggaatggtctccgtgaagcaaggcgctatgccccacagcacggatgggtaagtcagcccacgcgtctgatgagcggtaaagcttatcggacagggatccaattacgcattaacgccctccccacgaggtctcggaccacgcggggaaggcatgaaatgaatagacaatgtcgtgcaggatgtgatgctccgagtcataatcacgtcctgcaaagatgtcatagaacacatgggagtcgagtgtcacggcataatggagtggtttcctatctcaagaaggggcttgagacaaggggctacaccgtctattcagagcagagccttcacggccaaaatcgggtatataaacccgatatagtagcattccgacatgacagcacaatagtcgttgacgcgcaggtagtgacagacggactggatcttgacagagctcatcagagcaaagtcgagatctataacagacaggacttacttacgacattgcggtctgtatatcgggcacgtgagaacatcgaggttgtctccgctacgctaaactggaggggtatttggagctttcaatccataacaaggttgaggactctgggtatcctaacagctggtgacagcaatgttatcagttccagggtagtgtccggccgagtctacagctttaagaccttcatgttccatgcagggtttcatagaggaatggcttagcagctctgaaagcgtatcctacaaacgctgctaacttgcacaacatcttaaaaagttataaagaaagcacacgggtgtcttagcttatcagatatctctggtatagcgagtcatatagcgcaacaaaaaaaaaaaaaaaaaaaaaaaaatagccaaat

SEQ ID NO: 380 - DNA, 3505 bp, Bacillus rossius
ctccctccactggtctggaggttgcggagatagtagttagcaagtagcgacctctgcgtggttcccgccactagtagtcctagtagggagtaatcctgaaaaggtgaagccaacagctacctctgcgctggtacccggggctggccgccccggaagtgtacctcaatgctggctagttctttcaaaaagaagcctcggatggtgagctcgtccaaaagtggcagctcatgtaacgacgcgcccactggtgtcgtcgtgccagcatcgaaggagagtgtcgagtcacccagtcttgacaagaaagttggatatggttgtgaatttcccggctgtcctagggtattcacaaccaagacgggacgtggggtccaccatcgaaaagcccacgaggattggtatgatgcgcgacagaagcttgactacgtgaaagcgcgctggacaagagaggagtcagccctgatggcgcgtgaggaggctaaggctgggacgcaaagtgctaaaaagatgaaccaggtcctgcagttggtcttgccggacaggacactggagtcaataaagagccacaggagatcggcacagtacaaggaactggtcctgcaggcaatgggtgccttgtcggattcagggaaatgtgctggcccctcccaattagcaaatgctgagcttagtactcctctttcctcggcagtgctgggaaycggtgaaccgggtggtgggggatccggtgagcatgggtcgggtgatgtgccaggcagttcccgtggggaacatctgagtgcgctgctggacggtctgcagcccggtccggttgttgatcggcttcgcttaattgttcggtcggttgatgactggtcccgggcacgcctgcaccaggagattggttggtttctccgcgatctcttttggaagcccttgaccccaaacctggctagggtgtcactwccatctaaagacaaggtgtcacggcgcagactcaggcgggcggactatggtcgagtccagagggcgtggaagcgtaatcggaacacatgcttacgcgatctcttgagggacaagcgcacagagtcagcaccacccgaagaactaayggtgccttattgggagagtgtgctgcgttcgggatcgtcttgtactcccggtcaaagaggtcggacagccgagagaactgagttgtgggacccggtgtcctcgaaggaggttgagcaagctcttcctcctctcgggacagcaccgggaccagattcctttacaccaaaggacttcagggcggtgccgtctgctgtttgggcttgcatatttaacatctttatgctgtgtggccgactcccggattatctcctcgagtcgcgcaccacactgataccaaagagagacggtgcttgtaaccctgaagatttccggccgataaccgtttcctctgttgtggttagatgctttcataaggtgatcgccaacaggatgtccaggcacattcagttggaccctcgccagaaagcttttcgatctctggatggttgttcagagggagtcttcttgctggacttcattcttggacatgccagacgtaaccaccgaccggtgcacttggcgtctctcgacgtggccaaggcatttgactctgtgtcgcacgcagccatccttgatgtacttcgatcatttggtgtcccggatcaaatggttgagtacattgcatctgtgtatgcaggatccaggacacggctccagggtgatgggtggcaatcccatgctattcaccccacttgtggggtgaagcagggtgatccgctstcacctatgatattcaatatggttatcgaccgcttgtttactctgttccctcgggatacgggagtatcggtgggagatactgtattgaatggaatgggatacgcagacgaccttgtgttattcgccacaacacctgttggactgcagcagctgctcgatattactgccgaatatctgtcgcagtgtggcttgcgtgtaaacgctgccaaatgctttagtgtatcccttgcaattgtccctcatgagaagaaagtggtggttgcaactaaacatcgattcaaatgtctgggccaacctattccggcacttaagaggtccgatcaatggaaatatcttggagttcctttctctcctgaaggtcggctgaagattgatcccctcggtcggcttaaggatgaattggaaaagcttcgaagggctccactgaaacctcagcaaaggctctatgccttacgtactgtggttgtgcctggcctctaccacttattagtgcttggaggaacgactatcagttcgttgaataggcttgacattgcggttcggtctactgtgcgcaagtggctgagcctgccgcatgatgtgcccaacgcgtacatccacgctgacgctcgggatggggggctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccgtaaggtcagcaagtatgaaccactggtggatctagtaaaggaccggtactctgtcgataaagtgatcttctcctccctcattatcagtgcgcgtggtgtgtggggaggaagatcctttaggcatctatcaaaactgagactgcttgacatctctgatgccaaggtcctgtcaacccgagttctgcttggggggatgggggctgtacgtgtgtttaatcgccgtacagctgtaagtgggagggtcaatggctggtgattcgcaccctcctttagttatgtgctacctcctccagcttgaggtataatatagagggttttttagtgggtagtcaccttgtattgggtggagtcccacacgaaatgccactggtcacctggcatgagtgcgtaatgcatttttcccgctctaaaaaaaaaaaaaaaaaaaaaaa

SEQ ID NO: 381 - DNA, 4495 bp, Limulus polyphemus; identical to SEQ ID NO: 140

SEQ ID NO: 382 - DNA, 4400 bp, Bombyx mori; identical to SEQ ID NO: 144

SEQ ID NO: 383 - DNA, 5214 bp, Adineta vaga
tcgtaatgaaagtaaagaacattcttgcaatgtttgaagtgtgatttctgtcatctggtgcaaatcatgacaatgaacgcaacactgacaggttctattgccgctggcaaagagcttagtaagagtatatgcaatgagacccgaaagatggtgaacttaacgtgtgtagaatgaagccaggggaaaccctggtggaagttcgtagcggttctgacgtgcaaatcgatcgtcaaacatgcgttaaggggcgaaagactaatcgaaccatctagtagctggttccgtccgaagtttccctcaggatagctggcattcaattttcacagttatatccggtaaagcgaatgtttagaggcattgggcgtaaaatacgctcaacctattgacaaactttaaatgaaatagtttgcaatggtaggtgtatggcgcctctgtgtctctctttcgctggatatagtttgacgattttgtaccaggtatctgtttcttgtgagttcagcaccagtttgaacaggcttagcgatagaccttcgaacttgaaacactgttgtgaagctggctgggcccctgcagattttctcgattagaacgtgagtgttacgtccagaatgacccaccagtggttagttctacgttgccctggaaaggagaaaagttgagctaaaatcgcacggcctagttgtttatcaaataggcacggtgaggaactcttctatgtaccctgactaaagtactcacttgtgcgctgggtttgctccccctcgcattgacttatctgatcgcactacccaccaaacgaaacataaacttagctcgtggtatcagtccacagcgtgtgcagtcggattcaggggagcgtgttagtgacaagcaggataatattaacatagttaatgttaaggcgttcaacattccttatccaattggaagagttgactgtgaagtttgtcatgaagacattggacaaatgaatttgccgattcgagagcatgccgtatctgtacacaatataaacaaatttaattatttatgccagctatgttctaagtcttatgatactattaatagtgttaaagctcactatgttgcatgcagaagacagaagaatgcctcatccacaacagctgttccaaccaatgtcatcaacaacaaccaacttgctataaatactaatcaagtaatatcaagaaatccacttcagtgcgttgagtgtctaatgaaacaagttgatttctatgctaaagatacaaaggcactagtcacgcacatgcgtactaaacatgctgctgcctacgaggaatcaaagaaagtcgcaacaagaagagttgcctggagccctgatgaggatcaaattcttgctgaactagaagtcaaattgaaaaagatacaaaaaggtcaattacttagtcgtcttgtcgttgaatataataaatgtgctgataaatcgaaagctccttccaggtccaaggatgctattcgtacaagacgccaacaacatgattacaaactattgcttcgctcactccaatctcaacaaccgccagttggtagcgaagacagtgacagtgacatatcttctagtaataacaatcctttaacaacaacacataatgtcactccaacgccagattcatccaacgttgtactactaatacaaaagatccgtgaatctgtagattccattgtaaaaataacgaacctcaaattgaacacgaatatgctgaacgcagcaagtgcgttcattaatcaaaataacaacatggatccacttgaactatctatgcgtggtatcgaagaggatgtgaaggcaattcgagacaaagaacttcagaaaccaaccaggaacgttccttcttcaacaacttcgagaaagccaactcgaaatgccaaaaggcttgagaaatcaaaaaaatatggctattatcaacatctgtactataataacaagaaaaaattagtagcggaaatcctcgatggcgaaacaagtggtgctaagccacctccaatgaacctggttgaagattattatagaaatatttggtcacgttctactattgatgattcgcctgttaacaatattaaaaccgttaatagtgactctatatttgctccaatttcgcgtgatgaaatcaaattagcattatcaaatacgaaaaaggattcagcagctggacctgacgctgtaacaataaaagaagcaaaagctattattgacaatctttatgttgcatataatatatggctaggtgttcaaggaattcctgaacaactgaaattgaataaaactatcttaattccaaaaggaaattccgatcttagtctactgaaaaactggcgacctattacaatctcgtctattatcctaagagtatacaacagattattagcatacagaatgaacaagatctttaaaactaatgataaacaagttggattcaaacctgttaatggttgtggtattaatatatcttggcttcactctctcttgaagcatgcacgcttaaacaaaaattcaatatatgcttgtcttgtcgatgtgtctaaagcctttgattctgtgtcacatcaatcaatagtaagagctctcacaatgaatggtgcaccatccttgctagtgaaattaataatggatcaatatacgaatgtaaatactgtcatcacatgttctggttctatatcaaacaagataaatatctccagtggtgtcaagcaaggtgacccactatctagcttgttgttcaatctggttatagatgaactgttcgatgtaataaaggaccaatatggttatacaattgataacattggcaccaccaatgcacgatgcttcgccgatgatttaacactaatatcatcatctagaatgggtatgaataaattgcttgagctcaccacgaaattcttcaaagaacgtggactaaatgtaaacccatcaaagtgcatgtctattggcatgtccaaaggttataaaggaaagaagagtaaaatcgaatctgaaccactcttctctatcaccgatgctcagataccgatgttgggctatattgataagacaactcgatatctcggtgtaaatttcacatctattggtgccattgatgcaaaaagaatcaaaaaagaccttcaggacacactcgataagcttgaacatcttaaactcaaagctcagtgcaaaatggatctcttacgaacttatatgataccaagattcatgtttcaattaattcatactgagttatatccgaaattgcttattaaaatggacatcttaattaggaaattagctaaacgaatcctacatctgcccatatcaacgagtagtgaattcttttacttacccttcaaagaaggaggtcttcaactaacctcacttaaagaagcagttggtttagccaaaataaaattacacaagaagataatgtccagtaatgatccaatgttatgctacttgattgagagccagaggagccgtattgtcgaacattttatgaaagaccttaaacttggagattctttaacattaaacgaaatgaataacatcaaagagtgcttcatgaaagaaaaaagaatctcatttgctcaaaaaattcacggtgtcggcttcgaagtattctcatcaagtcctttgacgaaccaatggattaatggcgaaattaagacaatgacaactaaaacatacattaactcaattaaacttagaacaaatactctagaaactcgggtaacaacatctcggggactgaacatcataaaaacatgtagaagatgccacgtagctgacgaaagtctcatgcatgtgctccaatgttgctcttctaccaaaggtttacgatactctcgtcatcacaaaatatgtgccaaagtagcaaataaattggtaatgaatggttatggtgtatttcgtgagaagagttatccagatccaaacaactcaggttcataccttcgaccggatataattgcagtaaaaaatggtcatgttattgttcttgatgtaacggttgtgtacgaagtaactggtgctacgtttattaatgcctaccaaacaaaaataaataaatataatgcgattatggtacaaatcgagcaaatgttcaattgtgttaatggtgaattgcatggtctagtaattggatcacgtggttcaattcatcacagtcaactccacatctggcatcaaatgggattctcttccatagaacttaaatatgtggctataggatgcatggaggattcgctcagaatcatgtccacattctcaaaagctatcacatgaactagtctccttcttctattagtcagtctaattaatttttcttacattctacatctagttccattattaaattggtatgatcagtgctatctctgctacactcaatgcttaatcgtatgttattgacagtctgacacttgattactcttacgacatatgcactgtttgcttcagagaaaccactgttcatatagtgaagttcctcagttttctgttgatatattcttctttcattctcgcttctccttttctactgtgttctttttatcagttttttgtggaaaaattgagaataaataaagttagctggttccgtccgaagtttccctcaggatagctggcattcaattttcacagttatatccggtaaagcgaatgtttagaggcattgggcgtaaaatacgctcaacctattgacaaactttaaatgggtatgaagttcatttttctacttcattgagaatgaacagcgaatgtgagtgccaagtgggccatttttggtaagcagaactggcgctgttggatgcacaaaacgtcaagataaagagccagatggtctcgctcatcagataccataaaaggtgttggtcgatatagacagcaggacggtggccatggaagtcggaatccgttaaggagtgtgtaacaactcacctgccgaatcgactagtcctaaaaatggatggcgctcgagcgagcctcttatacttgactgttacgatacaacaagccattaacggacatcatgtcgtaacaagtaggacggttgatatggttgcgtcgaaggctaacacgtgagtgtggcttgagcagtcatatgtacagatcttagtggtagtagcaactattcaaatgagaactttgaagactgacgtggagaaaggttccatgtgaacagctattggacatgggtcagtcagtcctaagatgcgctcgaa

SEQ ID NO: 384 - DNA, 4372 bp, Bombyx mori
gtcaacgtgaagaaattcaagcaagcgcgggtaaacggcgggagtaactatgactctcttaagggcgatacgcataattttaatttcccgattgaaatccagtcgtcttaatctggtgaccagtggcgcggtcaccagtatagtgcacaggacgtgaatggctccgaggctggcggagtcactcactataagtgtgagagacgatgtcctgtgccaagtatacgtccaaccctaacgggttaagtgaaattagttgctcataacagggacggtgtacctgtttgctcgtggctggctatcgaatggacgggaccaatacacccccctgttagtaatggggtaagagagagcggtctgaaactatggccgaaatcacgacgccccactcctacccataacctgcacgtggtaccgccgcacattgaccgatacgggaggaggggcagcacttgaatcacgtagtcttggtgtagccattgcgggactacagccctcgtaagtgccgccttagaacgcaacggggcaataggtgggccggggcgctagcgggggggagtaatctcccctgttggcgtgcaccgcactgctcccactgggggcagtgtcatccggaaacaggtgggccggggcgccaccaggggggagcaatccctcctgatgatggcgagcaccgcactgtcccttatgggacggtgtaacccggatggctgtacacgtggtaaacacgtgacagcagccccgatggacggaccgcgaggaccgtcaagcctagcaggtaccttcgggtggggccttgcgatacctgcgggcgaaccctgtggtcgggtttgcagcccggccacagtgggtttttttcctgttgcaaaaaagtcaaataaagaaaatagacctgaagcctctggcctcccgctggagtcagagaggacaggcgataacccgactgtgcggggttccgccggcgcagatcctgtgggtcaggatgcgcctggttggacctgccagttctgcgaacgaaccttttcgaccaacaggggtttgggtgtccacaagcgtagagcccaccctgttgagaccaatacggatgccgctccgatgatggtgaagcggcggtggcatggcgaggaaatcgacctcctcgctcgcaccgaggccaggttgctcgctgagcggggtcagtgctcgggtggagacctctttggcgcgcttccagggtttggaagaactctggaagcgattaagggacaacggcggagggagccttatcgggcattggtgcaagcgcaccttgcccgatttggttcccagccgggtccctcgtcgggggggtgctcggccgagcctgacttccggcgggcttctggagctgaggaagcggtcgaggaacgatgcgccgaagacgccgctgcctatgatccatccgcagtcggtcagatgtcgcccgatgccgctcgggttctctccgaactccttgagggtgcggggagaagacgagcgtgcagggctatgagacccaagactgcagggcggcgaaacgatttgcacgatgatcggacagctagtgcccacaaaaccagtagacaaaagcgcagggcagagtacgcgcgtgtgcaggaactgtacaagaagtgtcgcagcagagcagcagctgaggtgatcgatggcgcgtgtgggggtgtcggacactcgctcgaggagatggagacctattggcgacctatcctcgagagagtgtccgatgcacctgggcctacaccggaagctcttcacgccctagggcgtgcggagtggcacgggggcaatcgcgactacacccagctgtggaagccgatctcggtggaagagatcaaggcctcccgctttgactggcgaacttcgccgggcccggacggtatacgttcgggtcagtggcgtgcggttcctgtgcacttgaaggcggaaatgttcaatgcatggatggcacgaggcgaaatacccgaaattctacggcagtgccgaaccgtctttgtacctaaggtggagagaccaggtggaccgggggaatatcgaccgatcttgatcgcgtcgattcccctgagacactttcactccatcttggcccggaggctgttggcttgctgcccccctgatgcacgacagcgcggatttatctgcgccgacggtacgctggagaattccgcagtactggacgcggtgcttggggatagcaggaagaagctgcgggaatgtcacgtggcggtgctagacttcgccaaggcatttgacacagtgtctcacgaggcacttgtcgaattgctgaggttgaggggcatgcccgaacagttctgcggctacattgctcacttatacgatacggcgtccaccaccttagccgtgaacaatgaaatgagcagccctgtgaaagtgggacgaggggttcgtcaaggggaccctctgtcgccgatactcttcaacgtggtgatggacctcatcctagcttccctgccggagagggtcgggtataggttggagatggaacttgtgtccgctctggcctatgctgacgacctagtcctgcttgcggggtcgaaggtagggatgcaggagtccatctctgctgtggactgtgttggtaagcagatgggcctacgcctgaattgcaggaagagcgcggttctgtctatgataccggatggccaccgcaagaagcatcactacctgactgagcgaaccttcaatattggaggtaagccgctcaggcaggtgagttgtgttgagcggtggcgatatcttggtgtcgattttgaggcctctggatgcgtgacattagagcatagtatcagtagtgctctgaataacatctcaagggcacctctcaaaccccaacagaggttggagattttgagagctcatctgattccgagattccagcacggttttgtgcttggaaacatctcggatgaccgattgagaatgctcgatgtccaaatccggaaagcagtcggacagtggctaaggctaccggcggatgtgcccaaggcatactatcacgccgcagttcaggacggcggcttagcgatcccatcggtgcgagcgaccatcccggacctcattgtgaggcgtttcggggggctcgactcgtcaccatggtcagtggcaagagccgccgccaaatctgataagattcgtaagaaactgcggtgggcctggaaacagctccgcaggttcagccgtgttgactccacaacgcaacgaccatctgtgcgcttgttttggcgagaacatctgcacgcatctgttgatggacgcgaacttcgcgaatccacacgcaccccgacatccacaaagtggattagggagcgatgcgcgcagataaccggacgggacttcgtgcagttcgtgcacactcatatcaacgccctcccatcccgcattcgcggatcgagagggcgtagaggtgggggtgagtcttcgttgacctgccgtgctggttgcaaggttagggagacgacggctcacatcctacaacagtgtcacagaacacacggcggccggattctacgacacaacaagattgtatctttcgtggcgaaagccatggaagagaacaagtggacggttgagctggagccgaggctacgaacatcggttggtctccgtaagccggatattatcgcctccagggatggtgtcggagtgatcgtggacgtgcaggtggtctcgggccagcgatcgcttgacgagcttcaccgtgagaaacgtaataaatacgggaatcacggggagctggttgagttggtcgcaggtagactaggacttccgaaagctgagtgcgtgcgagccacttcgtgcacgatatcttggaggggagtatggagcctgacttcttataaggagttaaggtccataatcgggcttcgggaaccgacactacaaatcgttccgatactggcgttgagaggttcacacatgaactggaccaggttcaatcagatgacgtccgtcatggggggcggcgttggttgagccttgcacagtagtccagcggtaagggtgtagatcaggcccgtctgtttcttccccggagctcgctcccttggcttcccttatatttaacatcagaaacagacattaaacatctactgatccaatttcgccggcgtacggccacgatcgggagggtgggaatctcggggatcttccgatcctaatccatgatgattacgacctgagtcactaaagacgatggcatgatgatccggcgatgaaaatagccaaatgcctcgtcatctaattagtgacgcgcatgaatggattaacgagattcccactgtccctatctactatctagcgaaaccacagccaagggaacgggcttgggagaatcagcggggaa

SEQ ID NO: 385 - DNA, 3720 bp, Ciona intestinalis
cgacggtgaaccaccttgtcgcggtgtaagagctttagtgtctcgaacaagaaatagcttgtgtgctgtccttctgggcggtgcacatacttcttaacctcccgaggccatgccggcgggggctttagcccccggcaggttttaccatgccggacgggttcgagaggtagaggccaaactaagagttcaccagcagacttcgcacgcggctggccactggccgaagtttaaacaacagggccgcatcttcccaaactcaatatatggtgttaagtgaaccgtgccgatgggtgaatggccatgggtaagttggtctctaacggtccttgtggagaagtggcgacccttcacaatacttcagccttaccctatgcccgggcaacttagggtggacgtatatctcccgcggaaaacatcttatctcatggataaaaatatatacgaaaacactacttctccaggagggggaccgctttgcggtgagaagacgcatcgttccgatgtgatcatccctccaccggggttcgccccgtcgacggacactgcttccaatacattaggggaaaatgtggatgcatctgcaaccactagcagtgccaacccattaagtcaggaaccaggatggtgcgaatcttgttccaagctgttcaaatcacaaagaggacttagagtccaccaaagatcaaaacatccagagttgtaccattctcagaatcaaccgcttccgcgatctaaagcacgatggagtgatgaggaaatggttatctttgctcgcgaagaaattgcaaataggaagatccgctttatcaatcagcacttacacaaagtgtttccacacagaacgctagagtcaattaaagggttgaggggaaaaaacgtaagatacgctcgcatcatggctgaccttgaggcggaaatgacctctcagcccgaagcagccacaagcttgtgcaccgaaacatcagaaaatctcgcttctagcaatgttctgccccaaacaagaggatgggctgaaaatctcgtcgaaaatattgacacagcacatctggcaaaccttgggccgttatcccagtttgaacctggtaaaccaagcagcagtacaaaagaggctatcaacaccgagtacaacgactggatcagcaaatggcttccctctggtgctgctcatagagaaagaagagcaaatccaccctcaactaagctaaatgctagagcaacaaggaggctacaatacagtaggatccagaatctctacaaattaaatcgttctgcctgcgcccaagaagtattaagcggggcttggaaggtccagtcgggcgaactgaacttgaaagaggtccaaccgttttgggaaaaaatgttccggaaagaatccgccaaggacaggcgcaagcccaagcccactggtgaagtactctggggactgatggagcctctaacaattgccgaggtgggatccactctgaagtcaacgacaccatcagccccaggacccgacaagttaacactagatggcgtaaagaggatacccattgctgaactagtatcccattacaacctatggttgtacgctggctaccaaccagagggactgcgcgaaggaataaccaccctaattccgaaaattaagggtacgcgtgacccggctaagctacgcccaattacagtgtctagctttatttgccgcatcttccaccgatgtttggcacaacgaatggaaacctctcttccattgggcgaaagacagaaagctttccgcaaggtcgatggcatctgtcataatatttggtccctaaggtctctaatacacaatagcaaagacaacttaaaagaactcaatataacatttttggacgtacgaaaagcatttgactccatctcgcataaatcactgggcatagctgcagcccgccttggacttcccccacccttgataacatacatctccaacctttacccaaactgttctaccaaattaaaagtaaacggaaaaatatcaaaaccaattgaagttcgtcgaggagtccgacaaggagacccactctccccgctactgtttaatgcagtaatggattgggccctatctgaactggacccaagagtgggagtacaaattggggaacaacgaataaaccatctagcattcgccgatgatattattttggtctcttcaacaaagatcggaatggtgtcctccatcaatacgttgagtcgccatctggcaaaatcaggcctcgaaattagcgctgggaaagaaggaaaatcagctagtatggccatcgttgttgatggaaagaaaaagatgtggacagtagatccccttcctaggttcaaagtaaacagccagaaaattccggcactgagtattacacaacagtataagtatctggggataaacatagatgcccaaggggcaagaaatgatgcagctcgaatccttacagagggtctagcagaattatctcgtgccccactgaagccacaacagcgactatatctgcttcgggtgcatcttcttccgaaactgcaacacggactggttttaagtagttgtgcaaaaagagcgctaacatacctggacaaaagtgtaaggtctgcaataagaagatggcttacacttccgaaggacacaccaacagccttttaccatgcgaaagcatgtgacggtggactaggcattacacgtttggaacacacaataccaatactcaaaagaaatagaatgatgaagttgacattgtcagaggatccagtgatcatggaacttgtaaaattgacatactttacaaatttactacacaaatactcaaatgtgaagctgcttaactcctggccagtaacagacaaagacagtctggcccgtgccgaagcctccatgcttcacacctctgtggatgggcgtggactaagcaattgcagtgatgtcccgcgccaaagtgactgggtcacaaatggcgcgtcgctacttagtggtcgtgactttattggagcaataaaagtgaggggcaacctcttgccaacaaaggttagtgcggcacgtggacggcaacgggagataacatgcgactgctgcagacgaccggagtcactgggccacatcctgcagacctgccctagaacatggggaccgagaatctccaggcatgactccctgttgaagcgagttcggaatcaggcatgcttaaaaaactggaccccgataatagagccatcgataccaaccaacataggacttcgtcggccagacctcgttttggccaaaggtaacatcgcctttcttgtagatgccaccgtggttgcagacaatgccaacatgcagttgcaacacgaagcaaaagtggaaaagtacaacaactcagatataaaggaatggataaaagtacactgcccaggggttgatgaagtgagggtaacgtcactaactgcgaactggcgcggttgcttgtatggaggttcagcatccttcctaacagaagacctgggactgcctaaagcagagttaagtctgctcagtgcaaagatcaatgaaaaaggatactacctttggtgtgctcactacaggggaacagcaaggttgtggaatcgaccgttaaggtcctgacagtaatatgaaaacatcacatctgaccggcacagaatcaccatgccgtaatgcacccaactaaggattccaatgggtaaaaaaaaaaaaaaaaaaaaaaaaaaaaaaaaaaaaaaaaa

SEQ ID NO: 386 - DNA, 5183 bp, Danio rerio
  modified_base (1868)..(1868): a, c, g, or t
aatcccccctacccaatccccccgtcgtgacctccaggccaggaatcacgagcgtacgacagtggccatccggcaatgacaatagcgtgactaacgacaatgagtcagatccatgacccttggagtgggttaacctccgcctctttaaaaacatggaaagtacagcaaaaggaaagtcatactggatggcccgtcgcccagtagaaggtgccacggagggatctttgggtcgggtccctttcgtaacgcgagatcctaagcgcaaaccagaggctaaacgaacacttacgcatggcttaggactacgagaatgctcggttgtcttgacacgcctcatcgaggggcgtcgaggtcgcgatcacacaccatcaggatggaacgcacagcgcggcatgccaaacgacgaaagctcggtcgaggagcccaatgggccgataccatctaaccccataccaacgggcacccaagccctgcctgaacctatggcggacggggagcagggggagcacccgggagtggtggtgaccctgccgctcagggacttaaactgccccctatgtggcgggtcggcgagcaccgcggtgaaagtgcaaagacacttggcatttcgccacggaacagtgccggttagattcagctgtgaatcatgtggaaaaacttctccgggttgccattccgtcctctgtcacattccgaaatgtcgcggaccgacaggcgagccgcctgagaaagtggttaagtgcgagggatgcagtaggacgtttggcacaaggagagcgtgtagtatacatgagatgcacgttcactcagaaatccgcaataggaaaagaattgctcaagacaggcaagaaaaagggacctcgacagatggagaggggagagctggagtcgaaagggctgacgctggggaaggtccctctggggaagggatcccccctaaacgtcccagacgtgcgagaacgcccagagaaccgtctgagccccccgcgaatccgccgattctctcgccacaacccgatctgcccccaggaggcctccgggacctactccgggaggtggccagtgggtgggtaagggcagcgagagacggaggtacggtgattgacagcgtgctcgcagcatggttggatggcaacgatcggctccctgagctggttgacgcggcgacgcaaaggacactgcagggcttacctgcagggaggttggcccgaagacccgcaacttttgttgcgcctaaccggaggagaggcaggtgggggcgccggctcaaactgctcgctaagcgccgcgcctaccacgattgccaaattcggttccgaaaagacccagcccgcctagccgcgaacatcctagacggcaaaagcgaaacaagttgcccaatcaatgagcaagcgattcatgagcactttcgaaacaaatgggcaaatccaagtccatttggtgggctgggacgatttgggacggaaaacagggccaacaacgcccacctcctcgggccaatctccaaaagcgaggtccaaactagcctccgaaatgcatcgaacgcctccacaccaggcccagacggcgttgggaaaagggacatttccaactgggatcctgagtgtgagaccctcactcagctgtttaacatgtggtggttcacaggtgtcatcccctctcgcttgaagaaaagtcgtacggtgcttctgcccaagtcctcagacccaggagcggagatggagatcggcaactggagaccaatcaccatcgggtcgatggtcttgcggcttttcacaagggtgatcaatacgagattaacggaagcctgtccgttgcacccaagacagagagggtttcgacgaagccccgggtgttcggagaacctngaagtactcgaatgtctcctccgacactccaaagaaaagcgcagccaactggcagtggtattcgtcgattttgcacaagcgtttgacaccgtctctcatgaacacatgctgtcagtccttgagcagatgaacgtggatccccacatggtaaatctgatccgggagatttacacaaacagctgcacaagtgtcgagctaggccggaaagagggaccagacatcccagtgagggttggtgttaagcaaggggatcctctgtccccgctgcttttcaacctggctttggatcctctcatccaaagtctcgaacgcacaggcaaagggtgtgaggccgaaggtcacaaagtgacagctttagcgttcgcggatgacctggcactggttgcgggctcgtgggagggaatggcacacaaccttgcgcttgtagacgaattctgcctaaccaccggcctcacagtccaacccaaaaagtgccacagtttcatggtcaggccctgcagaggtgccttcacagtgaacgactgccccccatgggttctggggggcaaggccctgcagctaacaaacatcgaaaactccatcaaatatctgggagtaaaagtcaatccttgggcggggattgaaaagcctgaccttacagtggcactagaccgatggtgcaagcgcattgggaagtcactgctcaaaccctcacagaaggtatacattctcaatcagtttgccatcccgcgactcttctacctggctgatcacggtggggccggcgacgtcatgctccagaacctggatgggacaatcaggaaggcggtgaagaaatggctgcatcttccaccgtcaacctgcaacgggctgttgtatgccaggaactgtaatggtggcctcggtatatgcaagctcactcggcacatcccatcaatgcaggcgagacgaatgttccgcttggccaactcatcggacccgttgatgaaggccatgatgcgcggctcccgagtcgaacagaaattcaaaaaggcctggatgcgggccgggggagaggagagtgcgctcccacgggtgttcggggcgaatcagtaccaggaaggggaggaggtcgctaacgatctggtacctcgctgcccaatgccgagcgattggagactggaagaattccaacactggatgggcctgccgatccagggtgtgggtatagccggcttcttcagaaacagggtggctaacggatggctcaggaagccggcagggttcaaagagcggcactacatcgccgctctacaactgcgagcatgtgtataccccaccctcgaattccagcaaaggggcaggagcaaagcgggtgcggcctgcaggcggtgctcatcccggttggaatccagctctcacatcctcggcaaatgtccggcggtgcagggagccagaatcaggcgtcataacaaaatatgcgacctcctgaaggccgaagccgaaacccggggttgggaggtacgccgggaatgggccttcagaactccggctggggaactgagaaggctcgacctggtactcatcctcggggatgaggcattggtcattgacgtcacagtaaggtacgagttcgctccggataccctccagaatgccggaaaggacaaggtcagctactacggcccgcacaaagaagcgatcgctcgggagctgggcgtaagaagggtcgacatacatgggtttccgttgggtgcacgcggactttggctcgccagcaactccaaagtgctggaactgatgggattgagcagggaaagagtgaaggtcttctccagactcttgagtcggagagtgctcctgtactctatcgacatcatgaggacattttacgcaaccctgcaatgaaaatcccagcgggatacagcaagaaggtatcggatctaataaggttgagcgaggagagggtggagatcctttggggggggtcgggctaagttcccctctcgggtcctcccacggtgacgctctacccctccctcctcgctcgtagaacccaacggtgaacacggttggcaggatgaagtgacgtgaggggtaagacatgcgtacgtgagcgcgcatttttgctgttctctggactgggtttcgtccccctcacaaccatcacttacactataggggcacagcggctcctacctccctccctatgacccccccttcccataccgatccatggctgttctagtctggaccgagggtcggacggggcatttgaaggtagctggaatcctccgctgctgcgagcctgaggtcgatggttagaggtgaaatacttgggaggagacacagcctccggagagcccctcccgggtggtcatcatggcaaccgggtgaaaccttacggtttcacttacgaaacagcaccataacagcgccgtaatagcgcaccggtgtgactactgtccagtgctgatattctcatctggagaatacaacacgggtaatggcagagtattcaaaacccaaatgtttacgatcgaccaacggagtcgttcccttgcatctaggccggacccgaaactgccgtaattgcccgtccccaaggtagcctcttagaaaaccgaagcccggtcggggcggtggttgcggcggcgctgcgggggcctgctgctcgggcggcgtcggtgtgccgcggtggttgcggtggtgcggcggggatctcggtccttgcggtgccgctgtgccgccgcggtcgcgtcggtggcgctggggtggtggcccgagtggcgtcggcgtgccactgcccatagtcgcccgcgggggcgaccgatctggaggggcgagggggctcgcgggactttaacgagaaacggaacgcaacttctcgcatcgctcccgggactttcccccctcgttcagccgagggatgccaaaaggcatgaaaggtaagtaccataccggtccgcaaaactctcttctgactcggttctctgttggttttctagagtaacaacgaggtggaggagagggacatggcagggactcccattcgtgccagcgggtggggacagatcgaaggaacggttcgagggcgtaacagacgagagggaatccggtcacacattgatgccatgcctaaataggcgaggtttgtatttctactttgtgggttcagtatagtcggagcatatggtcggttgtcccgttgttttcacggcgggcaagcgactatcatgataaagtagaatgggagacgggctccctgacaaacccggaaaggcgcccccccgtggttcgtagcagctgacggatcacgctcgaagaaaaatgagtgagaggggacgccgcaaccac

SEQ ID NO: 387 - DNA, 2089 bp, Parascaris equorum
  modified_base (178)..(277): a, c, g, or t
ggggccggtgggtttactcacttctgacccaccacctacggaacgagggaaaggcgagctggggccctcttccgctaggcaaggaaccgatctccacgtggtggccctggacaacggatcggagggttgaaggaaatcctctttattcaaagatggaagagatcaagtatagagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtttctacatggacgacgtaaaactgtacgctagaacgcctgcgatgctagactcccaaatccaggtagtgtcagaggtatcggaagcaatgggattccatttgaattgcagtaaatgcgcgaaagcgcattatactccgcatgaagtggtcgccgggcaggaggcgataggtgccgaaaggccgaagcaaccggaaatcccggtgctcggcttccgagacacctataaatatttaggagtggagcaacgcctcttgccaacggtagatgccctcaaagagtttgaagataagttgctggaccgagcaaatataatcttcgccagcgaactcacatgggggcagatggccacagcgtataacactatagctatcgccaccgtgcgatatgtctatagtaatacaaatggagctgcaccaaagcttctggaagccctgaaaagggcggccaccttagacacgcggataagagatcttttgaaacggcataagtgccggttccgaagtagcttcgttgagagattgtatatcccgagagagcgaggtggatgcggattgaaatctgtggaagacacgttgcgggagagcatcctggcgacgtggagctacataaccacgaacccgcatctagccggacagcagtattcgttcgagaagatggcagcaagaggaaagcgcaccccgatggcagacggggcgaagatattgttggatctcggagtggaaccccaggcggacctgaaaggaaggaaggtgaccgttgacgacatatgcttcgacgagccgactaagcttcagcgatacctggtgggaaagctcttgaaagcaagaactgaggagaggattcgaagatggaaagaagccagcttagctggacggttggtaaataacacaacgatcgatttacgcctctcgtgcttgtggatgaagaaaggttttgtgagcgcgaggatcctcagagatgcgcttagcgtacaaggaggatctttgtttactagagcctgccccgcccttagaggcaaaggaagccaagaaatgtgccggtgctgtcatgcagcgccggaaacggcagagcacataacctcagcctgtagtcattggcggcctagtctctatgtggagaggcatgactcggtggcaaggaacctctactacgtgatctgctgtcgctatggcataacaccggtccattactcgaatacggtgtcgccaatctcggagaatgctgaatgccgcgttctttggaacgtggatatacaaactcgaacaccaatgaagcatcgaagaccggacattgtcgtgttcgatctcaagcggaagaggatactcatatttgaagtttctgtagcccatgctagcgggctaattaagcagcgggaaatcaagacaaaccggtatacggtgaattcgaaagagttgcccgatgaagccgtcacaccgtatccgcctgggccgaatttggccgccgacctagcttatagctacggttataaggtagaattcggccccgttgtggtcggaacgtgtggagagcatataccggctgtcagagatgacctgcaaagaatgttggatctaaaaccccaccaagtggaagcccttctagagaggatatcccgatcggcagtgatcgggacggcaagaatagttcgagcgcacctcgcctgttcttagtcgcctccggatctggaaggagaccactcttgcgccgcccggtctggcggcacgttcaacttttcgcctgccttgtaggcagtacatctgcttgcgagcagatgataggcgccggtgacggccctaccaaaaagca

SEQ ID NO: 388 - DNA, 4686 bp, Ascaris lumbricoides
ggggccggtgggtttactcacttctgacccaccaccaacggaacgagggaaagcagagctggggccctcttccgattggcatggaaccgacctccacgtggtggccctgggcaacggaattcaagagaggatttaatcctctctatcatttgcaagatggatgagatcgaggtatccggcaaacaggttccaagtgagcacctttcccatagctgggaatatgggttaggcgtcctctgacatataagaggaatcagactcgttcgcgcccggtcattaacatcgatcagcgggagggccggactgaagtaaatttcctgttggcccgagtgcaggtggagctcggacccgaaaaacgatccctaagaggaccacaacccgaagggatggacgcagtcgccccggcacgtttggtgttggttatcctggagtgttgtgggacgaatagctatgccttgttcaactaactctttttttgaacgagggacccctgagccccatcgtgagccaatctcagggactgactcttcggagtccttaggtatgggtacccaccgttcacctcggctaaatgatgacgaggtgataaacggccccaagggtcacgaaagtgacccggttcatgtagtgcgtgcgcctcgaacgctacacccgaggcgattggaactcccaatcggagtaaataatctcggagaagcctctcaactacggcaagattcagcaatagctgaggaagcccaattggagagcaccgagaaccatgatggacgtcgccctcctttgagaggcggcaggaagctctggagtgaaaaggagatcgccacattaaggagattgtgtgaggcctatggaaataggcaggtatgctggaaagaggttcagaggaagtttgcggacttccacgaggaaagaacagtggctgcgttagccacgaagtggggggctcttaaacgcccgagagctccgatggttggtgcgccaccgactcctgatcatgatccagagcgtggaccagcgggcgagggagatggaggtacaacctcgcaagagaatgtgcctaccgatgatccaatacccgcgaacggcccgacagagggcaaggaatcggatgtgagaccagccgtggcctgtaggtgcacggaaccggaggagcaactgatggagtcggatgtgagaccgcctgcagtcgtaagacttgcagatccggagcagcatacgatgaagtcgggtgtgaaaccggttgcacttgacgggtcagcggatctggaggagcgtccgaaagagaaggatatcgagcagatgggtgttgactttgaaggggaaccgaggtttcgtgcctttcggaaagccttttacgggtatttcagatgggctgtcaactcgtttgatagggaacctgtcaagcgagttaggcgggactgtcccaaggtattttacgcttatgcggattaccttatcgcaaccggaagttctaaggcgttgggaccgaatcaatccaggattggtcgcttgaacggattggtctatgcggcagctagaacaatccaccaattctggagagaagaggtaggccatcgtcagcaaggcgagaagggatggtacacgaaaaccaaggcaacccgtgaagaccttcagatgctcatctctatgatggaatctgaacttgcaagaagaaaggagaagaggaagcccggcgcgaaagagctggagaatatccataagctagttgcaagacttggaacgcgcagcacatcgggcatcgtcagaaggctggagatgacaagacagaggctcaaactgttggaagacagaataagtttgcatgagcaagagaagaggcggaaacgattgcgcaagcaatttgcggaaaccccttctctaaaattactcacaaaaggagccaaggataggggcgatacgatggtaaccatgaaatctgtaatggacttctggagaccaataattggcagacgagttacctccaatccggaccaattgcaagtcttgagagactggagagatgagcagaagaaggcttatccggcagacctggatttagaaaaggccgatcttgaggagaaatatgagggagcaatcaggagaatccaaccgtggaaagctcccggtcccgacggattacatgcccactggtggaaagctttaccgtcggccaagaggctactgggtgaactggtggttgattggctgacaacaggtaaggttaccactggctggatgtgccgagggaggacaatcctgatccctaagaagggtgataggggcgacccttctaattaccgacctataacatgtttaaatacatgttataaggtgctaacatcggtaatgaattcagtcattctgagtcacctgagcagaggcgaagctttaccaatgaaccagcgagcaatgcggaaacgcgagtggggttgcacccacgctatggtccttgacagggccatggtaatggatgcaatggctcaaaagaaacactcattaagtgtggcctggcttgactatcgtaaagcatacgatagtgtgtcgcatgaatatattcgctgggcgattaactccgtgaatataccccggagtgttcagctgacgctcaagaggctcatgagtgactgggagacacgctttgagtcgacgcaatgccggccgaagttaaggtctgacaaaatgaaagtgctgaatggcatctttcaaggtgactcgttatcaccaaccctttttgtattatgcatagcacctatcagctacgcactcaataagggtgtcggccagtgtcaatcctcatccggctggagtgcaggttacggttttgagattggacatcagttctatatggacgatcttaaactgtacgctaggacgcctgcgatgctagactcccaaatccaggtggtgtctgaggtgtcggaagcaatgggactccatttgaatttgagtaaatgtgcgaaagcacattatgctccgcatggggcgggcggagcgcaagaagctgtggaaggtgcagaaggatcgaggaagggagaaatcccgatactcgggcttcgaagcacctataaatatcttggagtggaacaacgactccttccgatggaagtagccctcaaagagttcgaggataagtttatggatcgagcagaaacaatcttcgctagcgaactcacatgggggcagatggccacagcgtataatactatagctatcgctggtctacgatacgtctatagtaatacaaatggagcatcaccaaagcttctagaagccctgaaaagggcggccaccttagacacgcggataagagatcttttgaggcgacataaatgtcggtttcgaaatagctttgtcgagaggctgtatatccctagagaatgcggtggatacgggttaaaatcagtggaggatacgctgcgagagagtatcctcgctacgtggagttacatcgccacgaacccgcatttggctggacaacagtatttcttcgagaggcttgcagcaagaggcaagcgcaccccgatggcggacggggtaaagatattgttggatctgggagtggaaccccaggtggacttgaagcgaaggacggtgaccgtcgacggtatagtcttcgaagacccgaccaagcttcatcgatacctggtgggaaagctcttaaaagcaagaactgaggcgaggattcgaagatggaaggaagccagcttagctggacggttggtaaatgacacaagtattgatatgcgactatcatgcttgtggatgaaaaaaggttttgtgagtgcgaggaacctcagagatgcgcttgctgtgcaagaggggagtttgcttactagagcatgccctgctctaaagggtaaaggcggccaagaagtttgccggtgttgccatgcagcgccggaaactgcagagcacataacatcagcctgccgctattggcttccaagtctctacgttgagagacatgactcggtagcaaggaacctctattacgtcatatgctgccgctacggcataacaccggtgcattactcaaatagggtatcaccgctctcggagaatagccaatgccgcgttctttggaacatggatatgcagactcggacgccaatgaagcatcgaaagcctgatatagtcgtctttgatctcaagagggaaaagatcctcatgttcgaagtttcgatagcccatgccagcgggttattgaaacagcgggaaatcaagatcaatcggtatacggtgaactccgaagagttgcctgatgagaccataacaccgtatccgcctgggccgaatttggccgctgacctcgctgccacctatggttggcaggttgaatttgccccagtggtggttggcacgtgtggtgagcacgtaccagccgtcaaagaggacctgcaaagaacgttggatctaaaacctcatcaagtcgaagcccttcttgaaaggatatcccgatcggcggtgatcggaacggctagagtagtccgagcacacctcgcctgctcctagtcgctaaggggtccggaaatggtccggtcctgcgctacccggttctggtagcacgttcaagcgctcaatcgcctgccttgtaggcagtccatctgtggaagtcgcgctcttgatacagatgtggacggatggaagcagatgatagagccggtgacggccctactagccaaacgc

SEQ ID NO: 389 - DNA, 4126 bp, Bombyx mori
gctagctccctaaaatcctaccttacgtccgaggcgaacatctgtccacgtggggagcggaaacgcgtactatcgaaacttacgcggctaacaaggtaaaggtaacccattaatatggagacaagactaaaaagaaaattgagagggccgcttcccgggggcgatcgccggggcacacctggagctggcgctgggtgttccagcataggatccgtcagcggcggagagttgagcaggcgggctctcgccggggatttacaacccgaaaatgctacagccgccaacagaaatcacgatgtagaaagtaggagcaatagcccatgtgaaccttacagcccgagtaccggttcatacaacccctcggtacaatcatcaccatcatcctcgggtcatagaggctcaccaacgtcgactatggatgttgcgcagggggcgaatctttttacctgcgtccaccaaagctggcaaaacaaggggccgcatgaaatggagcagagaagtaaacctatttatcatgcgcacctactactacgtcactaaattagaaactgatctgactatttacagaaaaaagctgcatgaacatttttcactaaaataccctaatgtaataatttcacagcaaagaatatctgaccaaaaaagggcaatagaaagaaataaactactatctcaagaaaccctagaccgactaaaagaggaagtgagaaaacagctcgaagacgaacaaaccaataatgttgaaaatgaaaaattaaattcagaaacatattcacacgaatatacgacacttactccacaaactattttaacgaagaaaacacagcaacatacaaatattatctctagcacacagacctctcattcatccactcaaaccgaatcaataactctgctgttagaaaatgaagtcgatattttaaatactaaccccacagaaggggcaacacagacacaagaagttaaagataaatttgaaacgaatttaacaatgtactcaggcatggaccctaaagcaaggccgccattgcctaaacttaaatatagctctaagctaaatgaactgatacgtctatttaataatgacatacttgtagattacatctcaccagacacacaactatcagatgtacatacattaacatattgcaccgccgtaactatttcggaacaactaaaatataaaattatagcaatagaaggaaacgcgagacataaaaaaaacttcaaaccaccgtggcaacaaagattggagaaggatatagcaaaattgagagcagatattggtaaactgacccaatacataaataataatagatctaaaaaagtagtccaaagcgttgaacaaatatttaaaaacactaaaatacacacatcacacgaaaatggcaataaaaaatctcaagaatttttagacacactgaaacaaaaattagctctaaaagcccacagactaaaaagatataacaactcacagaaacgaaagaatgagaacactatatttctaacaaatgaaaaactattctacagaaacctaataaagccgaaaactgatcgagacaatagtaatatagatataccaacagcagaacaattggaaatgtattgggctaggttatgggaaaatagtgcaaaacataatgacaaagcaaattggattactgaagaaaaagaaagatgggatacaatagaagaaatgcaatttgatgacgtgacagaggaagaaataactactataacagctagactacataactggaaatccccaggtatagataaaatccataatttttggtttaaaaaactaatttgcttacacaaaacaatagccaaaaatctaacagatattatctctggaaatcaaagtattcccgaattcatagcgacaggaatcacttatatgataccaaaaggtgacttctctatagaagcatcccaatatcgaccaattacatgccttccgactatttacaaaattttaacaacagttattacaaagaaaataaattcacatatagaacacaataatatcttagctgaagaacagaaagggtgtagacgaggccacatgggctgcaaggaacagctaattatagactcaaccatcatgaaacacgccaccacaaaaaatagaaatttacactgtacatatattgactacaaaaaagcttttgatagcatcccacattcatggctgatccaagtcctagaaatctacaaaattaaccctataataataagcttcctacgcaatatcatgacacattggcaaaccacacttaaattaaaaaaccctcctaattttgtaacaacacgacaaatagccataaaaaagggtatttaccaaggtgattctctcagccctttgtggttttgcctcgccttgaacccactatccatcaattgcataatgaccgggcgggataccgattaaacaacaagataacaccgaaacaataatatcacacctgatttatatggacgacattaaattatacgcaaaaaatgacaaagaaatgaaaaagttaatagatactaccacgatattcagcaacgacatcagtatgcaatttggacttgataaatgtaaaaccgtacatataataaaaggaaaagtccaacccggtgattatacaatagatgacacaacacaatacggcgatggaaccaagtgcctttataaatatctgggctttcagcagctcaaaggactcgatcatataacaataaagcaatcattaacttcagagtacaaaaaacgtatcaatgccatttgcaaaacgaaattatctggaaaacatcttataaaagcactgaacacctatgcaatacccattctaacctactcatttggaataataaatggagcaaactgacatagacaaatagaacgaatacaggactacatacaaaaacacaataatcttcatccaaaatctgcaatagaaagattgacaattaaaagacaagacgggggtagaggcatgatagatatttggcatctatggcgtaaacaaatacacagctttaaaaacatttttctacataaaatcagatttaagtgaaattcacagagccatggcacaaatgataacaactacacaccgctaaatctcaaacaaaaagaactaatagataatacagaaaacctaagaaatagaaacccacaaaaagacatggaagaaaacaggaagaaaaaagcgctacatggacgacaccctcatgacctaagccaatctcacatagacagcaaggcatcaaacatgtggctcaaaacaggaagtctgttccccgaaacggaaggatttttaattgccatacaggaccaagtaataaacacaaaaaattacagaaaatatattattaaaaagatccccactattagagacgataaatgccgcaaatgcaacacccagccagaaacaatacagcacataactggagcatgttcaacccttacacagacagattacactcacagacacaaccaacttgctaatattatccatcaacaactggctctcaaacataaattgatacaaaatataaacacaccgtactacaattataaaccacaaaccgttcttgaaaatgactcctgtaaactttattatgatcgcgctattcttaccgataggacgattcactacaatagaccggatatcactttacaagataaaaacaataaagtcacctacattattgacattgcagtcccgaatacccacaacattcaaaaaacgtttacagaaaagatgacaaaatacacagaacttaaagaagaaatagttagaatttggaaacagaaaaaagcatacatagtcccaataataatctcaaccactggagttgtcccaaaccacatccacaacagcttaaagcttctagatttaaaagataacatatttatttcactacaaaaggcagctatcctaaatacatgcagaatagtgagaaagtttatgcagcttgaagaaaaccaaacttactacacgcaataaaaactagcataattattaactcataactaatgtatattacttggccaaaagcccgtatatacagttccaccggctctgtcgacagactgaactgagaaaggggaaacatatgtaaataataataa

SEQ ID NO: 390 - DNA, 393 bp, Phengaris alcon
ccaactctttacaaactacttacgtcaataatcacacaaaaactaaatactcacattactgataataaaataatccctgaagaacaaaaaggctgcgctaaaggatcaacgggctgtaaagaataacttatcatcgacgcccaaatacataatcaaactaaaaaagatcataagaacctttattacgcataaaaagcctttgatagtgtcccgcattcttggttgatacatgtactaaaaatatataagattcataatactttaattcaatttctacaatatataatgcataactggtctactaaactcaatctaagaacagtcagtaccaccgtcagtacctcaccaatcaaagttaagcgtggcattttccaaggcgactcacttagcccc

SEQ ID NO: 391 - DNA, 401 bp, Phengaris nausithous
ccaactctttacaaactacttacgtcaataatcacacaaaagctaaatactcacattactgataataaaataatccctgaagaacaaaaaggctgcgctaaaggatcaatgggctgtaaagaacaacttatcatcgacgcccaaatacataatcaaactaaaaaagatcataagaacctttattacgcatacatagattaccaaaaagcctttaatagtgtcattcttggttgatacatgtactaaaaatatataagattcataatactttaattcactttctacaatatataatgcataactggtctactaaactcaatctaagaacagtcagtaccaccgtcagtacctcaccaatcaaaattaagcgtggtattttccaaggcaactcacttagcccc

SEQ ID NO: 392 - DNA, 405 bp, Phengaris nausithous
ccaactctttacaaactacttacgtcaataatcacacaaaaactaaatactcacattactgataataaaataatccctgaagaacaaaaaggctgcgctaaaggatcaatgggctgtaaagaacaacttatcatcgacgcccaaatacataatcaaactaaaaaagatcataagaacctttattacgcatacatagattaccaaaaagcctttgatagtgtcccgcattcttggttgatacatgtactaaaaatatataagattcataatacttgaattcactttctacaatatgtaatgcataactggtctactaaactcaatctaagaacagtcagtaccaccgtcagtacctcaccaatcaaaattaagcgtggcattttccaaggcgactcacttagcccc

SEQ ID NO: 393 - DNA, 405 bp, Phengaris nausithous
ccaactctttacaaactacttgcgtcaataatcacacaaaaactaaatactcacattactgataataaaataatccctgaagaacaaaaaggctgcgctaaaggatcaatgggctgtaaagaacaacttatcatcgacgcccaaatacataatcaaactaaaaaagatcataagaacctttattacgcatacatagattaccaaaaagcctttgatagtgtcccgcattcttggttgatacatgtactaaaaatatataagattcataatacttgaattcactttctacaatatataatgcataactggtctactaaactcaatctaagaacagtcagtaccaccgtcagtacctcaccaatcaaaattaagcgtggcattttccaaggcgactcacttagcccc

SEQ ID NO: 394 - DNA, 398 bp, Phengaris nausithous
ccaactctttacaaactacttacgtcaataatcacacaaaaactaaatactcacattactgataataaaataatccctgaagaacaaaaaggctgcgctaaaggatcaatgagctgtaaagaacaacttatcatcgacgcccaaatacataatcaaactaaaaaagatcataagaacctttattacgcatacatagattaccaaaaagcctttgatagtgtcccgcattcttggttgatacatgtactaaaaatatataagattcataatactttaattcactttctacaatatgtaatgcataactggtctactaaactcaatctaagaacagtcagtaccaccgtcagtacctcaccaatcaaaattaagcgtggcattttccaaggcttagcccc

SEQ ID NO: 395 - DNA, 367 bp, Phengaris nausithous
ccaactctttacaaactacttacgtcaataatcacacaaaaactaaatactcacattactgataataaaataatccctgaagaacaaaaaggctgcgctaaaggatcaatgggctgtaaagaacaacttatcatcgacgcccaaatacataatcaaactaaaaaagatcataagaacctttattacgcatacatagattaccaaaaagcctttgatagtgtcccgcattcttggttgatacatgtactaaaaatatataagattcataatactttaattcactttctacaatatgtaatgcataactggtctactaaactcaatctaagaacagcgtggcattttccaaggcgactcatttagcccc

SEQ ID NO: 396 - DNA, 405 bp, Phengaris teleius
ccaactctttacaaactacttacgtcaataatcacataaaaactaaatactcacattactgataataaaataatccctgaagaacaaaaaggctgcgctaaaggatcaatgggctgtaaagaacaacttatcatcgacgcccaaatacataatcaaactaaaaaaaatcataagaacctttattacgcatacatagattaccaaaaagcctttgatagtgtcccgcattcttggttgatacatgtattaaaaatatatgagattcataatagtttaattcactttctacaatatataatgcataactggtctactaaactcaatctaagaacagtcagtaccaccgtcaatacctcaccaatcacaattaagcgtggcattttccaaggcgactcacttagcccc

SEQ ID NO: 397 - DNA, 405 bp, Phengaris teleius
ccaactctttacagactacttacgtcagtaatcacacaaaaactaaatactcacattactgataataaaataatccctgaagaacaaaaaggctgcgctaaaggatcaatgggctgtaaagaacaacttatcatcgacgcccaaatacgtaatcaaattaaaaaagatcataagaacctttattacgcatacatagattaccaataagcctttgatagtgtcccgcattcttggttgatacatgtactaaaaatatataagattcataatactttaattcactttctacaatatataatgcataactagtctactaaactcaatctaagaacagtcagtaccaccgtcagtaccacaccaatcaaaattaagcgtggcattttccaaggcgactcacttagcccc

SEQ ID NO: 398 - DNA, 405 bp, Phengaris teleius
ccaactctttacgaactacttacgtcaataatcacacaaaaactaaatactcacattactgataataaaataatccctgaagaacaaaaaggctgtgctaaaggatcaatgggctgtaaagaacaacttatcatcgacgcccaaatacacaatcaaactaaaaaagatcataagaacctttattacgtatacatagattatcaaaaagcctttgatagtgtcccgcattcttggttgatacatgtactaaaaatatataagattcataatactttaattcactttctacaatatataatgcataactggtctactaaactcaatctaagaacagtaagtaccaccgtcagtaccttaccaatcaaaattaagcgtggcattttccaaggcgactcacttagcccc

SEQ ID NO: 399 - DNA, 405 bp, Phengaris teleius
ccaactctttacgaactacttacgtcaataatcacataaaaattaaatactcacattactgataataaaataatccctgaagaacaaaaaggctgcgctaaaggatcaatgggctgtaaagaacaacttatcatcgacgcccaaatacataatcaaactaaaaaagatcataagaacctttattacgcatacatagattaccaaaaagcctttgatagcgtcccgcattcttggttgatacatgtactaaaaatatataagattcataatactttaattcattttctacaatatataatgcataactggtctacttaactcaatctaagaacagtcagtaccatcgtcagtacctcaccaaccaaaattaagcgtggcattttccaaggcgactcacttagcccc

SEQ ID NO: 400 - DNA, 405 bp, Phengaris teleius; identical to SEQ ID NO: 399

SEQ ID NO: 401 - DNA, 414 bp, Phengaris teleius
ccaactctttacaaactacttacgtcaataatcacacaaaaattaaatactcacataactgataataaaataatccctgaagaacaaaaaggctgcgctaaaggatcaatgggctgtaaagaataacttatcatcgacgcccaaatacataatcaaactaaaaaagatcataagaacctttattacgtatacatagattaccaaaaagcctttgatagtgtgtagtgtgtcccgcattcttggttgacacatgtattaaaaatatataagattcataatactttaattcattttctacaatatataatgcataactggtctactaaactcaatctaagaacagtcagtaccaccgtcagtacctcaccaatcaaaattaagcgtggcattttccaaggcgactcacttagcccc

SEQ ID NO: 402 - DNA, 405 bp, Phengaris teleius
ccaactctttacaaactacttacgtcaataatcacacaaaaactaaatactcacataactgataataaaataatccctgaagaacaaaaaggctgcgctaaaggatcaatgggctgtaaagaataacttatcatcgacgcccaaatacataatcaaactaaaaaagatcataagaacctttattacgcatacatagattaccaaaaagcctttgatagtgtcccgaattcttggttgatacatgtactaaaaatatataaggttcattatacttgaattcactttctacaatatataatgcataactggtctactaaactcaatctaagaacagtcagtaccaccgtcaatacctcaccaatcaaaattaagcgtggcattttccaaggcgactcacttagcccc

SEQ ID NO: 403 - DNA, 405 bp, Phengaris alcon
ccaactctttacaaactacttacgtcaataatcacacaaaaactaaatactcacattactgataataaaataatccctgaagaacaaaaaggctgcgctaaaggatcaatgggctgtaaacaacaacttatcattgacgcccaaatacataatcaaactaaaaaagatcataagaacctttattacgcatacatagattaccaaaaagcctttgatagtgtcccgcattcttggttgatacatgtactaaaaatatataagattcataatactttaattcaatttctacaatatataatgcataactggtctactaaactcaatctaagaacagtcagtaccaccgtcagtacctcaccaatcaaaattaagcgtggcattttccaaggcgactcacttagcccc

SEQ ID NO: 404 - DNA, 411 bp, Phengaris nausithous
ccaactctttacaaactacttacattaataatcacacaaaaactaaatactcacattactgataataaaataatccctgaagaacaaaaaggctgcgctaaaggatcaatgggctgtaaagaacaacttatcatcgacgcccaaatacataatcaaactaaaaaagatcataagaacctttattacgcatacatagattaccaaaaagcctttgatagtgtcccgcattcttggttgatacatgtactaaaaatatataagattcataatactttagttcactttctacaatatataatgcataactggtctactaaactcaatctaagaacagtcagtactcgtaccaccgtcagtacctcaccaatcaagattaagcgtgacattttccaaggcgactcacttagcccc

SEQ ID NO: 405 - DNA, 405 bp, Phengaris alcon; identical to SEQ ID NO: 403

SEQ ID NO: 406 - DNA, 405 bp, Phengaris alcon; identical to SEQ ID NO: 403

SEQ ID NO: 407 - DNA, 405 bp, Phengaris alcon
ccaactctttacaaactacttacgtcaataatcacacaaaaactaaatactcacattactgataataaaataatccctgaagaacaaaaaggctgcgctaaaggatcaatgggctgtaaagaacaacttatcgttgacgcccaaatacataatcaaactaaaaaagatcataagaacctttattacgcatacatagattaccaaaaagcctttgatagtgtcccgcattcttggttgatacatgtactaaaaatatataagattcataatactttaattcactttctacaatatataatacataactggtctactaaactcaatctaagaacagtcagtaccaccgtcagtacctcaccaatcaaaattaagcgtggcattttccaaggcgactcacttagcccc

SEQ ID NO: 408 - DNA, 405 bp, Phengaris nausithous
ccaactttttacaaactacttacgtcaacaatcacacaaaaactaaatactcacattactgataataaaatagtccctgaagaacaaaaaggctgcgctaaaggatcaatgggctgtaaagaacaacttatcatcgacgcccaaatacataatcaaactacaaaagatcataagaacctttattacgcatacatagattaccaaaaagcctttgatagtgtcccgaattcttggttgatacatgtactaaaaatatatgagattcataatactttaattcactttctacaatatgtaatgcataactggtctactaaactcaatctaagaacagtcagtaccaccgtcagtacctcaccaatcaaaattaagcgtggcattttccaaggcgactcacttagcccc

SEQ ID NO: 409 - DNA, 405 bp, Phengaris teleius
ccaactctttacaaactacttacgtcaataatcacacaaaaactaaatactcacattactgataataaaataatccctgaagaacaaaaaggctgcgctaaaggatcaatgggctgtaaagaacaacttatcatcgacgcccaaatacataatcaaactaaaaaagatcataagaacctttattacgcatacatacattaccaaaaagcctttgatagtgtcctgcattcttggttgatagatgtactaaaaatatataagattcgtaatactttaattcactttctacaatacataatgcataactggtctactaaactcaatctaagaacagtcagtaccaccgtcaatacctcaccaatcaaaattaagcatggcactttccaaggcgactcacttagcccc

SEQ ID NO: 410 - DNA, 405 bp, Phengaris alcon
ccaactctttacaaactacttacgtcaataatcacacaaaaactaaatactcacattactgataataaaataatccctgaagaacaaaaaggctgcgctaaaggatcaatgggctgtaaagaacaacttatcatcgacgcccaaatacataatcaaactaaaaaagatcataagaacctttatcacgcatacatagattaccaaaaagcctttgatagtgtcccgcattcttgggtgatacatgtactaaaaatatataagattcataatagtttaattccctttctacaatatataatgcataactggtcgactaaactcaatctaagaacagtcaataccaccgtcagtacctcaccaatcaaaattaaacgtggcattttccaaggcgactcacttagcccc

SEQ ID NO: 411 - DNA, 405 bp, Phengaris nausithous
ccaactctttacaaactacttacgtcaataatcacacaaaaactaaatactcacattactgataataaaataatccctgaagaacaaaaaggctgcgctaaaggatcaatgggctgtaaagaacaacttatcatcgacgcccaaatacataatgaaactaaaaaagatcataagaacctttattacgcatacatagattaccaaaaagcctttgatagtgtcccgcattcttggttgatacatgtactaaaaatatataagattcataatactttaattcactttctacaatatgtaatgcataactggtctactaaactcaatctaagaacagtcagtaccaccgtcagtacctcaccaatcaaaattaagcgtggcatattccaaggcgactcacttagcccc

SEQ ID NO: 412 - DNA, 405 bp, Phengaris teleius
ccaactctttacaaactacttacgtcaataatcacacaaaaactaaatactcacattactgataataaaataatccctcaagaacaaaaaggctgcgctaaaggatcaatgggctgtaaagaacaacttatcatcgacgcccaaatacataatcaaactaaaaaagattataagaacctttattacgcatacatagattaccaaaaagccttcgatagtgtcccgcattcttggttgatacatgtactaaaaatatataagattcttaattctttaattcacgttgtacaatatgtaatgcataactggtctactaaactcaatctaagaacagtcagtaccaccgtcagtacctcaccaatcaaaattaagcgtggcattttccaaggcgactcacttagcccc

SEQ ID NO: 413 - DNA, 393 bp, Phengaris teleius
ccaactctttacaaactacttacgtcaataatcacacaaaaattaaatactcacattactgataataaaataatccctgaagaacaaaaaggctgcgctaaagaacaacttatcgtcgacgcccaaatacataatcaaactaaaaaagatcataagaacctttattacgcatacatagattaccaaaaagcctttgatagtgtcccgcattcttggttgatacatgtactaaaaatatataagatccataatactttaattcactttctacaatatgtaatgcataactactactggtctactaaactcaatctaagaacagtcagtaccaccgtcagtacctcaccaatcaaaattaagcgtggcattttccaaggcgactcacttagcccc

SEQ ID NO: 414 - DNA, 747 bp, Xiphophorus maculatus
tacagcacggacattgggatgtcattcggactagagaagtgtggtcggctgatcacaaagaggggaaggtcatccgcacagaaggggtctcactcccagaaggaacaatagcagacatagaggacagatacaagtacctaggtataccacaagcaaatggcaacctcgatgaggtcacaaggagaggagccacagctaaatacctccaacgaataaggcaagtcctgagaagccagctcaatggcaagaacaaaatccgtgcgataaacagctatgccctgccagtaatcagataccctgctggaataattagctggccaaagaaggagataaaagccactgatattaagactagaaactactaacaatgcatggagggttccatcccaaatccagcaccctgagactgtacacgagccgcaaggaaggaggcagaggactagtgagtgtgagaaccacagtccaggatgaaacaactaagatccataaatacatcagggacaaagcctcaacagacaatgtgctcagtgaatatctcagacaacagggaacggaggttgaggtgccagagataccatcatgggaggacaagcccctacatgggatgtaccaccagcaaataacccaagtggctgatatcagtaaatcctaccaatggctggaaaaagctggactcaaggacagcacagaggccctcatcctggccgcccaggaacaggccctaaacaccagagcaatagaggccca

SEQ ID NO: 415 - DNA, 964 bp, Bacillus rossius
aacgactatcagttcgttgaataggcttgatattgcggttcggtccactgtgcgcaagtggctgaacctaccgcattatgtgcccaacgcgtatattcacgctgacgctcgggatggaggcctttccattccctcctattgttggacagtccccctgcaccgcctccataggctgaaggctctttccgtccctttgtggcgagggagggcccgatgaaatggttgcgagtgtgggggaagagatcaagcgtgcatctgctcgcttacaggatcatggtacgaccatcagtacccgtaatgcctactgagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacatagatcgccaatgctcttgtggtaaaacggtattcttggaaccgcatttccacacggcagaaggtctactgaagcctgactctgtcatccttcaagacgcgtttattgcggtagtcgttgatgctttggtggctggagaaaggttggatttagaccgagagcacgaccgtaaggtcagcaagtatgaacccctggaggatttagtaaaagaccggtattttgttgagaaggtgatttttttttccctcccaatcagtgggcgtggtgtgtggggaggaaaatcctttaagcatctatcaaaactgagactgcttggcatttttgatgccaagatcctgtcaacccgagtttttcttggggggatgggggctgtgcatgtgtttaatcgccgtacagctgtaggtgggagggtcaatggctggtga

SEQ ID NO: 416 - DNA, 1043 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctttccattccctcctatcgttggacagtcccccgggttccgtttccataggctgaaggcgctctttgtcctttgtgacgggggaggtccggatgagatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactccgtcatccttcatgacgcgtctactgcggtagtcgtcgatgctttggtggctggagagaggtcggatttagaccgagagcacgaccataaggtcagcaagtatgaaccactggaggatctagtaaaagaccggtattctgttgagaaggtgattttctcttccctcacaatcagtgtgcgtggtgtgtggggaggaaaatcctttaagcatctatcaaaactgagactgctcggcatctctgatgccaagatcctgtcaacccgagttcttcttggggggatgggggctgtgcgtgtgtttaatcgccgtacagctgtaggtgggagggtcaatggctggtga

SEQ ID NO: 417 - DNA, 1043 bp, Bacillus rossius
aacgactatcagttcgttgaataggcttgacattgcggttcggtccactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgaaatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggttgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactctgtcatccttcatgacgcgtctactgcggtagtcgtcgatgctttggtggctggagagaggtcggatttagaccgagagcacgaccataaggtcagcaagtatgaaccattggcggatctagtaaaagaccggtactctgtcgataaagtgatcttcacctccctcatcatcagtgcgcgtggtgtgtggggggggaagatcctttaagcatctatcaaagctgagactgcttgacatctctgatgccaaggtcctgtcaacccgggttctgctcggggggatgggggctgtacgtgtgtttaatcgccgtacagctgtaagtgaaagggtcaatggctagtga

SEQ ID NO: 418 - DNA, 979 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcactctctgtcctttgtgacgggggaggtccggatgaaatggttgcgtgtgttggggatgagatcaagcgagcttcggctcgcttacaagatcatggtatgaacatcaatacccgtaatacctacagagttcgctttgctaggttattgcatacctccaacgatggagcacctcttaaggggtctaagaaggtggagggccagcaccggtgggttaccgatgggtctctcatgctgtcgggtcgtgactacattgcttgcaattgggtcaggatcaactcaatcccgctccgaaagcggactgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaagacggtattctgggaaccgcatttccacacggcaggaggtctactgaagcctgactctgtcatccttcatgacgcgtctactgcggtagtcgtcgacgctttggtggctgaagagaggtcggatttagaccgagagcacgaccgtaaggtcagcaagtatggaccactggtggatctagtaaaggaccggtactctgtcgataaagtgatcttctcctccctcattatcagtgcgcgtggtgtgtggggaggaagatcctttaggcatctatcaaaactgagactgcttgacatctctgatgccaaggtcctgtcaacccgagttctgcttgggggg

SEQ ID NO: 419 - DNA, 990 bp, Anopheles merus
tgtgctctaccgctccttcattcgccgtactgaaaggcagctattttctaagccgacacggttctggagcttctggaacaaacggcgcaatataagaagtatccctccgtcaatgagctacaatggccaaactagtatcgatacatccgatatttgcaacactctcgccaatcgtttcgctgatgcattcacccttcctgttcacaatcctaacacactagcagaggccacccgcaatactccatcggatgctatcgattttattatacccacaattgacgaagcattaattgcgcgcacactcaacgatataaaaccatctacatcatctggacctgacaatattcccgcatacatattgaagcactgccgtcaatcactcgcacccattcttgccaaaatatttaatgattcccttatgcgtggcacgtatcctgagtcctggaaacacgcgcgaatgattcctatccataaaaaaggcagtcgacttcatgctagtaattatcgtggcattgtatccctatgcgcttgtgcaaaggtgtttgagctcattctatacaatccgctactcacagcagttcaaaactatatgagccctagtcagcatggatttctcccaaggagatcttccaccacaaatcttgctgaatttgttggctactgcttcgacaacatggatcgtggtactcaagttgatgcagtatatatcgacttcagggctgcgttcgatagtatttctcatgatattctactttcgaagctaaaaaaactcggtttcctcgactggcacatcacctggctgcgttcatatttaactggtcgttcgtactacataagtataggatctcatcgttctcactctttcaccagctcctccggtgtgcctcaagggagtaatttgggaccgctactcttcctcatctatattaatgatctatctttcgttttaccgccaggccaacacctaatgtatgtcgacgatatcctcat

SEQ ID NO: 420 - DNA, 457 bp, Chironomus circumdatus
acttagctcaataagcaaaatactggaaagagttctgctgagcagaatcaatgaatatctagaaaacaacaacatcattccaaatcagcaatgtggcttccgaacaggaagatcaacatcgcatcaacttatcaaagtaatcaaaacagccagagaaagcataaaaagcaaagaatcaactggaatgatctttcttgatgtggagaaagcatttgacagagtctggcataacggactcttgtacaaaatgatcaagctagggtttccactgccgcttataaaaactgtaagatctttcctcagtgaaagaaccttctcagttcttattaaaggccagttctcggaaatctacgaaatcaaatatggagttccacaaggagcagtgctttcaccaactctctacaacatcttcacgtacgatgttgtacgagaaacaactgaaaatatcgcacttttc

SEQ ID NO: 421 - DNA, 457 bp, Chironomus alpestris
acttagctcaataagcaaaatactggagagagtattgctatatagaatcaacgagcatctcgaggataataacatcattccaagtcagcaatgtggcttccgaacaggaagatcgacatctcaccagctcatcaaagttatcaaaacagcaaaagaaaacataaagaacaaaaagtcaacaggcatgatcttcctagatgtggaaaaagcatttgacagagtctggcataacggactcttgtacaaaatgctcaaactgagattcccactgccacttataaaaactgtaaggtctttcctaagtgaaagaactttctcagtttttattaaaggtcagttctcagacatcaaggtaatcaaattcggagtgccacaaggagcagtgctttcaccaactctctacaacatcttcacgcatgatattgtaagagagacaaccaacaatatcgcactcttc

SEQ ID NO: 422 - DNA, 457 bp, Chironomus luridus
acttagctcaataagcaaaatactggagagagtattgctgaacagaatcaacgaacatctcgaggataacaacatcattccaactcagcagtgtggcttccggacaggaagatcaacttctcaccagcttatcaaagtgatcaaaacagcaaaagaaaacattaacaacaaaaagtcaacaggcatgatcttcctagatgtagaaaaagcatttgacagagtctggcataacggactcttgtacaaaatgctcaagctgagatttccactgccgcttataaaaactgtaagatctttcctctgtgaaagaactttcgcagtttttattaaaggtcagttctcagaaatcaaggtaatcaaatatggagtgccacaaggagcagtgctgtcaccaactctctacaacatcttcacgcatgatgttgtaagagagacaaccaacaatatcgctctcttc

SEQ ID NO: 423 - DNA, 4841 bp, Beta vulgaris
gaaaggattacaaagaagtgtacaaatcaagttaccaaataaactttttctcctaaattctctctaggtgcacgataaggtgagtgctattgtgagccgagtgtagtatggggaggaaaaagaagagctccggggccggtgaagggtcatcggagaccggaaactcacttaagtcatctggaccaattagtaagcaggtagtgggcgcggattttgtagaaagcaatggaacagtaactaaggtaacgccagcgaggagtatggtggctcaaggggagatattagcaacgccggtaccggaagaagtggctgagctagctgaaaagaatcacaacttctggaagagaatgacacagagtaaaatctctgaaaaaggtatgggtctttcctatgtaactccggttgttatcaatggtgaaaatgtagctaaacttgataagaaggaggttgatagagctacggaagagtggcagaatgcattaatcgtgtatgttattggacaaaaccctagtctaatggctataactaagtactgtaaatctcaatgggcaccaaaaactgaacctaaaatattcaagcatgaagagggatattttgtggtgaaaatggagacagctgaggatagagatgcagttctatatacagggcctcatttattttttggtaaggctatgattgtgaaacagtggacatctagctttagctttaatcaggagattttaaaaattatcccaatatgggttacctttcctaatcttccattgaactgctggtctcctgattctctgagtaggattggaagcactattggggtaccaatatatgcagatgaatgtaccacgaaacaattaagaatttcatttgcaaggatcttgattgaaatggatgtaacagggaagatccaagaggaaataaaggtggaagatcctaatgggagggtgttcacacaaaaggttgggtatgcttggctaccaccattttgtcctaaatgtcagaagataggtcatgtgtgtgaggagaaaaagaaggctactaaaggaaggatcacccaaaaatgggtaccagtgggacaagctaaggatcttctgtcatccattccagtcttagaggctgatactggggatgatagggttactggaaatcctccaacaatttctagtaatccaaatcaacctgccaatgtaaccccagtggttacgccagtatcttctactcagagacaggaattggatgatgaaggggcttggaagctggtaacaaggaaaacaaaggataaagggaagcaagggacctttcaaacagctaaaacagctgtaatgtatgaactatctggaggacgaagctcagctgctggtgctgggggtgctaagggaccaaacccttatttgtcttaatgttatgtgtctcttggaatgttagggggatgaatgatccctttaaaataaaagaaatcaagaatttcttgtatagtcacaaaattgttgtgtgtgctttactggagactagggtgagggaacagaatgcaagcaaggttcaagggaagttagggaaagattggaagtggttgaataattattctcactcagcaagagagagaatatggataggttggaggccagcgtgggttaatgtcactcttacacatacccaggaacaattgatggtatgtgatattcaagatcaatctcataagttaaaaatggtggctgtgtatggccttcatacaattgctgataggaagagtttatggagtgggttgttacaatgtgttcaacaacaggaccccatgattataattggtgatttcaatgctgtatgccactcaaatgataggctatatgggaccctagtgactgatgcagagactgaagattttcagcaattcttattacaatcaaatttgattgagagtaggagcacatggtcatattattcatggtctaatagcagtattggaagggatagagtactgagcagaattgacaaagcctatgtgaacctagtttggctaggaatgtatgctgaggtaagtgtgcaatacttaccccctggtatctcagaccactctcctctgttattcaacttgatgacagggaggccacaaggggggaagccctttaagttcatgaatgtaatggctgagcaaggtgagttcttagagactgtggagaaagcttggaattctgtaaatgggagattcaagcttcaggcaatatggttgaatctcaaagcagtcaagagagagctgaagcaaatgaagactcagaagattgggctggctcatgaaaaagtgaagaacttaaggcaccaattacaggacctacagagtcaggatgattttgatcataatgatataatgcagacagatgcaaagagtataatgaatgatttgagacattggtctcacattgaagatagtatccttcagcaaaaatccagaattacctggcttcaacagggagatacaaattctaaactgttctttactgctgttaaagcgagacatgccattaatagaattgatatgttaaatactgaagatgggagagtaattcaggatgctgatgaagtgcaggaggaaattttagaattttataagaagttgcttgggacaagagcatctaccttgatgggggtggatttgaatactgttagggggggtaagtgcttatctgcccaagcaaaagaatccttaattagagaggttgctagtactgaaattgatgaggctttggctggtattggtaatgataaggcgcctggattggatggttttaatgcatatttcttcaagaaaagttggggaagcattaaacaggagatttatgcaggtatacaggaattctttaataacagcagaatgcatagaccaattaactgtatagtggttactttattacccaaggtccagcatgcaacaagagtaaaagaattcaggcctatagcttgctgcacagtgatttataaaattatatctaaaatgctaaccaacaggatgaaggggataattggtgaggtggttaatgaggctcaatcagggtttattcctggtaggcacatagcagataatatcctacttgcttcagagctcataagaggttatactaggaaacacatgtctcctagatgcattatgaaggtggatattagaaaggcttatgattcagtagaatggtcatttcttgaaaccttgttgtatgaatttggttttcctagcaggtttgtgggctggattatggaatgtgtctctacagtgtcttatagtgtgctggtaaatggtatccctacacaaccatttcaagcaaggaaagggctaagacaaggagatccaatgtctccttttctttttgccttgtgtatggaatatttgagtaggtgtttggaggaattgaagggtagccctgatttcaactttcatcctaaatgtgagagactgaacatcactcatctgatgtttgcagatgatttactaatgttctgtagagctgacaagagttcccttgatcacatgaatgttgctttccaaaaattttctcatgcctcagggttagctgcaagtcatgaaaagagtaatatttacttttgtggggtagatgatgagactgctagagagctagctgattatgttcatatgcaattaggggagctcccctttagatatcttggagtccctcttacatccaagaaactgacctatgctcaatgtaagcctctagtggagatgattacaaatagagctcaaacttggatggctaaattgttgtcatatgcagggagactccagttgattaaaagcatactcagtagtatgcaaaactactgggctcacatctttcctttgtcaaagaaagttattcaagcagtggagaaggtatgcaggaagtttctttggacagggaaaactgaggaaactaagaaggctccagtggcttgggctacaattcaaaggccaaaaagcaggggtgggtggaatgtgattaacatgaagtactggaatcgagcagcaatgctgaaattgttatgggctattgagttcaaaagggacaagctgtgggtcaggtggattcactcctactacatcaaaaggcaggatatacttactgttaacatcagtaaccagactacatggatcttgaggaagattgtcaaggctagagaccatctgagtaatattggagactgggatgagatatgtattggagataaattttccatgaaaaaagcttataagaagatcagtgagaatggtgaaagagtaaggtggagaaggcttatatgcaataattatgcaacacctaagagtaagtttattttatggatgatgttacatgaaagactgcctacagtggatagaattagcaggtggggcgtgcagtgtgacctcaattacaggctatgcaggaatgatggggaaacaatacaacacctgttcttttcttgcagttactcagctggggtctggagtaaaatttgttacattatgagatttcctaactctggagtatcccatcaggagattatatctagtgtatgtggtcaagcaagaaagaaaaaagggaagctcattgttatgctgtacacagaatttgtgtatgcaatctggaagcagagaaacaaaagaactttcactggagagaataaggatgagaatgaagtccttaggaaaattttatttgcagtagctgcacaatgtaatgatgaggaaaggagtctgctgatgctgtaattctcctaagtgtatttgcgtttgtctgcttcatgtgcttgcttttgttgcacatatttttttggtatatatatacatctttatttgccaaaaaaaaagaaaggattacaaagaa

SEQ ID NO: 424 - DNA, 1042 bp, Bacillus rossius
aacgactatcagttcgttgaataggcttgatattgcggttcggtccactgtgcgcaagtggctgaacctaccgcattatgtgcccaacgcgtatattcacgctgacgctcgggatggagacctttccattccctcctattgttggacagtccccctgcaccgcctccataggctgaaggctctttccgtccctttgtggcgagggagggcccgatgaaatggttgcgagtgtggggaagagatcaagcgtgcatctgctcgcttacaggatcatggtacgaccatcagtacccgtaatgcctacagagctcgctttgctaggctattacatacctccaacgatggagcacctcttaaggagtctaagcaggtggagggccagcatcggtggattactgatgggtctctcatgttgtcgggtcgtgactacattgctagcaatagggtcaggataaatgccatcccgctccgaaagcggactgctcgcggacgtgtccgtgacacccgctgccaggcgggatgtgacagcattgagacattacatcatgtgctgcagcaatgtcatcggacccatgacatgcgaatcaaaaggcatgatgcatgtgtgaagtacttactagatcgccaatgctctcgtggtaaaacggtattcttggaaccgcatttccacacggcagaaggtctactgaagcctgactctgtcatccttcatgacgcgtctactgcggtagtcgttgatgctttggtggctggagaaaggtcggatttagaccgagagcacgaccgtaaggtcagcaagtatgaaccactggaggatctagtaaaagaccggtattctgttgagaaggtgattttctcttccctcacaatcagtgcgcgtggtgtgtggggaggaaaatcctttaagcatctatcaaaactgagactgcttggcatctctgatgccaagatcctgtcaatccgagttcttcttggggggatgggggctgtgcgtgtgtttaatcgccgtacagctgtaggtgggagggtcaatggccggtga

SEQ ID NO: 425 - DNA, 1042 bp, Bacillus rossius
aacgactatcagttcgttgaataggcttgacattgcggttcggtctactgtgcgcaagtggctgagcctgccgcatgatgtgcccaacgcgtacatccacgctgacgctcgggatgggggtctctccattccctcctatcgttggacagtcccccggctccgtttccataggctgaaggcgctctctgtcctttgtgacgggggaggtccggatgagatggttgcgtgggttggggatgagatcaagcgagcttcggctcgcttacaagatcatggtatgaacatcaatacccgtaatacctacagagttcgctttgctaggttattacatacctccaacgatggagcacctcttaaggggtctaagaaggtggagggccagcatcggtgggttaccgatgggtctctcatgctgtcgggtcgtgactacattgcttgcaattgggtcaggatcaactcaatcccgctccgaaagcgggctgctcgcggacgtgtccgtgacacccgctgccgggcgggatgtgacagcactgagacattacatcatgtgctgcagcaatgtcatcggactcatgacatgcgaatcaaaaggcataatgcatgtgtgaagtacttactagatcgccaacgctctcgtggtaaaacggtattctgggaaccgcatttccacacggcaggaggtctactgaagcctgactccgtcatccttcatgacgcgtctactgcggtagtcgtcgatgctttggtggctggagagaggtcggatttagaccgagagcacgaccataaggtcagcaagtatgaaccactggcggatctagtaaaagaccggtactctgtcgataaagtgatcttcacctccctcatcatcagtgcgcgtggtgtgtgggggggaagatcctttaagcatctatcaaagctgagactgcttgacatctctgatgccaaggtcctgtcaacccgggttctgctcggggggatgggggctgtacgtgtgtttaatcgccgtacagctgtaagtgggagggtcaatggctggtga

SEQ ID NO: 426 - DNA, 439 bp, Iberochondrostoma lusitanicum
ccctctttttaagaagggggaccggagggtgtgttccaactatagggggatcacacttctcagcctccctgggaaagtctatgccagggtactggagaggagaatacggccgatagtagaacctcggattcaggaggaacagtgtggttttcgtcccggccgtggaacactggaccagctctataccctctacagggtgctggagggttcatgggagtttgcccaaccaatccacatgtgctttgtggatttggagaaggcattcgactgtgtccctcgcggcgtcctgtggagggtgctccgggagtatggggtccggggtcctttgctaagggctgtccggtccctgtacgaccgaagcaggagcttggttcgcattgccggcagtaagtcagacttgttcccggtgcatgttggactccggcagggctgccttttt

SEQ ID NO: 427 - DNA, 6614 bp, Beta vulgaris
aattctattttaatatgtaaaaaaaaaatgtctagagagagagagagagtgtttagagagagagagtccagaaaggctgagcgtttcaaccaggaatggactactgtcaccaaaaggaaacatcccaacagaccttacccccctccgcctccacctctagcctccaccaccgcatacataaagttcctacccccacgtttcaactcctcagatgtagccggaatcttccacatatatggtcccataattcacatatccctaccaaaagccaaaagacccaaccctcaataccaattcgcctttgttaagttcagggccaagcaatcccttcatcaagccattcttcatgaaaatggtagaataattgaaggaaagaggttaaaagttgaactggccaaaactgatacctatggccctcccccaaaatcgcaccaacagacaaaccttgcccaaaaccttaaacctacaaaaccaaaaacaaatcccaatccatcattcaagacatcattacgggaccacagatcttacaaggatgcctccaccccccaccaaactaatccaaccacgaaacacaacaaacccacttaccaaacatcaccctcgcatgtatacctttctctccagcaaattgaacctcaacctgacttcatccagcaggaaatgagttatgctcgaataatgtgttcgagagttcttggtgaagaagtggagcaagcaaggataaaccttgaaacaggagaatgtgatgaggaaacggtggggcttataaagctaagtagaagccacgaaaacgatgaactattgaaaagaagtcttattggtgtatcctttaacccaacttcctcaaactcaaaccttcatcagattctagcagagggtgtgtcaaatatcactattacatctctgggaggccccatgcacctcctatccttcgaatcagaggaggacaaacaactcatgctggaaagcaaatggctggaacgatggtatatggagctacgtaacgcttccagcaaaatctcgtctctgtggagagaaacctgggtaactatctatggcatacctctatctgcatggtcctatgataatatactcaaaataggaagtatttttgggaaagtgctctcggtgaatcaacggaaatttgaatacacaaaaatcttgatctccactgactgtatgttcaagataaattgcaaaatggcaatagacgtagatggtgaaaaatcgaaaatacacatatgggaaagtccacaagaccaatcatggatgaacaatgcagaaaagaaacctggctcaaaagtcaaaactgacacagatccgatagattctgatgatgaaaaaccaccgtcgggggaagatgaaaagatctctgacagaaatgattaccaaccacttgaaaacggttcacaggtcatgtcggttcagttcccaaatgagattaatgacccagccattcccaaaaataacccaacaccccaaaaaaacggctcccaaaaaagccaaacagttcccaaagcttgtccagacaagccacaagtgtcaaaacagccaaactctgagcctgggctgcatgaaggccactgcaaatcttcccctagccagcctaaacactacacatccccatctaagtccataaaccaagtttcaaaaagtccaaacaaaagcccaaacccccaaattaccaagcccaatcattcctcgcccatggtccatctcaacaatagatttaaccctctccaaagacaaaacacacactcaaccacaataacttctagctctggaccatccttcccaccaggctttgaagagtctatcccactccacctcaaacaagcccatgcccgaaaacgtaaaaaaaaagcaaaaagaagaatgcaaaaaaaggcaggaccttcgtcttctgaccacaggcttagagaagcatcttcccatcatgataatgctgatgaaatgttcaacatcagtgcagatgatgttattgaaatgggccatgctcttggggcatcattcaacggtccaagatcagcactcaaagaacgaattgagtccattctatcagcacagaaagctaactgggacgcatctcagagataagtttcctgtctcttcacttaatctcatttatctatgattaacattctttcatggaacataagaggcctaggggctaggattaaaagaagtgcccttaggaaaatgatctctatccacaacccccttttcatcaccatacaggaaacaaaactaggggaaattgaccccaaacttataagatcaatatggaactcaaatgaggtggcatggactttcagcccggctgacggtaatgcgggtggaattttgactctgtggtcaaaaacattcattacagtgtcctcatcacatgtttcaaaaaattggattgcagtccgtggaaccatttcacatctgaactgggattgttccctcatatccatctataatccatgctcagtcgaggagcgagcagttgtgtggggagaaattcttgaattctggacaacatccaaacttccttgcctcattataggagactttaacgaaacacttgcatcaaatgaccgaggcagtctagctatatcccagtccggttctaatgatttcaggcaatttgttcaatccctacagctcactgaaatccctacaacagaaagattcacttggtttagggggaattctaaaagcaaactggaccgttgcttcgtaaatccagaatggctcactcattacccgacactcaaactatctctccttaatcgaggcttatcggatcactgccctctactcctaaattcttctgtcagaaactgggggccgaagccctttaaatttcagaactgttggctgtcagatccaagatgcatgaggctagtaaaagatacatggcagaaatcttccccaatgggactggtacagaaactcaaaacagtcaaaaaagatcttaaagactggaatgagaaagtgtttggcaatattgaggcaaacatcaaacagctggaacatgaaatcaaccaactggataaaatctcgaacgaaagagatctagactcatttgaacttgaaaaaaagaaaaaggcgcaagtggatttgtggtcctggatgaagactaaagaatcctactggtcccaacagtcaagaattaagtggcttaaacaaggggacagaaatacgaagtttttccatgtggtagcctcaattagaaagcataggaacagcattacatcgatagaggtgaatggggacaaaatttcggagccggagaaaattaaactggaagccatgaagtatttcaggaaagccttcaaagaagaatcttataatagaccactgctcgaagggctagatttcaagcatctcacagaagctcaatctgcggatcttatagcgcctttctcacatgaggagatcgacaaggctgtggcctcatgtagttctgataaggcccctgggccggatgggtttaatttcactttcattaagaaagcatgggatgtaattaaagaggagatttatgagactgtccaagagttctggaattcatcaaggctgcccaaaggatgcaacatggcttttattgccttgatcccgaaaacagatagccccaaaggcttccaagacttccgccccataagcatggtgggctgtgtttataaaatagtggcaaaacttctcacaatgaggcttcaaaaggtgatgaattcgctagtagggccggcccaatcttcattcatagaggggcgccatattcttgatagcgccttaatagcaggggaattgatagactcatgtaaaaggtggaaaacttcatcatcactattaaaaatagattttcacaaggcctttgatagtgtatcttgggcttttctggattggactttggagaaaatgaatttcccgatacaatggcggcaatggatacaaacatgcgttacaacagcctcttcatcagtactaatcaatggctctccctcgccaccatttaaattacaaaagggcctgcgtcagggggacccactgtcaccattcttattcgtgttggtggttgagacccttaatctgctcatcaacaaggcaatttcactcggtttctgggaaggagttgaggtatcaaagggaggtttaaaactttcacacctccagtacgcagatgataccttgatattctgtgctccaaggattgactatttgcaaaatatcaaaaaagtccttatactcttccacctagcatcaggattgcaaataaactttcataagagctccttgattggcataaatgtctcgaaccaatggatgaaggatgccactgcttcacttctatgcaagggcggatcattgcccttcaattacctgggacttcctattggaggtgactcgtctcgaatcaaaacatgggaaccaattctcgagcgtatttcgaaaaaacttgactcatggaagggtagactgctgtcaattggaggaagagttaccctaattaaatcttcaatctccagcctaccactttactttatgtccctatttcccataccaagatccgtaatcgagcaaatcaacaaattgcagaggcacttcctttggagtggcgaccgtggaaaaagagcattgtcacaggtagcttggaaggtaatagagctccctaaagcttttgggggattaggtattggaaatatcttccacaggaaccttgctctattgttcaagtggatttggaaattttttaatgacacaagtccactatggagggagttaatatggcacaaatataagtacaagcaaccactcacaatccgggaccttgatcctccaaggcaaggtggcccatggcaaaaaattgtatcagccataatcaaaagcccaaccgcaaaggctattgcaattaatggggtccgaagtcttgtaggtgatggagctctaacactattctggcatgaccaatggctgggcccaaagcctctaaaggcccagttcccacgactctacttacttgctacgaataaaatggcacctgtggcatcccattgtttttgggatggtctggcatgggcctggtctttctcttgggccaggcaccacagagcccgtgacttggatgaaaaagagaagttacttgagcttcttgatatggttcaccttgatcctagcaaccaagactccctggtgtggagttatcacaaatctggaagcttctcaacaagctccttcacggcagaaatggcaaaagcaaatctccctcctcatacggacgcaattaaaggtgtttgggtgggcctagtaccacacagggttgaaatatttgtatggatggctctgctgggccgcataaataccagatgcaagttagcctcaattggtataatcccacaaagcgagaacatctgtgtcctatgcaacacctcacctgagcagcacaatcacctgctcctccattgtcccttctccctcagtctctggaactggtggttagatctttggcggttaaagtgggtcctgcctgagaccctccgcggcttgtttgatcaatggctatccccgataaagaccccctttttcaaaaaagtttgggcagcaacctttttcatcatatcttggtcaatctggaaagagagaaactctcggatctttgaaaatacatcatctcccccgtcaagcctccatgatctcattttgctccgcctgggttggtggatctccggttgggatgaagccttcccttattcacctacagatattcagagaaacccgcaatgtttggtctggggtggaaaaattcctcatcccttacaagcccctcacccctcatctgctatctggaccccccctgatcatggatcgctaaagtggaatgttgacgcttcgtataacccccttaaccatagagcggcagttggtggagttttgaggaaccatctaggccacttcatatgtgtattctcggtcccagttccccccatggagattaactttgctgaggttctcgcaattcaccgggctctttcaatttcacactcagatatcactcttcagtcatcactattggtaatcgaatcagactctgccaatgcagtgtcatggtgtaatgccaagcagggcggaccgtggaacctgggctttcagctcaacttcattagatctgcaggatctagagggctaaaaattgaaataattcacaaagggaggtcatccaaccaggtggcagatgctcttgccaagcaagggctttcaaggcgagataacttcattgcatggctataaaatctcaacagatattctccttgtaattcacagtcacctagctttactgatgcttagtaatctggcagactataggccccttggcttgttgttgtagctcatagtgatgatactttgttgttgtcttggtaggtaataatccctggtatcagtaactagattgtaaaaatcaatggtgggggactcctctctttagggtgtgtttagacactatgaaaatttcgcccacctagtgggggaatgcccttttttgagttagaggcctcctccattctttggattcatcaataaaatgagtcacaaattatcaaaaaaaaaaaaaaaattctattttaatatgt

SEQ ID NO: 428 - DNA, 6688 bp, Beta vulgaris
aatagaattagcatataaagaaattcaagagagatgagagaggagagagcatccagagagagaaacaaagaattccaatggaccactgtcaaacattcgaaaacgagacaagctcaaactcaagcacggcggacgtgcttcatcaaccacctcccagcaacgataaccatccctgaaatatcacaaatattccgaacgcacggagccatagcaaacatactcatacctgcatcccagaaaaacccagatcaagtatttgcgtttgtcaaattccactttccacaatcgatgaacacggcgttgcgagatgaacatggtaagtcagtaaaagggtcaaaaatcacagtattcccagcgaaatacgacaagcccacaccaaagatatatcaaaaccacaaacctcaaaccacccatacacacattccaaataaccccatcacaaaccggcaatataatccaaaaccaagctttagagatgcaagaacgtaccgggaagtggcgaaccccagtacacaggtaaaggaaagaactcacccaaactcaaacccaaacccaaatcaaaaaaagaaaacccctcaccaatcccaaactccaccagatgaaaaagaaaaacatcagaaaaaacaatttagtgatgtcagacaagaagtcaccctcctcaaatccactccctccagacatagaataatgagctcgagatgtcttggagaaagcactgaacagacccggaactcgctaaaagaaatagaagaaaatggagagttcgcagcagcaattgaaggagaaaggtgtaaggagaatgatgaattattccagcgcagcgccattggtattactgactcgttacaagaagctgagtcaatcatggaccacataatggcagagggagttaactgcattaaaataaaagctatgggaggaatgcagcacttgctaatcttcgagacacttgaagacaaacaaaatatgatagacagtaaatggctagaaaggtggttcattgcaatcagaaacgtgaacaagcatagtgcagctctatggagggaaacatggataaacatctatgggactccactcattgcttgggaatacagaaacttcctcaagatagggagcatatttggaagagtaaaatcaatcttatatggagagtatgactgtgcacatatattaatcatcactgactgtctttttgacatcaattgcaaaattcaattacaaatagacgaggtgaattatccggtattcgtatcagaaaaacagcagatcatttacccaaaatcaaggccaagcaacgctgagacagaatcagagtcagaagaatcctcagcaaaacaaaaagaagcagttccaggtaagtccccatccactgaaatttcaaatcatgatgatgaggagacaaaaagccataatgtgaatgacgtaagcaaaaaagaagagaatacacaacgtcacaatcatgagacacaagaacagccactaaggagaacagaaatcgagggcgaattaaaaaacctcggaaatcagaagcagtccccaccagatattaatacccatccaatagaagccaatcatgaccccacagataaagctgcacaaaaggtggaccttgtcattgggtcacctgcaaaaaaacaaagccaatcaccaatcaaaactcaagacaaccacaatgagagcccaacaaaattattcacaaccaatagcccaacacattccaccaaaaaaaacatgcaaactcaccctgaacatcatatatctcccatacagttgcaaaacaaatttgggcctctgctaagaagtagaaaaacaatatcctcttccatatcatcaatgggctcttcaacgtgctcaggccccctcttcccaccagggtttgaacaggccatcccaatccagacgagaatagaaaaagaaagaaagagaaggagaaaaatggagataagaagtaaactgaagagtgaaaaagcaggcacccaaaaggcagaatcaagccccccacatagaaataatgttagcataatccacattgatgatgtgatcaaaatggcagagaccatagggctcactttcaaagggccagttgcagaattgagaaaacgaattgaatcgattcttgcagagcaaaggcaaaattgggaggcaaatgcctagtccctagcagaacaattcatgtcaacagcgtgttaataaatgttgctgatttcatggaacatcaggggtctaacagcaagacccaaaagatcttctctcaggaagatgatatttcaacatgatcccacctttgtattcatccaagaaacaaaaatggatgatataacaaaaaaatcagtaaaaacttactggaaggcagatgatgtggagtggatctttagcccagcggcaggtaactcaggaggaatcatatcattatggaacaaaagtagtttcaccatggcatccaccaaaatagcaaggtcctggatggcgatcagtggctgccttcatgaagtaaactatgaatgcaccctcatcaatgtttataacccatgtgatgtaggggaaagagctgaagtgtggagagagttattggagttccaaaaaaacaatccacgcccatgcctagtcattggcgactttaatgaagtactcaatgaaaatgaacggggaagtcactatttctctcagacaggcagcactaactttaaagatttcgtgcaggactctcatcttcttgaaatcccaccagcatgtggcggattcacttggtttcgtggcaattcaagaagcatcctcgacagacttttcgtaaatccagaatggataacaaacctcccgaatctcagagtatccctactgcaaaggggactgtcggatcattgtccgttactagtacataacaaagaactagactggggtccaaaaccttttcggttccagaattgctggctctcggacccggaatgcttgaaaatagtgaaagcggtgtggcaagatgctgaggcattacataccatcggaaaattgaaagaagtgaagaaacggctcaagtcttggaatctcactgagtttggcaatattgactcaaagataaaaaaatttgaatctgaaattcaacatctggatagcatcaacaatacaagagatcttgacactcaggagctagaaaaccgcaaagaagcacaagttgagttatggaaatggataaaacgaagagagatgtattgggcccagaattcgagagttacgtggctaaaagaaggagaccgtaacacaatgttcttccatgcaattgcttctaataaaaggaggaaaaattcaataaccaccgtggaggttgatgggctgaaaattgatgaaccttctcgcataaaatgggaggccactacatattttaaaaaaatattcaaagaggagcatggctgcagacccttatttgaagacttaaatttcaagtgtgtcactcatgagcaagcagaacagctaaccctcccattctcatgtgaagaaatagatgaagcagtgtctacatgtagctcagacaaagcgccgggcccggatggatttaattttaaattcatcaaaagtgcatggggaattataaaacacgacatatacgagatggttcacaagttttgggaatcatcgcgacttcctcaaggctcaaatgttgcatatattgctcttatcccaaaaatgagcaatccgaaaaatttcaaagactatagaccaataagtatggtcgggtgcttgtacaagataatagctaaggtgatggcaaagaggctgcagaaaataatgagttcacttattgggcctcttcaatcttcttacattgaaggaaggcaaatacttgacggggcactagtagcaggagaagtcattgactcatgtaaaaaaagtggggttgaagcaatcctattcaagcttgattttcacaaagcgtacgatagtgtttcatggagtttcctcaaatggattttaatgcaaatgagatttccggagcaatggtgtcaatggattatgacttgcgtcacaacggcatcggcatcaatcttggttaatggctcccctagtacgccgttcaagttaaaaaggggcttgaggcaaggagatccactatctcccttcctatttgtacttattggggaagcactaaatcaggtgatcttgaaggctacaaatatggggttgtggagcggcgtggaagtttgtagaaacggtttaaagatcacgcatcttcaatatgcggacgatacattggtttttagtgatgctagattggagtcattaaaaaacatcaagatggcactcatccttttccacctcgcttcgggattacaagtgaattttcacaaaagctcaatcataggcatgaatacatcaaaaacgtggctcaatgaagccgcaaattcactactttgcaaaaccggtgacatccccttcacctacttgggcttgcctataggggaaaacattcacaaaattaaagcatgggatccaatcatcaacaaaatctcaatgaaacttgcaacatggaaagggcgaatgctttcgattggaggtaggttaaccctaatcaaatcttcactttccaacctacctctttattttatgtcactcttccccattcctaaaggggtggtcgaaaagataaataagatcactagaagatttctatggtccggagatatggaaaaaaggtctatccctctagtggcctggaagattgctcaactgccgaaagacatggggggcctaggcataggcaacatattccataaaaattcagcaatgttgtcaaaatggatgtggagactccttagcgattcatcacctatttggtgccaagtggtttgtaacaaatacaagtatcagggcactttatcaatcacggacatcaaggtgccgaaatcaggtggcccatggaggcatatatgtgcagccatattccatcaagcaaatgtgaaagaattactctacaaagggtttcgaaagaatatcgggagtggctcccaaacccgtttttggcttgattcatggctctcatcctcctctctaaaatcagagtttccaagactattctcaattaccatgaatccgaacgcatcagtggagtcactcggtttttgggaagggtataattgggtgtggagtttctcatggaaaaggattttaaggccccaagatgcaattgaaaaagcaagacttgacaacttgctacttcaagtgtgcccagcaaggcaggcccaagatcatctaatttgggccttctccaaatctggctcattctctacaaaatcagtatcaaggcaactcgtcaagcttcagcatcctcattatcaagatgcaatcagaggtgtatgggtgggacttgttcctcacagaattgaattattcgtttggctggctttgttggggaaaataaacactcgcgacaaactggcatcgcttggaatcattcacggtgattgcaatatatgtccgttgtgtatgaccgaacccgaaacagcagaacaccttctactgcactgccccgtagcatcccaaatatggtcatggtggatcggattatggcgaattaaatgggcattccctcttagtctccgggaggctttcacgcaatggttttggccaaaaaattcaccttttttcaaaaaggtttggtctgcggtttttttcattatagtgtggaccttgtggaaggagagaaaccagcgtattttctcaaacaatccgtcaactgtcaaggttttgaaagacatggtgctcatgagattaggttggtggatatcgggatggaaagatgagttcccatacaatcctacagacataatgcgcaacccatcatgtctgcaatggtccggtattaaggatgatagcaaggcagatctcgtaatcaaaagctcagtctcatggtgcccccctccctctcagatcatcaaatggaatgtagatgcttcagttcatacttgcagtgcccgctcggcaataggaggtgttttaaggaatcactcgggaaatttcatgtgtttattctcctcgccgatacctttcatggaaattaattgcgcagaaatacttgcgattcatagagccgtgaaaatatcatcagcaaaagaggagttaaaaggtgcaaaaataatcctcgaatctgattcaaagaatgctgtcctttggtgcaacagtgatagtggagggccatggaatctaaacttccaactaaatttcataaggaatactcgcaaagggggccttgacatatcaattgttcatagaagccggagtgcaaatgttgtagcggactccatggccaaacaaggccttcatcgtctatctgaatttattgcatggttgtgagtgtctgcgtggcatgtcagggtgcaaagaaggaagttgcacttcctggctgccctctagtctgtaacatctcatgtaattgtccagttgtctatctctcatgtttggttcaaagtgcaagatgtacttcatagcataggaaaagatgcattttgtatgtgacttaattgtaactcagtaatggatggggactcctctctatcgggtgtgctttagcactataaaaatgtcgcccacctagtgggggaataccttattttgagtagaggcctcatccatttcatttcattttgattacaataataaaatggagaagaaattatcaaaaaaaaatagaattagcatataa

SEQ ID NO: 429 - DNA, 6642 bp, Beta vulgaris
aatattgaaatatcgataagaagattgtgtaaggttaaaaaaatggagagagaaactagagagagaaacggagagagaaacgcagagagaaagcaggaaagagcaatcggagagcatcaatggattgtaattaacagaaggaaacccaaagcttcccaaccttcagcctctagaacatgcttcatcaaccacttaccagtgactttcaccatagctgatatagcaaaaatattcagaacccatggagcaatagccaatgtttgtattccaccaaaccaaaaatatccaaaccataattttgctttcgtccaattttaccactctcaatccctttacacagcaatcagagatgaaaatggaagacaagtagagaaacatcgtatttcagttttcccagccaagcaagacaaattcagaaacaccaaaaatacctacacctatcaacatcaaccaagaagtcaaagcaccaaaccaaaagacaacagaaaagcacaaagatctctgcgggacaatcgctcctataaagaggcgaccttatgcattggctcacctgaagataacagagaagtcaaattcaaccttcagaacaacagctcatacaaaaccactccgcacaaaactcataatccaaccccaaaccctatcccaaacattatcaaacccaaccagtcataccatagattaatgcactcaagggcgttaggagaagaaacagaacaaattcgaaactctttaggggagatcgatgcaaacagtgattatgcagcatccatgaaaggtaacaagtgtgaagagaacgtcgaaatattccaccgcagtgcaatagcagttgcctcatcttctctatcatcagataccatactcaatcacattctttctgaaggggttacttgcctcactatcaaacctatgggaggtatgcaacacctcataatctttgaaacatatgacgataaggaagcgatgatgaatagcaaatggttgctacagtggttcgacgtggtaacaaatgtcaatgatcaaagcgcaacattatggcgaaaaactcggatcaacatctatggagtacctcttattgcatggggatacgaaattttttttaacattggatgtgtgctagggagggtcatatctgttgattatgggaactatgaatgtgcaactgttgacataatcaccgactgcttatttgaagttaattgcaaactgatgatggagatcgatggaaaaaattatgacatttatgtcggtgagacaagacaattcacttgtcaatattccaactccagtcatggaattcaggttacaccggacaaaagtaacaacctaagtcccataatgtcaagtccagaaaagctgaacaattggagtccaaaaccaggaacagatctcattgacaaacaggagaattcccccactgagctgtcacatcaggcacaggttccccttaaagacaatccctgcaaatctccagtcattggtggcggcagcccaatagacactcctacaaaagaggtaactatctcgtcaccaaaggatccacttaatgatttagtaatcaatggagcacctagggaaacctcgcctcgaccacatcaaaagacagcaaataataatgaaacattattcctctctacctctcccacttccctattatcttcagcccccaaacagctgaccccacacagccaacatcaatcacctctcccagaaaataccaaacaaaaatctgtaactttcagccttgggccctctacccaaagaagtccatctctttcagtctcctccagaaaaaaacccatccaaagcccaattcactctcagcccatccgaaacacatccaatgaaccactagccttctctccctcccctcctcttaatatctcaaatagatttcggtcattaataaggcctagcccagtaacatcaaattcatcatctctttctggacctatgtatccaccaggctttgaaaacctcatcccagtaagtaccaaaacagcccacgaaaagaaaagatccagaaaattgttgaagaaaaaattaaaactcattgatcccaagcttcccagaccaaaatcccctcagccaaatgcatctacaaatttctcactggaaatctcttcatcatccaccctggcaattgcaaaaaaattggattttcaattccaagggtctgaacatcagttagaagaacacattgagagaatccttcaaaatcagaaaatcaattggtcaaatgaccaagtttaactggttctcacctctcattccatctagctctcacccaatgattttattatcctggaacataagaggccttggtgcaaaggtcaaaagaagctcaatcaggaagctaattggaaaacatgatcctcacatgattttcattcaagaaaccaaattagaaaaaatctgtccaatgtttatgcgatcaatttggaacgagaataatattggggtttgtttcagcccttcccagggatcctcagggggccttctttctctatggaagaaatgtttctttgaacttgaagaagctaaatatgacaagaattggatcatgctcactggaaaaatcctaacctcgggtttcaaatgctcttttgttaatatatacaatccatgtgatctcaatgaccgtgctcaagtatggctggaattagcgcaattgtgcatctcatcagaatcaccttacctcctcattggcgattttaatgaagtactcgatccatcagacaggggaagtcaaattgtttctactaacggtatacatgcttttaaatcttttgtgcaggtactagaacttattgaaatcactccaacaacaggcaagttcacatggttccgtggccaatctaagagcaaacttgacagaatgttcatccacccccaatggcttgacttatttcccacactccaaatctctcttctcaaacgtacattatctgatcattgcccaatcttggtgcaaacaaaactgaagaattggggcccgcgcccattcagattcattgatgcttggctctcgcaccctggttgtttgaaactaatcagcaaaacatggttagaagcccatgattgttctttctcggaaaaattgaagaaagtgaagtctagcttgttaaaatggaacgcagaggaatttggctgtattgatgaaaaaatccaatctctggaaaacaaaatacaagaaatggatcgtatagctgacgatagaaatttagaggccaatgaacttgaggagaggagaaaatcccaaatggatctatggatatggatgaagcgcaaagaggtattatgggctcaacaatcacgcgttaagtggataaaagagggggatcgaaacactcgatattttcacataatggccacaatgaggagaaagaagaacgccattgaatcactcatcattgaacagaagcagattgactctcctgaagatttgaaggcagcagcagtttcttatttcagtgagttattcacagaagaactatcaccacgaccagtattcggggatttgaattttaaacaattgaatgattcacaccgggaaattctcacatctcagttcactcgcagcgagattgatgaagctgtgtcttcatgtgatgggtctaagtccccaggacctgacggattcaattttaaatttgtcaaacaagcatgggaagttatcaaggaagatgtatatggcatagttaatgaattctggcattcctcccgtcttcctagaggctgtaacactgctcttatagccttaatcccaaaaatcagcaacccggaaggcttcaaagactttagacccattagtatggtggggtgtgtttacaaaataatatccaagatccttgcaaggagacttcaacaagtcatgggctatctagttggaccccatcaatcctccttcatcaaggggaggcaaatcttggatggggccctaattgcaggagaagttattgattcttgcaaaaagaataaaaaagaagccatcatcctcaaactagatttccataaggcgttcgacagtgtatcttgggagtttattgactggaccttgaggcagatgaactttcctaaaaagtggtgcaaatggataaaagcttgtgtaatgtcggcggcggcctcgatattgatcaatggatccccaacaccccctatcaaacttcaccggggcttaaggcagggcgaccctctttcgcccttcctttttgaccttgtcgtggaacctttgaatcttctcataaagaaagcagtgtctttgaagttgtgggacgggattgaaacatgtcgcaatggtcttaggattacccacctacagtatgcagatgacacgatcatattttgtcctccaaaattggaattcttgtcaaatatcaagaaaacattgatcctcttccaattggcctccggattgcaggtaaattttcacaaaagttcactacttggagtgaacgttcatgaaaaccttttgaatgattttgctaagcatctcttgtgtaaggtgggaaaattaccatttacctaccttggccttccaattggaggcaatattactcgtctctctctttgggatccggttatatccaaattagaaaaaaagcttgcatcatggaagagcaaccttctctcaataggtgggagattaaccctcattaaggcgtgcctttctaatcttcccctatattacatgtctttgtttcctatccctaaaggggtacttgggaaaattgttgcaattcaaaggcgattcttgtggagtggtaattcatcaaagaagggcatgcctctcgtctcatgggatcttatagccctccctaagcatcttggggggttagggcttggcaatttacatcacaaaaatactgctctccttttcaaatggatatggaggtttttgaatgaacctcatgccttgtggcgtcaagtagtgcatgggaaatatggtttaaaagactcattcaccacacgtgatttatctctctcctcatatggtggcccgtggaatggaatttgcaacgccattctcaagtccccacaagcgaaaaaacttgcctttcatcaagtaagagtgcagattggtgacggttccaacaccttattctggcatgatgtatgggttggtgcgaaccctctcaaaactgaatgtcctcgccttttcaggctgagtttgcagcaagatgcatatgtttctttgtgcgggttctgggatggcctttgttggcggtggagtttattgtggagcaggcccctgagacaaagagaccttcatgaacaagctactctgttaaatatcatcaatcgagccgtacttcagaaggatggaaaagatcatctgatttgggcgcccagcaaatccgggattttctccgtaaaatctttttctctagagttggctaatatggaagaatccagaagttttgaagcgaccaaagaattatggaagggactagttcccttccgcatcgagatctttgtttggtttgtcatccttggaagactaaacacaaaagaaaagcttctcaatctgaaattaatttcgaatgaagactcttcttgcattttctgctctagttccattgaaagcacaaatcatctttttcttgagtgctcttactccaaagagctttggcactggtggttccaaatatggaacgtagcctgggttctgccttcctccatcaaagaattatttactcattggatccctcctttcaaagggaagttcttcaagaaagtatggatgtcgtgtttcttcatcatactatggacaatctggaaagaaagaaactctcgaatctttcaagagaaaccaaattccaagctgcaattaaaggaactaattcttcttcggttgggttggtggataaagggttggaatgaaccttttccttatagtgccgaggacattgttcgaaatcctctgtgtctgaattggttgactcccgttaagccccaaaaggctattatgccggctccttttccgcagcattggtctcctccaagtattggtagcctaaaatggaatgtcgacgcttccattaaatcatcccttcaaaagtcatctattggaggagttcttcgagaccataagggcaactttatatgtatgttctcgagcccaattcctttcatggaaatcaacaacgctgaagtgcttgctattcatcgggcattgaagatttctgctgcctgccctcggatctggggttcacacatcatagtcgaatctgattcctcaaatgcagtaagttggtgtaaaaaggatgcaagtggtccatggaacctaaactttattctcaacttcatccgtaactcagcatcaaaggatccgaaggtttccatcacgtacaaaggccgtgaaaccaacatggttgctgatgctcttgcaaagcagggattgtcgagatgggatgaattcatagcctggatgtagcttggttctgacccaaaaaactgtaattgcaaataaaatcaattctagagtctgatttcactgatgggccaggcagctatactcaaccatgtaaaagggccgcagactatctgggccattagcttgtagcttgtaacaatatgagggagttcacttcgtttcgaaatgagaaatcaacaaattatcaaaaaaaaaatattgaaata

SEQ ID NO: 430 - DNA, 5582 bp, Beta vulgaris
actaatatactccaactactcccttgaaagacaggtctctctctctctattctcccgatagagcgccctaccttctggttgctctccgttgcggcggcggtcctccttcgccaatggctgaggagatctccgaatttgtttcccaattgcgtatagatgatgaggaggacgcagttctagatattgaatctataaaccctaataatgataataatgttgcgcttctcctcctggggcgtctcttaactgttcgatcctataacgtggaggctttcaaacgtaccatcaccacggtatgggcaccgaagcatggactggttattagggttttaaaaccaaatcttttcgcttttcagttttttcattggagggatatgatgaaggttcttgacggacgtccgtggtgttttgacaatactctcattttgttaaaagaagcggagggtgatgaacagccggaccaggtaagcttgaatcattctcctttttggattcgtttaaagaatttgtcgttgaatcatcgttcgaatgatgtagttaaagccctaattggcaatatgggtgagattcttgatatagaggaggatgtgttagggtttggtagataccgtagggttaaagtgatgcttgatgtctccaagcccttgagaagatacaggaaaatccgagataagagaggtagggagttacaaattgattttgcatatgaaagactaccatttttctgtttggcttgtggtgttatgggccattcggagaaagattgccaggtagtgttggaggaagacaaatgtgagaagcttggttggcatttgggtttaaaagctaccccaaggaaggggagatctaaggaggttgaagaggaagtcaagtttcgaaactgtaagaaggtgctctttaatgagggtaataggggtgtgcatggggagagtgaaaccactggacaggctctcattaaaagtcctgatctgcatgggaaggttttgtctgcagaccaatcattaccaaagcatggtactgctgagaatactcaagaattgggggacccggtttttgatttggtgggtgaaataaatgtagaggatggacttcatgccccctctgccaagtacaacaaggcggcttttaatattgatgtgcaagtcaacccttgcaataatgagggaaagggtgcgaatcttaaaggtcagtctggtgatggttttgttttctcgagttccaaggagacatcagaagggaaagctcgagcttggaaaaggctagctagaggtaaaatggaggataaaggggtaccacaacaaatggatatggattctctcgagaaatttctcaaacgagctactgaccagtgtgatatggtgaatgattctcatgacggtgctacgaagcggttcaagctaagcccatcctgtgaagttaatcccattttttcggcggagattggtgctacccaatcccgccaatcattatgaatattttgtgttggaactgccgagggttgggcaacccttggtcagttcgtcagctccgaagttggagtaatcaatttgcccccgatattatttttgtatcggagaccatgattaataaaatcgaagttgaggctttgaaaagttggttggggttttctaatgcattcggtgttgctagtgttggtcgtgctggtggcttgtgtctatactggaaagaggaagttatgttttctcttgtttccttttctcaacaccatatctgtggagatgtggaagacggaaataaaaaatggaggtttgtaggtgtttatgggtgggcgaaggaggaagaaaaacatcttacttggtccttattgcgtcatctatgcgaggatacttctctacctattcttttgggtggggattttaatgaaatactaagtgctgcagagaaggagggaggagctaatcgtgttcgaagagagatgataaattttcgggacactcttgatactcttgcacttcgggacttaggctacgtagggacttggtacacttgggagcgtggtcggtccccttcgacctgcatccgagagcgtctggaccggtatttgtgctctaactcatggttggacctttacccagattctgtccctgaacacaccatccggtataaatcggatcactcagctattgttcttcgctctcaaagagctggcagacctaggggtaaaactcgtagacttcatttcgaaactagctggcttcttgatgatgaatgcgaagctgtggttcgcgagtcgtgggagaattctgagggtgaggttatgacgggacgagtagcaagtatgggccaatgtttggtgcggtggagtactaaaaaattcaaaaatctgagtaaacaaattgaaacggcagagaaggctttaagtgtggcccagaataatcccatttccgaatctgcttgtcaggagtgtgtgctgttggagaaaaaacttgatgagctgcatgctaaacacgaagcgtattggtatttgagatctcgtgtggccgaggtcaaggatggagacaaaaacacaaaatattttcatcataaagcttcacaaaggaagaaaagaaattttgtgaaagggttatttgatggtttgggaacttggcgtgaggaagctgatcacattgaaaatattttcacaagttacttcagttcgattttcacttcatcgaacccatcggatttgagcttggaggctgttatgtctgtcattgagcctgttgttacggaggaacataatctgaagctccttgaacctttttcaaaggatgaaattcttgcagctctacaacaaatgcatccttgtaaagcgcctggtcccgatggtatgcatgttattttttaccagcgtttttggcatattgttggtgatgatgtcacaagttttattagtaatattttacatggtcattcctcccctagctgtgtcaataatactaatattgctttgatccctaaagttaaaaatccaactaaagctgcagagtttcgccccattgccctctgtaatgtactttataagttgatgtcaaaggctattgtgatgagattaaaaagttttctccctgagatcatttctgaaaatcaaagtgccttcgttcctggtagactcattactgataatgctcttatagctatggaggtttttcactctatgaagaacagaaatcgaagcagaaaaggcacaattgcaatgaagcttgatatgagtaaagcctatgacagggtggagtggggttttcttagaaagttgcttctcacaatgggttttgatgggagatgggtgaatctgattatggaatttgtctcttctgttacttattctttcattatcaatggaagtgtgtgtggttctgttgttccggcccgtggtcttcgtcagggagaccccctttctccttatctgtttattatggttgctgatgctttttctaaaatgattcagaggaaagtccaggataaacagctccatggtgctaaagcgagtcgtagtggtccagaaatctctcaccttttctttgcagatgacagtttactcttcactagagctaaccgacaggaatgcactattattgttgatatactcaaccagtatgagcttgcatccgggcagaaaattaactacgagaagtcggaagtctcttacagtagaggagtcagtgtctctcagaaggatgagttgacaaacattctgaacatgaggcaagttgataggcatgagaagtatcttggtatcccctctatctctggaagatcaaagaaagctatttttgattctttgattgatagaatttggaagaaactccaaggttggaaggagaaacttttatctcgagctggtaaggaggtgttactgaaatctgttattcaggctattcccacttatcttatgggagtctataaatttcctgtgttcataatccaaaagattcagtcggctatggcaaggttttggtggggtagttcggacactcaaaggaaaattcactggaagaattgggattcgatgtgtaatttgaagtgttttggcggtatgggttttaaagacctaacaattttcaatgatgcattgttagggcgacaggcatggagacttacccgagagccacaatctctgcttggtcgtgtgatgaaggccaaatattttcccaattgtgattttttgaatgctccacttggtcattctagcagttattcatggagtagcatttggagttcgaaagctcttctgaaggaaggagtgatttggagagttggtaatgggtcccaaataaatatgtggtctgatccatgggtgcttgatgaaggcggccgatttcttactagtacaccccatgcaagtattagatgggtcagcgaattgattgactttgatcgtatggaatggaagacttctttgcttgaaagttttttgaatgagagagatttacggtgcattctagcttcgcctcttagtgcgactccggttccagatgaattgacgtgggcttttacgaaagatgctacctattcggtgaagaccgcgtatatgatcggtaaaggaggaaatcttgataattttcatcaagcttgggtggacatttggagtttggatgtgagtcccaaggtaagacacttcctttggcgtctttgtacaacctcccttcctgtccgtagtcttctcaagcatcgtcatttgactgatgatgatttatgcccatggggctgtggtgaaattgagacccaacgccatgcgatctttgattgtccgaaaatgagggacctttggcttgatagtggctgccaaaatttgtgcagcagagatgcttcgatgtccatgtgcgatctcctggttagttggcgttcattggatggtaaactgaggattaaaggtgcctacttagcctggtgtatatggggtgagaggaatgctaagatttttaataacaaaactactcccagctctgttcttatgcagcgtgtctcacgcttggtggaggagaatggttcgcatgctcgtcggatttatcaacctctcgtacctcgtcgcacaggtagtccaagacaatggattgccccacctgctgattctataaagttgaatgttgatgcgagcttagcggttgacggctgggttggtctaagtgtaatagctcgacgctctgatgggggagttctctttgccgctgttcgaagagtgagagcctactgggctccagagattgctgaggccaaggctgtcgaactggcagttaagttggggcggaggtatgggctgcaacgagttattttggagtcggattgccaagttgtgatcaaccggttatcgaagaatgccatatttctttcggatttggatttagtactttttaatatcttagcttcttgcacttatttttcatctgttgtgtggtcacatgttaaacgtgacgggaattatgtagctcatcatttggcaaagctcatcccttttggggtggaacaagtttgggagaaccattttcctccggaagtggctccctatgtgttgatggacaatttgtccttggagtaatatagctacttttccccctcaaaaaaaaaaaaactaatatactcca

SEQ ID NO: 431 - DNA, 5652 bp, Beta vulgaris
aatcattctagatgattaaaataagtctctctctggcgttcgtctagggtttgagttccagtcctgggtttccattaattttactcgaattttcgatctgtgtgatcccatcttgggattggtgtcagtcatcatggctgacgagattattctcaaagtttctgcaatgaaattgacggcggaggaggacaaaaccttagcttttgatgatatttccgataccgcgaacaatcaagattttaccctatctctgattggcaaagtcgtaacagttcgatctttcaactttgatgctcttaaacgtactctcaatcagatatggtcgatttcgaagggggctatttttcgaatcatagaaaatgacttgtttgtggtccagtttgcttgtaagcgtgacaaagagaaggttatggcaggaaggccatggtcttttgatcaaagcctggtgttattgcaagaaatcgatgctgatgttcaaccctcaaacgtacgcctgacgcattcgccgttctgggtccgagtttacaatttgccaatgcgatgtcggtcggaacaacacattcgaatgataggagggtgtattggggatgttcttgaagttgatacgcatgaaatattatgggataagtcggcgcgtatccgtgtgcttattgatattacaaaaccacttcggagagtgcagcgttttgctttgaaaaacggtgtttcggcattggtggagatcaagtacgagcgtctccctacattttgttttctgtgtggtgtgataggccacataggccgtgattgcgtggaagttttcgaggaggataaagagggtgaaagccaatggggtgcgtggcttcgagcatcccctagaagaggtaggcagaagatggaagaggaggagaaatgtttcttgaagggtgctcgtgcattagagtttgtgaggatagaaaaggaacctacgagtaggaatatgcataatgatctgaggaatgtggagcatgattgtccacctacgaaaccaatggaggctcacgtttcgggggcgatggaatccattgctggagctaaactcgctgctgccgagtttgaggaaccccatgcggttgcggttcatgctgctgtcccggaacctattggtggcgtgggtttggtgtcgattccgtctatcatggtgtcctctttggatgttgataaatccttttcaggtgactttaacaaccaaaataataatatgttttcttttgtagctggggaggggaaggttgccacaaagtttaaaaaacttaaacaaaaatctcgtttgactaaagttgctggggaggcttttattgatattaataatgtgagtccatgccatattgagtctggtggtaaggcaggggataaaagaaagatggttgataatatgattgtggatgatattaatgattctgataacttgagttccaagaaacataaactaaatgatttttcggaaaatgacaataatgttgatattgttgaggcggaggttggttgtaaccaaccccgccaggcattatgaaaatcttgtgttggaactgtcagggtatgggtaacccttggacagttcgtcagttgagaaggcttatggcttctaatacccccgacagtctttttatgtcggaaacaaaggttactaaaaatattgttgagcagaaaaaggagagcctcggattttccggggcctttggtgtgtcgtgtgtagggagagctggaggtttatgtatgttttggaaggaagagacgatctcttttaggatggtgtccttctcccaaaatcatatttgtggtgatgtggggagtaatggggatgtgcgctggaggtttgtgggcatttatggatggccggaggaggagaataaacacaaaacttgggctttgataaaagggttgtgtgatgaatacgagggccctatagtctttgggggtgattttaatgaaattttgagttatgacgagaaggaagggggtgcatcgagggagcggagagctattgtggggttccgtaatgtgatggatgactgtagcctgggagatttgcggtttgtgggtcagtggcacacctgggagagagggaggagtccggaatctcgaattagggaacgtttagatcggtttattgtctcgcggtcttggttgcatttatttccagaggcttttattgatcatcaggtgcgttactgttcggatcatgctgctattgtattacgttgtttgggtaatgaggggatgccgcgaagaagggctggtgggttttggttcgagaccttttggctacttgatgatacttgtgaggaggtggtgcggggggcatggaatgcagcagagggtggtagaatttgtgaaaaattaggggctgttgcgagggagttgcagggatggagtaaaaagacttttgggtctcttcgaaagaaaattgaagcagtggagaaaaagttacatgcagcccagggtgaagctacttcgattgacagctgggagaggtgtgtgggtttggagagggagttggatgaattacatgctaagaacgaggcttactggtacttgagatcgcgagtggcggaagtgaaggatggggatagaaatacttcatattttcaccataaagcttctcaaaggaaaaaacggaaccttattcatggcatttttgatggtggtgggaggtggcaaacggaaggtgaggagattgagtgtgtggtggaacgctattttcaggagatattcacgtcttccgagccttcttctaatgattttcaggaggtattgcagcatgtgaagaggtctgtgacacaggagtataacgacattcttttgaagccctactcaaaagaggagatttttgcagctttgagtgatatgcacccttgcaaagcccccgggcctgatggtatgcatgctatcttttatcagagattctggcatataattggtgatgaggtgtttaattttgtaagcagcattttacataactattcttgcccagggaatgtcaattgtactaatattgctcttattcccaaagttaaatcccctactgttgtttctgagtttaggcctatcagtttatgcaatgtattgtacaaaatagcttctaaagctattgttttgcggcttaaacgattccttccctgtattgcaacggagaatcaaagtgcgtttgtccctggaagactgatttcagataattctcttattgctctggagatctttcatactatgaagaagaggaataatagcaggaaaggattgatggcgatgaaacttgacatgagtaaagcctatgacagagtggagtggggttttcttaggaagctactattgacaatgggatttgatggacgatgggtaaatttggttatgagttgtgttgctactgtttcatattccttcattattaatggacgagtatgtggttctgtgactccctccagaggattacgccagggtgatcctttatctccgttcctatttatcttggttgcagatgctttttcccagatggttaaacaaaaggtggtttcgaaagaaattcatggtgcgaaagcaagccggaatggtccagaaatttctcaccttctttttgcagatgacagtcttctctttaccagggctacccgacaggagtgcttgacaatagttgatatcctcaacaaatacgaagcagcatccgggcagaaaattaattatgaaaagtcggaagtttcctttagtagaggtgtaagctgtgagaaaaaagaagaattgattactctcctccatatgaggcaagttgatagacaccagaagtatcttggtattccagctctttgtgggaggtctaagaaagtactttttcgggaactcttagatagaatgtggaagaagttaagggggtggaaagaaaagttattgtcgcgtgctgggaaagaggttcttatcaaggctgttatccaagccttgcctacctatctgatgggagtttataagcttcctgttgctgtcatacaagaaattcactctgctatggctagattttggtggggagggaagggggatgaacggaaaatgcattggctaagttgggagaaaatgtgcaaacccaagtgtatgggaggcatgggatttaaggatcttgcggttttcaatgatgctttattgggtaaacaagtttggcgattgttacataataaggagtcccttttgagcagggtaatgagtgccaaatattatccacatggtgatgtgcgttacgcacggctaggatactcgcatagctactcgtggcgaagtatttggggcgcgaagagtttggttttggaggggttgatttggagggttggagatggtacgaaaattgacatatggagtgcaccatgggtaggggatgaagaaggtagattcatcaagagtgctcgagtggaaggactagaagtggtgggagacttaatggatgttgaaaggaaggagtggaatgtggagcttattgagcgtcatttcaatgaacgagatcaacaatgtatactggccattcctttaagcactagatgtctacaggatgaattaacttgggcatattctaaggacggcacttattcggtgaaaacagcttatatgttgggaaaagggggaaacctggatgattttcatagagtgtggaatattttatggagtttaaatgtgtcaccaaaggtacgtcatttcctgtggcgtgcgtgcacaagttcgctcccagtaaggaaagtgcttcagagacgccacctcatcgacgaagcagggtgcccatgttgtgctagagaggatgaaacgcaatttcacttattttaccgatgcccgatgtcgctcaagttgtgggaagagctgggtagttatatattattgccagggattgaagatgaagctatgtgtgataccctcgtcagatggagtcagatggatgcaaaggtggttcaaaagggttgttatatcctgtggaacgtttgggttgaaaggaacaggagagtctttgagcatacaagtcagcctgctactgtggtgggccagagaattatgagacaagttgaagattttaacaactatgctgtgaagatttatggaggaatgcgttcctccgcggctctgagcccaagccgatggtatgcccctccagttggcgctattaaattgaacacagatgcaagtttggctgaggaaggatgggtgggacttggagtgatagcccgcgactcggaaggtaaggtgtgcttcgctgcaaccagacgtgtgcgtgcctactggcctcccgaggtagctgaatgcaaggccatttacatggcaactcgtttggcccaagctcatgggtatggggatgtgatttttgaatccgactctttggtagcaacgaagaggttaacgaaagctgcaattttcttctcagatttggatgcaatacttggggacattctttctatgtgtaatgcattttcttctgtttctttctctcatgttaaaagggatgggaatactgttgcccataaccttgctagagttgtgccttttggtgttgaacaatgttgggagcatcactgtcctagttctgtaacaccctatgtacttatggacactttgtccctttgattaatgcacttctctttcccctcaaaaaaaaaaatcattctagatgattaa

SEQ ID NO: 432 - DNA, 5549 bp, Beta vulgaris
aactactaataacattatgttcaacaatatatttgagaaactcccttgcaagacaggaaatcctctctacccccgatagagatccctaccctctggtcccgctccgctgcggcggccgccctcctcagccatggccgaggagatcttaaactccgtatcgaaccttcgcatagatgatgaagaggagcaagtcattgacattgtttctctgaaccctaataatgaaaacaatgtttctcttctgctaatagggaaactgttaactgaacgctcctacaatattgatgccttcaaaagaacgatcactactgtctgggcgcctcagcatgggcttgttattcgcaccttaaaaccaaatttgtttgctttccagttttatcactggcgggatatgtcaaaggttatggatgggcgaccttggtgctttgacaatatgttggtgctactcaaagaggccgacggtgatgaacaaccggaccaggtatgtcttaaccattccccgttctggattcgccttaaaaacctcccctttaatatgagatctaatgacgttgttaaagccctaattggtaacttgggtgaaattcttgacattgaagaagatgtgcttggtattggtagatataggcgtgttaaagttctgcttgatgtttccaaacccctgcgccgataccgtaaacttagagacaaatcagggaaagacttgcaagttgattttgcttatgaacgtttgccatttttctgtttagcttgtggtattatgggccatgctgagaaagattgccagtttgttttggatgaagataagtgtgagaagttgggttggaatctgagtctcaaagctaccccaagaaagggtcgaaataaagagatggaggaagaactgaaattcaagcactgtaaaaaaaatttgtttgataagccttctgaattagtgaagcaagggagtttgcttataaaggaacatgtgatttcacctgacacaaaccccataaaagccattaattctccgcaattttccaataatggtgggaatttaatggcggctgccagtgctgtctcaatcagcacgattccccaaaaaacttgttcccctgccccccagcttgtggacccccctgtttgtgacacgccacctacccccactttttgtccccactctcaaattgtccccccttttgtctttaccagtataaaagagcccattgtgagtaaacataaagcttggaagaggttggcccgcgggcccatgattgataaaggagatgtttcctttatggagatggaccatgatcttataaccacaaagaggccccatgattctgatttcgatggtgaattgattgcggataccactgtgaagcgcctgaagctaagtgtatctcatgatgttgctcctgtttttccggcggaggttggtgatgaccaaccccgccaagcattatgaatatcttgtgttggaactgccggggggtgggtaatcctcggacagttcgtcagctccggaagtggagcactttctatgcccccgacattatgtttttgtcggaaaccatgataaataaaactgaatctgaagctttgaagagtagattgggttttgcgaatgcttttggtgtttcgagtcgtggtcgtgcaggtggtctctgtgtgttttggagggaggagctctctttctctcttgtttctttctcacagcatcatatatgtggggatattgatgatggggcgaaaaaatggagatttgttgggatttacggttgggctaaggaggaggaaaaacaccatacttggtcacttatgcggtttctttgtgaggatttgtctcgtcctatacttatgggtggtgatttcaatgaaataatgagttatgaggaaaaagaaggtggtgctgacagagttcgcaggggaatgtatcaatttcgtgagactatggacgatttgtttcttcgagatcttggttataatggagtgtggcatacttgggagcggggcaattcactatcaacttgtattcgggaaagattggatcgttttgtttgctctccttcttgggctaccatgtatccaaacactattgtagatcactctatgagatacaagtccgatcatttggctatatgtcttcggtcaaaccgtacccgtaggccaaccagtaagcagcgccggtttttctttgaaacaagttggttacttgatccaacctgtgaagaaacgattcgggatgcttggactgattcggctggtgactccctaacaggtcgtttggatcttctagcccttaaactgaagtcttggagttcggaaaaaggtggtaacattgggaaacagctgggccgtgtggaatctgatttgtgccgcctccaacagcagcccatttccagcgccaactgtgaggcgcgccttacccttgaaaagaagcttgatgagcttcatgcaaaacaagaggcccgctggtatctgcgttctagagcaatggaggttagagatggtgatcgtaataccaaatattttcatcataaagcttcgcaaagaaagaaaagaaattttgtaaaaggcttatttgatgctagtggtacttggtgtgaggaggttgatgatattgaatgtgtttttactgattatttcacgtctatttttacttctactaacccctcagatgtgcagttaaatgatgttctttgttgtgtggacccagttgttactgaggagtgtaatacttggctgttaaagcctttttcgaaggaggaactttatgtggccctttctcaaatgcacccgtgtaaagctcctggtccggatggcatgcatgctatcttctatcagaagttttggcatattattggcgatgatgtgacacaatttgtgagtagcatcctccatggttctatttcccccagctgtattaatcacactaatatagctctgattccgaaggttaaaaatcccactactccggccgagtttcgccctattgctctttgtaatgttgtatacaagttggtttcgaaagctcttgtcatccggttgaaagatttcctcccccgtttggtttctgaaaaccagagtgcttttgttcctgggcgtctcattactgataatgccctcattgctatggaagtctttcattctatgaagcatcgaaatcgcagtcgtaagggtaccattgctatgaaacttgacatgagcaaggcttatgatagagtggagtggggctttttgaggaagttacttctcactatgggttttgatgggagatgggtaaatctgatcatgtcctgtgtttcctctgtttcctattccttcattatcaatggaggggtatgtggttctgttactcccgctagaggattacgccacggtgaccccctctctccatatttgtttattctgattgctgatgctttttcgaaaatgattcagaagaaagttcaggaaaagcaacttcatggagcaaaggctagccgcagtggccctgtgatttctcatcttttctttgcagatgttagtttactctttactcgagcctcccgtcaggaatgcgctattatagttgagatcctcaacctctatgaacaagcatccgggcagaaaattaactacgacaaatcggaggtctctttcagtaaaggtgtcagtattgctcagaaggaagagttatctaatattcttcagatgaaacaggttgaaagacatatgaagtatcttggtatcccctctatcactggtagatcaagaacagcgatttttgattctcttatggatagaatttggaagaaactccaaggctggaaggagaaactgttatctcgtgccgggaaagagatcttgctcaagtcagtgattcaggccatccccacctatcttatgggggtttacaagcttccatgctctatcatccagaaaattcactctgctatggctcgcttttggtggggtagctctgatactcaacgcaggattcattggaagaattgggactctttatgcacactgaaatgctttggtggtatgggctttagagaccttagagtattcaacgatgctctcttggggcgacaagcatggaggctggtccgtgagcctcactcacttcttgcgcgagttatgaaagctaagtattattccaaccatgactttttagatgccccccttggagtctctactagttattcgtggcgcagcatttggagttcgaaggctctgttaaaagaaggcatggtgtggcgaattggcaatggcacgaatgttcgaatttgggaggatccttgggtacttgacgaattgggtcgcttcatcactagtgaaaagcacgggaatttgaatatggttagtgaactcattgattttgatcgaatggagtggaaggtgtctctaattgaaacagtttttaatgaaagagatatcaaatgtatcttgagtattcccctcagttctctcccattgaaagatgaattgacgtgggctttcacaaaaaatgctcattattcggtaaaaacggcttatatgcttggtaaaggcggcaatctcgattcttttcaccaagcctggattgatatttggagtatggaggtaagcccgaaggttaaacattttctttggcgtttaggcactaataccttgccggttcgaagcttactaaaacaccgacatatgcttgatgatgatttgtgcccacgcggctgtggtgaaccggaatcgcaattccatgcgatctttggctgccctttcattcgcgacctatgggtggacagtgggtgtgataatttccgtgccttaactactgatacagctatgaccgaagccctggtgaattctcacggtttggatgctagtgttcgtaccaaaggagcctttatggcttgggttctatggagtgaaaggaactcgatcgtcttcaatcagtcctcaacacctcctcatattttgcttgcacgtgtgtctcgtttggtggaagaacatggcacctacactgccagaatctatcctaatcgcaactgttgtgcgatccccagcgctcgtgtatgggctgctcctccgccggaagtcattaaattgaatgtggatgcgtccttagcctctgctggttgggtgggtttgagtgttattgctcgtgattcccatggcactgttctctttgctgcggtccgcaaggttcgagctcaatggtccgcggaaattgctgaggctaaggctattgaaatggcccttcggttgggtaggcgttatgggtttgccgcgatcattgtggagtctgactgtcaagttgtggttaatcgcctctcgaagcaagccctttatcttgctgatctggatattattcttcacaatattttttcttcttgtattaattttccctctgttttgtggtctcatgtgaagcgtgatgcaaactctgttgctcaccatctagctaagctaacccctttcgggattgaacaaatttgggagaaccatgttcctccggaagtggctccatatgtgttgatggacaatttgtccttaaattaatgttagctggcttttcccctcaaaaaaaaaaactacta

SEQ ID NO: 433 - DNA, 5738 bp, Beta vulgaris
aaactgcttatcacttgagcatttagttagaattaccaattctttatttttagtccccttctctctctaggagttagggcataaacccagcgagtctggcgattgtcgccgtgtaattcggccggctacaatcgattatggcagacgagttagtcgaaagttgcaggcggctgagaatagtggaggaggagaacgaagtggtggatttgggggcggtagagtcaacaaatctgacggcgaagacgtcactgatgctggtggggaaggtgctttcgacgcgggcggtgaatctcgacgctcttaaacgggtaatgactcagatttggagcctgaatagtaatatggtggtgcgggcaattgattccaattcttttatctttcaattctttcattggaaggataaagccaagattttggatggacgcccatggttgtttgatcaaaaacttttggtgattgatgaaattctaggcgatacacaaccgtcggatgtggtactggagacgtcacctttctgggtgcgaatttacaatctacccttcaattgtcgatcggatacggaggtgcgtgccattgctggtggccttggcccagttttggaggtggacattgatgactttggccttgaacgattttgtagagtgaaggtggaattgaatatctttaaacctttgcgcaggagacagcgtattagacgcaaggatggagctgttgctagtattgactataagtatgaaagacttccccatttttgctttcgttgtggggtgcttggccatggtgataaggattgcaatgcggaggtgccggaggagtgggagaaggagatgggatggggtcagtggctgaaggcttcaccgtataagggaagggggaaacacaaagaagaaacgggggccattaaagagaggaggagggtgctttttgtttgtaaggaagaaggtgattttcaaggggagaaaaatactcagcttggtaatagaggggaggggatttatgcagggaggagacaaagttcttgtgctgttgcagagatagggaaagggataaatgtggagcagctagtggatttggggaatgagaattatgctatggagcttaggacggagggggacaagtctattaatgaggaggttggtgcaactcacatcataaatgctgctggtgatgtgtcagagggggacaagcctattaataatgatattggtgtcccccactttgttaatgttgctgatgttgtgactattcccgaggaccaacacaatctctcctttcaggttggtacttgctcaaagtcatttaataattccaaattgtcaaaaaagaaacgcccccctaataaggggtctgtgactaatctgactaaaagtacccctatggactgtaatcatgttattctccctgctgtattggacactggaccttctgatgttgactttttggatgtgaactttatggggaaacgaaaatgtgctgacttccctatggatactatgctggacttgagtacaggacggaaaaaatcgaaaattgaactaaatctggatcaaaatatgattcaagtagcggaggttggtgttgcccaaccccgcgaagagcaatgaaactactaagctggaactgtcagggtttggccaacccttggacagttaatgctcttcattctctttgctggagagataggccaaacattgttttcgtgatggaaacaatggtggattctcaggtgttagaaaaaattcgtaaacgatgtgggtttatgaatgggttgtgtttgagtagtaatggaaattcgggtggcatgggtctgtggtggaatgagatggatgtaactgtggagtctttctctgctcatcatattcatgcagtggttttggatgaaaataaaaatcccatctggaatgctatggggatttatggatggccagaaacgtcaaataaacatttaacttggagtcttctgagacgattgaaacaacaatgctctttacccgtacttttctttggggactttaatgagataacgagtatcgaggagaaggagggcggtgcccctcgttgtgagcgtgtgatggatgcatttagggaggtgattgatgattgtgctgtgaaagacttggggtacgttgggaatcggtttacttggcaaagaggtaactccccctccacactcattcgggagcgacttgatcggatgctagcaaatgatgagtggtgtgataattttccttcttgggaggtagtgcacttgcctcgataccgatccgatcatgctcctttgctgctgaaaacgggtgttaatgactcatttcgtcggggaaataaactttttaaattcgaggcgatgtggttatcgaaggaggaatgtgggaaaattgttgaggaagcatggaatggttcggctggggaggacattactaacaggttggatgaggtgtctcgtagcttatccacgtgggcaacgaaaactttcggcaaccttaaaaagcgaaaaaaggaggccctaacgctccttaatggcctccaacagcgtgatcctgatgcctctacattggagcagtgtcgcatagtgtctggtgatttggatgaaattcataggttggaagagtcctactggcatgctcgtgcaagggctaatgagattcgtgatggtgataaaaacacgaaatacttccaccacaaagcgagccagcgcaaacgacgaaacaccattaatgagctactggatgagaacggtgtttggaagaagggccgcgaggaaatatgtggggttgtgcaacattattttgaggggttatttgctactgacagccctgttaacatggagttggctctggaggggttgtcccattgtgtttcgacggatatgaatacggctctgctgatgttgccgtctggggatgaagttaaggaggcactctttgctatgcaccctaacaaggcgccaggtatagatgggttacatgctttgttttttcagaaattttggcacattttgggctcggatgtcatttcttttgttcagagttggtggcgggggatgggggaccttggggttgtgaataaaacatgtattgtgttgattcccaaatgtgatcatcctcagtctatgaaagattttcgccctattagcctttgtactgtgctctataagattctatcgaagaccctagcgaatagattaaaggtcattctacctgcaatcatctcgccaaatcaaagtgcttttgttcctaggcgcttaattaccgacaatgctcttgtggcgtttgagatttttcatgcaatgaagcgaaaggatgcaaataaaaacggggtgtgtgctttaaagttggacatgagcaaagcgtatgatcgagttgaatggtgttttctggagagagttatgaagaaaatgggattctgtgatgggtggattgatagagtgatggcgtgtatatccagtgtctctttcacgttcaacgtgaatggtgtggttgagggttctctttcgccctccagaggtctgcgtcaaggtgatccgatttctccctacttattcctattatgtgctgacgctttctctactcttctatcaaaagcagcaagtgaaaagaagattcatggggcgcagatttgcagaggggctccagtggtgtctcacttgttttttgcggatgatagcattctttttactaaagcctctgtgcaagaatgctctatggtggctgatattatcagtaaatacgagagagcatcgggacagcaagtcaacttaagcaaaacggaggttgtttttagtagaagtgtggatagagagcgtcgatctgccattgtgaatgtgcttggggtgaaggaggttgatagacaagagaagtacttgggacttcctaccattattgggaggtcaaagaaggtgacgtttgcttgtattaaggagcgcatatggaagaagctgcaagggtggaaagagaaattgctatcccgacccgggaaagaggtgctcattaaatcagtggcgcaagctattcccacatatatgatgagtgtattcagcctccctagcgggttgattgatgagatccattcgttgctggctcgattttggtgggggtcctctgacactaataggaagatgcattggcatagctgggatacgttgtgctatcccaaatcgatgggcggtcttggctttagggacctacattgcttcaatcaatctcttcttgcaaagcaagcttggcggttatgtacgggggaccagactcttctatatcggctgttgcaagcacgatactttaagtcttcggaattgctggaggcgcgacgagggtataatccgagttttacatggcgtagtatatggggatcaaagtcactgttattggaggggcttaagtggtgtgttggctcgggggaaaggattcgcgtatgggaagatgcgtggattcttggtgagggagctcacatggtcccaacgccgcaagcggatagcaatttggatttaaaggtatgtgatttaattgatgtggcaaggggtgcgtggaatattgagtcggtacaacagacgtttgtggaagaagaatgggagttggtgttgagtattcccctctctcgatttttgcctgatgatcatcgctactggtggccctctcgcaatggaattttctcggtccgctcatgctattggctgggacgtttgggtcctgttcgcacatggcagctacaacatggggagagagaaacggagctgtggcgtcgagtatggcagctccaaggccctccgaaattaagccatttcctatggcgtgcgtgtaagggaagtttagcggtgaagggacgcctattctcacgtcatatcagtgtggatgctacttgctcggtttgcggtgacccggatgagtccataaaccatgctttatttgattgcacatttgcacgggctatatggcaggttagtggttttgcttctctcatgatgaacgccccactttcttctttctcggagaggcttgaatggctcgcaaaacatgcaactaaggaggagtttcgaactatgtgctccttcatgtgggctgggtggttttgtcgaaataagctgatttttgagaatgagctttctgatgctccgttggtggcaaagcggttttcgaagctggtggcggattattgtgagtacgcgggcagtgtgtttcgtgggtcagggggtggatgtgggtcttcggctttgtggtctcctccacctacaggtatgttcaaggtaaattttgatgctcacctaagtcctaatggtgaagtgggcttaggagtcgtgatccgtgccaatgatgggggtatcaaaatgctgggtgtgaaacgagtggctgcccggtggactgctgtcatggcggaagcaatggcggcgttatttgcagtggaagtcgcgcacaggcttggttttgggcggattgtgttggagggtgatgctatgatggttattaatgcggtgaagcacaagtgcgagggagttgctcctatgttcagaatttttaatgatattagttctcttggtgcgtgtttggatgtttttagtgtatctcatgttagacgagcgggcaatactgtcgcccacctgttagctcgttggtgctgtgattgtaattctgagattgtttggctggactctttcccccaaagtatttctactttggcggaacttgatttgatttaatataaactcttctgcttttcccctcaaaaaaactgcttatcacttgagc

SEQ ID NO: 434 - DNA, 5691 bp, Beta vulgaris
gactcgcattttttatcctttcctgcaaaaaaaatccctacttagagttccctctaggtttccttgggagggtttgctagtctcgatactagggttcctcgaaggaggggattgtggcgattcgtttggggattcccaatcatatgataatcatggcatctgacattattgtttctagcgagttaactgtgacggataaggaaaatacgatggaagaaaaagacaaaaaacatgggaagttgacgtcggagaaggatgttaatacagattctgaaccggtggaatgggaggaggacggtgcggaggaggatgaggccagaacggagttagggcttgttattcgaatctgtacaaaccggcatgttaatcaaaatgccttcaccaccaccatgaagaatatatggcaggcgaaacatgatatggatataaaaaatatcgggaaaaatttatatgtagttcaattctatcattggagggataaacaccgcgtgatggagggacaaccatggcacttcgataagcatgttattctgatgagcgacattaaaggtaactgtaaaccctctgatattcaattatgggaattcccgatctgggctagggtttatgatctaccttttaaagggcggttaaatataaataatgtaaaggcaattgggaataaaataggttcgttcattacaatggacaaatctggagccatgggaatcgataaatcaattcgaattagggttatgcatgatgttcgaaaaccgctctcttcttcaataaaggtgcgcatgaaatctggcgaggaggacatttttaccgtcaaatatgaaaggccccctttattttgtttctactgtggaaaagttggacatgggactaaagattgtgaggaggatgatgctgaagataaaggagtagtgaaatatggggggtggattaaagcgtcgccatggaaagtggctgacgcgggagagaagggaggaggcagggctaatgagagctcgtgtgctagaactttattcattaccaaaccgaaaaaacctgtaggtgtggagaagaaggaatctatgtcggcagtggtggagaaactcactagctgtgtgcttcaagagaaagctattgagcagggcgttgacactgactatatttcgaatgaccggatgatgcctagtggggtgaacatgataatggaagatgctgtagcaaattgtggggaggaagtaatcgagcagaatgagagcaataagagcaaagagggtatgagtagtaattgtgtggcgcaaagtagaagcaaggctgggaaggatgtgaaaaagtggaagaaagtggctaggcagcgagataaggtggataatggtgtccctaatatagtgggagttaaacgaaatgagagagacggaggctgtgtaggattagataatgtggaaatagaggagttacgttacttgaagagagtgggattaagtgtgcaagatgatgtaagtttgacaactatctctactgaaaataaagtggcgagccccacgacttgggctctcggtgataaatgaatcacatcctctcatggaattgtagagggatggggagcccctctgcattaagtgcactgaggcgtttgcttgcttcagaaaatccccaaattgtcttcttatcagagacaaagctaaagagttacgaaatggagagtgtgaagaaaaaattaaaatgggaacacatggtggctgtagactgtgaaggtgagtgtagaaagagacggggtggtcttgcgatgttatggaggagtgaaatcaaagtgcaggttatgtccatgtcctcaaatcatatagatattgttgttggagaggaagctcagggtgaatggagattcacgggcatttacgggtacccggaggaggaacataaagacaaaacaggggcattgctttcggctctggcccgcgcctcgaggaggccgtggttgtgtgggggtgatttcaatctcatgttggtggcaagtgagaagaaagggggggatgggtttaatagtagagaagctgatattttccggaatgctatggaggagtgtcattttatggatttgggttttgtgggctatgagtttacatggacgaataatagaggtggtgatgcgaatatccaagaaagattagaccgttttgtggccaatgatttgtggaaaataaaatttccaggatcttttgtttctcatttgccaaagcgaaagtctgatcatgttcctattgttgctagtgtgaagggtgcgcaaagtgctgctacgcgaactaaaaaatccaagcgatttcgctttgaggctatgtggttaagggagggagagagtgatgaggtggtgaaggaaacttggatgcgtgggacagatgctggaattaatttagctcggaccgcaaacaagctcttgtcatggagtaaacagaagtttgggcatgtggcaaaagagattcgaatgtgccagcaccagatgaaagttttaatggagagtgagccctcggaggacaatataatgcacatgcgagcccttgatgcgagaatggatgagctggagaaacgggaggaagtgtattggcatcaaagaagcagacaagattggattaaaagtggggataaaaacactaaattttttcaccaaaaagccagtcaccgtgagcagcggaataatgttcgtcgtattagaaatgaggctggcgagtggttcgaagatgaagacgatgtgacggaatgttttgctcactactttgagaatctgtttcagtctggtaataattgtgagatggacccaatcttaaacattgtgaaaccacagattacggatgagctgggaacacagctagatgcaccctttagacgtgaggaggtgagtgctgctttagctcaaatgcatcctaataaagcgcctgggccagacggtatgaatgctcttttttaccaacacttttgggatactattggtgaggatgttacaacgaaagttttaaatatgttgaataatgttgataatattggtgctgtaaatcagacgcacatcgtgcttattccaaaaaagaagcattgtgagtctcctgttgatttccgcccaataagtctgtgtaatgtcctttacaaaattgtagcaaaagttctggcaaacagaatgaaaatggtacttccgatggtgattcatgaaagccaaagtggttttgttcctggcagattgattacagacaatgttctggtggcgtatgaatgttttcatttcttaagaaagaaaaaaacggggaaaaaagggtacctgggtcttaaactggatatgagcaaagcttacgacagagttgaatggtgtttcctagaaaatatgatgctgaagttgggttttcctactaggtacacaaagctagtaatgaattgcgtgacatctgcaaggttctcagtactggtcaatgggcaaccgtcaaggaatttcttcccatcacggggacttcggcagggtgacccgctttcacctttcctatttgttgtatgtgcagaaggtttatctactttattgagagatgcagaggagaaaaaagtcatccatggtgttaaaattggccatcgagttagcccgatttcacatctcttttttgcagatgatagtttgttattcatcagggcgacagaggaagaagtggagaacgtgatggatattctctctacctatgaagcagcttccggtcagaaattgaatatggagaaatcggaaatgtcctatagtcgaaatttggagccggataagattaatactcttcagatgaagttagcctttaagactgtagaaggacatgaaaaatatttgggcttgcctacattcataggaagttcaaagaaacgagttttccaagcaattcaagatcgagtctggaaaaagttaaaagggtggaaaggtaaatatttatctcaagctgggagagaagttttaattaaagcggttgctcaggctatcccaacgtatgcgatgcagtgttttgtaattcctaagagtattatagatggcattgagaagatgtgtaggaactttttttggggtcaaaaggaggaggagaggcgagttgcgtgggtggcgtgggaaaaattattcctcccaaaaaaagaaggtggcctgggtatacgaaattttgatgttttcaacagggccctgctagctaaacaagcttggcggattctcactaaaccggattccctaatggcaagagtaatcaaaggtaaatattttccgcgaagtaattttctggaagctagggtgagtccaaatatgagctttacttgcaaatccatcctgtctgcgagggctgtaattcaaaaaggcatgtgccgtgtcattggggacgggagagatacaacaatatggggtgacccgtgggtgcctagccttgaacggtatagcattgcagcaactgagggtgttagtgaagatgatggtccacaaaaggtttgcgagttaattagtaatgacaggtggaatgtggaattactcaatacccttttccagccttgggaaagtacagctattcaacgtataccagttgctctacaaaagaaaccggatcagtggatgtggatgatgtcaaaaaatggacaattcactgtacgtagcgcatactaccatgaacttcttgaagatcgaaaaactgggccctctacttcccgtggaccgaacttgaagctgtggcaaaaaatctggaaggcgaagatacccccgaaggtgaagctatttagctggaaagccatccataatgggcttgctgtgtacaccaacatgcgtaaaagagggatgaatattgatggtgcttgtccaagatgcggagagaaggaggaaacgacagaacatctgatttgggggtgtgatgagagctcgagagcttggtatatttcgcctctgaggatacacactgggaatatagaagctgggagctttagaatttgggttgagagtttgttggacacacacaaagatacggaatggtgggcactattttggatgatctgctggaatatatggctggggagaaacaagtgggtttttgaaaaaaagaagctggcttttcaggaggtagtggagagggcagttcgcggcgtaatggagtttgaagaagaatgtgcgcacacgagcccggtggagacgctgaatactcacgagaatgggtggagtgtgccacctgtaggaatggtgaaattaaatgtggatgcagcagtgttcaaacatgtgggaattggaatgggaggagtagttcgtgacgccgaaggtgatgtgctgttggcaacctgctgtgggggttgggctatggaggatccagcgatggcggaagcttgtagtttgaggtatggtttaaaagtggcgtatgaagctggtttccggaacttagtggtggagatggattgcaagaagctgtttcttcagcttaggggtaaggctagtgatgtcactccctttgggagagtagttgatgatattttatacctagcctcaaaatgctccaatgttgtttttgagcatgttaagcgacattgtaataaggttgctcacctcttagctcaaatgtgcaagaatgccatggagaagagagtgtggcttgaggagtatcctagtgaggtcagtagtgctgtattgttggacaagatttcctaatttatgaatctttattttccggtcaaaaaaaagactcgcatttt

SEQ ID NO: 435 - DNA, 6927 bp, Beta vulgaris
aacatgctcctcagaatcccactctaatttcccagccaaataatccacttacagcaattaggtaaagaaaagtacatcaaaaattcttagtactttcctttctgatccatcctgtatccttcctatccaaacttctattccaacacttatcctaatccacatagtttgaaatgtaaatttgagagagtatgctagagaggtaaaataaatggaacaatctcaatcaacctccaactttgtagtatggcacagaaagcaagggccacttatcaaaactccaatggatcagtttaacaacattccaatcgacatttccttggtagttgttggcaagtttcttgatagaagggagttttcagtccgtcacattcagtcttgggtagactcatgggtcacaagaggaaggataaaggtaacaaaggaaggggatctttttttctttcacagtcgtgacatgcaagataggtttgacattttaggcttatatgatactatgaattttaacggagcgctgcttgttctcaaaccatggaagccgttggattcatttaaatcatttaacttctcagaatcagctatatgggtgcgactggaaggaatccctctggtatttaactcgaaatccatagctaatgaattattatcccgtataggaaaggttcttctttttgatgaaaattcagaacgtccgggaatcaaaaaattctttagggccctggtttggcttaaaatcaaagctcctctagttccagggatgtacattgaagtccaagaaaatagaacgttatgggtggatcttcgttatgaaggaattttcgtattctgtaagcgctgtgggaagattggtcataaaagctcctcatgtgatcaatcttgggaaaaagcaaaggagaaaattgaagccataataacaggggcgtgcagcccggaatctcctatgatgtatggtaatccaaatgcatcactttacactaacaagatcataggtctgccttatacccctgaatttctgaccacaatggtcaagttaaatgagcctcgaaaacctcctgatcaaatatcttcaagtagcagttcaagcaatgatgatgatgatgacgatcataatcaaccaagagacgaagaaatgcaaaatgcatcctcagatcatggttcttattcggacggattcaacaatggacttagtctgcattccggcccgtcgaagagaccaagggaagaaggtactcaaggcaagaacttcgaaaaaggtggacccagcaaccattttgagtatgggcctaatctgcatagcccgaatatccgatccgcagtgagcaagaaaagcaagggtaagaatgtcatttcagtttctaagcctctcttcaagaaagcgaaaactaagacatcctggaagaggatgacaactgtgggagccagcattgcgtcatcaggatcagcgtgtcaggcggcggaaaaaacaatccattcagatttcttatatcattccaccaggtttcacaacctaaaatcttcttttacccattcgcatttacctgagcattttcctgaaataatatctcacccggatcctaccttaccacaaaaatgtccttcaataaatacccatcccctttctctttcctcaactatacctttatctaatcagctaaccccacgtgatacatcaatagaaaatatggaatcaaatacctcctctccccactcatccaactcattcactcaacctcccaatttaccaatgtctccccctaaccaacagctttatgaaagcatccctcctttttgggcaactcctgtcccttttgaagggcaatttgaaaatttccaacagcaggaagattcggtttttgtcataaatgatgatatgcgtgcttcatgggaatatttatttggctctagcagtatgtcgtcgtactttaatccggatgatgctatagcaatggggggcccaccaattaactcctttcctttaaatgatcagctagactggtctgaatttcacaatctgtttccagaggatatcactacccactctcctcagactcctctccaaatccctggttcacactcatctctgcaaactggttcatcaagctcatatcattcggtgttcccaggggtcccagcttctgaatttgctgaattaaggatttttccgacctggtcacaagtcacaaatactatggctcagaacatttatgaagagtcatcactgggtaagcgcaagtttggggatctacaggacgtagtgtgtgcggtcgaagggaaaacagaggacatggaagaggctttgagaaggactcaagaagagaaaacgaagagattaaagcttcatgattcatctgaagtatcagagaaaattaaagaggcaggcactacgggtttgtcttcgccgcaattaatgccgataaccactcgaaccagtggaggtctattggaaccgagcccatcagaaggtaagtttatcaaagccaaacttccttttcagtttgaagaagcaagggaagcctccttatgtgaaggtggtcacaagaaagttacgggcaaacctccaaggcccaaacatgtgattgtccaagctttagtatgtgagaaaaagaggaaattcgaggagttcgaaccattactggatgaatttattaatgaagtcacactcgatctgcataaatggatttcagaaaaaaggcaggaaattctcagaaaatttaagaaattcaaatacagggctttttttggggatgaaggcttggagactgggccgaaacagtctccagaggcaccatgaaagttcttgcatggaattgtaggggtcttagatcagcggactcccctacgattccgtttttgggctggttagtccgccaatgtctacctcaaatccttttcctatcggaaactaaatcggatagtagtctaattagcaaactagctatgtacttaggctttcctaatgtagccaccgtagatagtataaataatgcaggtggcctagccttattttggagtaacgatgtaaatttagatttaaaagttagctctactaactattttgcctgtaacatcaacgatcttgttgatgaggatgtatatatatggaatcttattttgttgtacggatcgccttacttagacaatagaggggaggtttgggagaggatagctgattatataagtcgaaatcctctcgatagtgttatcatgggcgacttcaatcaaatagaattcctcaaccaaaagatgggaggttcgacgtacatcccaggcaaggagactttttcgcaatggagggatcaacttggactttccgaaattaattttcaaggacaaaacttcacctggtgcaataatcgctcggaaccagaacgggtttatgaaagattggatagggcttatgctacagaagattggctgcatagatactcagaagcaaggatattaaatatgccgattcttatctcggatcacagcccaattcttctcatttcctcgccgatttatccaaaaaagaagtcaacaattaagatggaatcctggtgtttagatttcaaggaagtggagattctaatatctaaacactggaaagtttcatatagtggatccccgatgtacgaggtagctcagaaatgtaaaagcgttagatacaagctatttcaatggtgcaaaaactacaaatctgagaacaatattaattgggaggaatttctgtctaagtgcggtgagattcaagctaatttacctatcagtggtggaggaaaattagacgaagaaataaaagatgagagcattcgcaaattggaagttcagttaaaattctggcagcagagagtgaaatgtaaatggaaagcatgggaggacaccaattccagatggttctttcgaaaagcgaaacgacgaaaacaaaagaatgaaatcttggtaatcaaaaattcagcaggaaaatgggtttcttctaagcaggacatccagggggaatttcttggttactttgcagatatttttcaaggatcacaacactctcaggaatactgggaagaattggacggaattaggcatctgattccacaaatcgacctaatgcaaagggaagatctgattaagccagttacaagagaagaagtcagaaatgttgtgttccaaatggggagcctgaaagccccggggccggatggcatcccagccatattttaccagaaacactggtcaattgtcggagaagacatatggagagcggtatcccacttttttaccactggatacatccttcaagaatggaaccagacgaatatctgtttaattcctaaggttgagcgcccggagcaggcgtgtcaattcagacccattagcctctgtaacgtaatatacaaaatcatttcgaaaatcattgccaaccggctaaaaccaatactaaagagcatagtgaccccgtaccagaatgcgttcgttcccggtagattaatttcagacaactgcctcattgcccatgaagtggtcaacctcatcaagcaacggaaaaagggtacgcattttttagccgctctcaagattgacatgtttaaagcatatgataaagtggattgggatttcctattttggttgttgacgcaaatgggattcccgtcattttatcgacaatggattatgcaatgtgtcaccactgtctcatattctatcattgtaaatggtgagcctactacaagattcaaaccatcgtgcggattacggcagggtgaccctctttcctcttacttgtttattttgataatggatgttttatctagattgttgatagatggagttagcgctggttcgtttcaaggaatcaagctttctcgatctagcccggttttgtctcacctttttttcgcagacgattctctaattttcttcaaagcaacccccacagcttgtgcaggtgtaaaagatatccttgctcgatttagcagattgtcgggagaagtaatcaattacaataagtctcatatcatgtttagcccaaacacacccctcaagtttaagagatacatgagaagtattgtcggcactccgtctgaagaatctttaggaaaatacttaggatgtaatattgaagtggatggtagaagctctaggaagtttcaaccattggtagagaaagtagagaggaaagtttccagctggcaacatctaactttgtcacatgcgggaagagtcatattcattaataacatcctctccatgcttagtctgaacattctaagtgtgttcctcattcctaagtccacggccgataagataaatgcaatctttgctagattcctctgggccaatcccaactctccatcgccaatattctggaagagcaggaaaatcattgaaatgccgaaaggaggaggaggactagggataaggaatgtccaccttttcaataaagcactgctagcgaaacaggcaattagaatccataattcacgtcaatcactgatctcacaggtacttttagccaaatataaagcatctccagtagatattgttttacggaacagaaatttgggcagagtatcgtggggaatgagaggtctctgtagggcggttcaagattgtcgagcgggtttcacgagtcagattggtaatggatccaacacaagcatcgtaggtgataaatggattagggaaggtccagtcatagtgaaatcgggggttaatctagctcaaatgggaattagacaggtgaaggatcttatgaacactcagcaaaagacatggaattcttcgctaatctggaaatgtttccaccctgatactgccatgaaggtattagccactcatattccggtagaagatctgagtgacatatttgtttggagcgaatcaaaatcaggtgttcctagggtcaaggatatttatgcattctacctgcttgacaaaggagaattgaataccacgaaagaaaacagacaattctggaacaaattttgggcctccgatctcttacctaaatggaagttcttcacgtggagactactgaataaagctttggctaccagctctaatctcagaaaaagaaatattctgatacaagagatgtgctctctatgtaagcaagataaggagaatgagagtcatttattcagagattgtaatatatcaaggcatgtatgggcaagctcgctcttgggaataagaatatgccccatgactgtcatatccattgaagattggatcaagaactttctcaagctattatggaaggaggatggagtcaagtcaccacgggtttcagagtttatagcaaccctatgggccatatggattcataggaataacgtcatctttaggagtgaagaggtgaatccggttgcaattatgaacttaaaaatagctcttctcaaggagattagagaaagtagcaaattccgagatagaaacaacccactctcccacatcgaaaactcacgtttggaaggatgtcacgtctctcagcttgattctacttctgacaaatgtatagttaaggttgatggagcatggaagagacataagcaaaagaatccaagagcgggaattggatggtcagcccttttagataactcaaaaatatttgaaggaaatgatgtggtaatatctttgtcttccctgcaaacggaagctcatgcagttctacgaggtttacgggaagcattcgctcatggagttaaccgagttcacatttgctcagacagcagagttctcgttcaagcccttcacaatcgtcaataccccttcgaagttgcatccatcgcacatgatatacaggctatgtgtaataaatttttgttttgtaagattcaacatgtaggtagagatgtagtggcccctgctcatgcattagctacagcagccagattaggtaatctcatataatatggatatgtttgttcttattgtcaaaaaaaaaacatgctcctc

SEQ ID NO: 436 - DNA, 6509 bp, Beta vulgaris
atatattgaaacctgatctatttcatattgttagttttatgttggattaaattatttcctccgtaaaaaccgaatggagagcgaaagtgagaaagcgaaaagagagagcgaaaaagcgaaatgcttgtcaagtgaggaaaatgacctccttcagaggtcaaacaagaaatttaagagaatggaggaagattctttcatggcagaaggagatcgatcttcgcctcctatgcgagaagattctgtagcggcgtcttttgtggaggaaacgttgggaaccccaaacaaatctcccaagaaagtatcatacagtcaagctgcccgaggattgggccttcaaagtaatcccctctatgtgaatgattccatagaggatgaagagatttctgatgatgatatccctctagagtgcgactcagaggatgaaagttgcccaacaatatacctcacaaaggaggaaaaaagaagaattcgacatccttggcgaaactcccttattatcaaactctttgataggagactgagttatgatattctggttcgccgtctgaaatacaaatggaaccttaaaggtgacatagctctaacagatgttggccatgcatactatgtagtccgttttaacaacatggaagattacgacttcgtattgacacaaggtccttggctcataggtgatagctacttgacgatcagaaagtgggtgccgaactttgtgtccgatcaagaacctatcaaaaagctaacagcctgggtgcgtatccctcacttatcggtggaatacttcgataagcaatttctgcacagcattggatcgaaaattggaaaggtgataaaaatagatagaaatactgagtctatggatagaggacagtacgtacgtttttgcattgaagttgatctctctaagcctttactatccaaatttcgtctgaatggcaaggtgtggattgtccagtatgaaggtttaagactaatttgtttcaaatgtggtcaccttgggcacaaggaagacacttgcaatgtcttcaaagctcaacagaaagataacactgagtccaacattaatacagcagccaatggtgcggattatcagcaagtggaagaaaatcatgtccctcaagaggtcagggagaaatatggcaactggatgatggtcactagacctggtaaacgccccacaacgaaaggtaagggcgtccaagagaaacgaggccctactaaaccagttcaaatcttgacgaaagctccaagctcagctgtggctcagccgttggttaaggagaaggtgcagggatcacgttttgaaattctggacccagaaccggtcctccctatggaggaaccaaataagaccattcagttggaggagacgctggaaagcagcctgggcggtccttcgggtgaggccataaatttaggcgaaagttccggactcagttctaaccaacttgggaagctcgagaaaatttcggaaggtaaaggtttggctatcgagattaattctcctgttgatttaggtaagtcttcctttaaagaaaaagacgagaatatagacgatattgtctccgttaaattaggaaaatctcatccttccattcctaaaaatctgtaccttcccaaaattgttccgcaagtgactcctaaagaaactcggactcctttgggcacccaaaatcgttttcacaatagaagcaaccctaaatgcaaaaaaggtgttgctagacacagttcactggtaaagtcgagctcgctcggcggtaaagaaaactcaggcatccttcgaagagagaacaagtctttatctcagactcgtacgggtcactccaattcggttaattcgattgacggattcagtcatgaatcctcaactcagcccaatcactctgatctccaaaattcctccttcgtgcgagttcttcatagacactccaacggacggcccttcgatgatagaagtccacccgctagccaatcggacccttctcatagtggatacctaccttcccccggaacacaaccctccggacatgatgatgacgtttcaaattccgtatgttacggatggaccaatgagagccctcacggaagcattcctaggagttcttcctaatgttcctcggaatatttttgacagatttcccatctttccaatgtttaatatgtcgatcaaaattatggtgtggaatgttcaaggtgttggaaccaagttgaccatcttaagagagttgatgagaatcaataaccctacggttttagcattggttgaaactcatataagtggagatcaagctcaacgaatttgtgatcgtattggtttttcaggtcaaacaagagtggaagccgaaggttttagaggaggaatttggttattctggaaatctgaagaggtaacggtcaccccctatggtagtcacagccaacatttaacggtagaaatccggcgcattggtgatgatccctggctcttctctgccatatatgctagtccagattctaccttaagaaaagagttgtggcgcgagttggagcaaattaaaaatcagtatacggggccctggctcttagctggagactttaatgaaacttctagtctgtgtgaaaggaatggtagtgaatcttccgaaatgcagcgcagatgcaaagattttgcaaattggattgaaaataatgctcttattgaccttgggtttacgggccctgctcatacttggtcgaggggtctctctcctaccactttcaaatctgctcgcttagatagaggtctcgccaactctgaatggaaacttaaatttacggagggggtcgttcgtaacctccccaaatcacaatcggaccattgtccgatactgatcagtacgtctggctttgctccagtcccaagaattattaaacctttcaggtttcaagcagcttggctaaatcatcaagttttttgtgagtttgttaggaaaaattggaacgcggatgcgcctattgtccccttcctaaagtccttcgctgacaaacttaataaatggaacaaagaagagttctataatattttccggaagaaatcagagttatgggcgagaatttctggtgttcaagcgctgctatccacaggtaggcaaaatcatctcatcaaactagaagcgaagttgagaagggagatggatatagtacttgatgatgaggaaaccttatggttccaaaaatctcgaatggaggctatttgtgatggagaccggaatacacgttatttccatctctctacagtgattcgaagaagtcgaaatcggattgacatgctgcaaaataatgatggagagtggatttcgaatcccatggaagttaaggccatggttctcggttattggaaacatcttttctcggaggacagtgtgcaatccaacttttgtcatctccctagggatttttttccccaaattactgctgatgacttcgaaaaaatgatgcgccccttaagtgaagttgaggtgactcttgcactgaagagtatgaaaccattcaaggccccaggcccggacggctttcaacctttattctatcagagattctgggatcttgtgaagcccaacgtcatgcatttggtttctgaaattctgtctggtcgagactttccagaaggctttaatgacactttcattgtcttaatccctaagatggatattccgcaacttgcaaagcactttcggcctattggactctgcaatatagtgtacaaaattgtaacaaaggtgattattaatcgcctcaaaccaattctgccctctttaatatcgcctactcagtgtagttttgtcccaaatcgtcaaattacggataacgtcataattgtgcaagaaatgttccattcaatgcgtaacaaacaaggaaaaaagggcttcatggcggtgaagatcgattttgaaaaagcctatgataggcttagatggactttcattcgtgagtcgttgatggagttgcggattcctcaacaccttgtggacattgtcatgaattgtgttagctcagctaacctccagattctttggaatggtgaacccatggaaaaaatttgtccaactcggggactacgtcaaggagaccctttgtctccgtacttgtacgttatttgtatggagcgtcttgctcacttgattgatcaagaggttactaatggtaactggaaaccagtcaaggctagtcgtaatggccctcctatctccaatctggctttcgcggatgacctcattttattttcggaagcctcggtggagcaagctcaagtgatgaaatggtgtcttgataggttctgtgaagcttcgggaagcaaggtaaatgaagataagtcaaaaatttatttctcggctaatactcatttggatattagggatgctgtatgcaacactttagctatggaagctactgcggattttggaaaatatttgggagtacctacaattaatggaaggtcttctaaaagggaataccaataccttgttgatcggattaatggaaaacttgctggatggaagacaaagactctatccattgcaggtagagcaaccctcatccagtcggcgtttagttcgatcccttactacacaatgcaatcgactaagctcccgcgctcgacatgtgacgacatcgacagaaaatcaagaagctttttgtggggcgaacaagaaggtaaaaggagagttcaccttgttgcttgggaaaatatttccaaatccaaaaaagaaggaggtttgggaattagatcaatgagacaagctaattcagcttttctagttaaattagggtggcgactgttagcggaaccatcatctctttggtctcggatcctgcgagccaaatattgcgataaccgttgtgacatagatatgtttaaggagaaatcgaatgcatcgagcacttggcgtggtattctgagcagcatcgacgttgttcgcaagggtattaattctgctgtagggaatggtgcaaaaactcttttttggcaccatagatgggctacttctgagcctctaatctccctggctagtcctataccccctatagaactccaagatgctacagtaaaagaaatgtgggacttagtttcgggatggaaagtggatgtctttgctaattatttacctgaggccacgttgaaactcattgccgcacatgaactaatagatgatgaagaagcgatagatgatatctattggaatgggtccccttctggaggttttactatcggatctgcaatgaatatcactcgaaacgcggagctagcaaatatggatgctcatcccaagtggtctgctgtgtggaaaataccaactcctcagcgcgttcgtttcttcatttggctggcgattcaggatcgtctcatgacgaacagcaaccgttttttacgtaggcttacggatgacccaagatgcttggtgtgtggggaagtagaggaaaatactgatcatattttgcgacgctgccctgtggctcggattttatggcggaaattaggaatgttgggagaacacaatagggaagaaattaatcttggcagttggataactaaaaatcttagtgcggatacgatgatgggaagtgaatggcttagagtctttgcagtttcatgttggtggctttggaggtggcgaaacgacagatgttttaaccgcaatcctagcatccctattgaccaagttagtttcatctttgcgcgagtgaaagaaattaaggaagcaatggaccgcaacgataccaacaagagtcagcacagtgggcgacgcaaagaaattctcgtgagatggcaatgcccaaaagaaggctgggttaagcttaatactgatggagcatcaaagggcaatcctggcccagctggtggtggaggcttaatccggggtccaaggggtgaaatccatgaagtattcgcaattaattgcggtagctgtacatgcactaaggcggagttacttgctgttttgagagggctaatgatcgcctgggaaggcaatcataaacaggtcattgtttctgtagattcggagttggtagccaagcttcttataagcaatgctcctccctcctccccgtatattcatatcattaatcgatgcctttcgctcattgctcgcaaggagtggaagatagttatcgagcactgctatagagagaccaatcgggcggcggaccggcttgctaatatgggtgtttgtgctgttgaaagagtagtcatgattgaggcgatcccgaaggatcttcatgctattttattggaggacttgagtggagtagcatggactagaatggtcccggtctagtctcatgcttagtttgcttggtagtatgtagtagtagtgttttcttagtctttagtgtgttttttttatttttctagtgtctttctctagtttttgttttagtcttcttgtttccgtcgtcttcttcttaggtttttgtttctttgctccttgttttgggttttttggccctcattttcaccaaaaaaaaaaatatatattgaaacctgatct

SEQ ID NO: 437 - DNA, 6787 bp, Beta vulgaris
aggacatgaagagataactagaaaaaagtttgcacttttaagtttgagctaggtaactagtaaattttccttttagggtacttttctctctctagaattttctctctgtttttttctagcctgcgtcaagtggaaattcaatcttaattaggtaatcagagggtttcctttgtacctgtggtacaagggctctgggaaccggttttaagagtcgaatttccaaggggtttcgatcgtcctagtctcagatggagatggatgtggaaacagaccaagtaggggatcacgggaggaaacttattcccttgacgcaaaaattgaatattcaagccagttcgtcccaggaaggtgaggctgaggacgatggtttgcaacatcaaggggaagaatctaacgaaaaggaagaaggagaagttttccgttggttccctcaagcaaggggaaatctgagttctttcagggatgcggttgccgggtcaacacagtggttcagagaggctaaaaaactgatggaagtgtcgcttgaatgggatgacgaggaagttcctatcccggactcccagttggcggtgagtttcacaaaagaaactttgtggaaactcagggaaccttggaggaacacattaatgggaaaggtgttaggcatgtctatctccaggaattttctagtggaaagagtgaatcgaatatggaaaacaaatgataaagtggaagttatagatttagggcatgatgttttcctgtttaagtttaataatggcaatgatatggagaaagctctatttggtgggccttggtttatcttgaatcactacttgatgcttaccagatggaaacctgatttccgaccttctcaatcagtctttgacaagatcatggtgtggatacggttcccggaattacctttagagtattatgataaagaggctctatttgcgattgctggaaaagtgggcaagcctattaaagtggattatgctacagatcatatggcaagaggtagatatgcgagagtgtgcatagaactggacctagcaaaagctttagtgtcgaaagtctgggttgctagggcttggcaaaacgtggaatatgagaatttaagtctggtgtgcttcctctgtggtaagataggtcatcggagggaccaatgttcccatggtctgggggagcaaaaccggaaaaatgaggtgaagcagcaggaccatgtaatggaggaaaacaggctggagaaggggagtcatggagaagagagcaatagttggagaatggtgggagaaacgaccgatgatgtggcatgcaagggtctgccaggaaaggcaatgatgactaaggattcgcaagatgtggtggctgaggaaaacaaacaggaaacgacaaagttaaataatgagggagaagataaagaggggccatggattgtggttactaatataaagagaagggttggtaaagggaaggaagggaactctgggggacatccgagaaatggggagggcacaagcaaaacaaaaggaagatatgggaaagaaataaggggagggacccagttgagaacaaatttggatttaaataataatagatggagggcgttggcaggaaaagatcaggagagagaaagaaaaggaacggaaaaacaaggcaatgatttgctttctgacaagggtaaggaagttttaagaagcgaacaaaaaagtggagagcatgttgggagaagcaagaaaacggcgttgctgataggtgaaaggaaaagtaaatcagctattttcgagaaagaaggtttgcatgggaggtttacgtcccctcagcttcccagaagtattaatactccctcttatcaggaggtgaacactattctttctgaaaatttagagcctgatatttcctcttgcaatggagaatgctcaagatcatcacctcactcatctgaaacagacctcatctttgaagaaaagtcccatgattccctctctctctttgaccccagtcccaccacaaaaaacgctcaaccttttcccaactttccccactcctttgctgtggaaagccctggcatcgccaatgactgtagagaagtcattcgagctccagtttcacttgtcccacctcatgaagtttcagcaccacaggaaggcagaaccctggatattcgacttcggtccggagcaaagaattcaggcaccacgcaaaaaccccccagttttcatcttaagatcagaaaacctagaagtggaggtttcaaagcctcgaaacctgacgtcaatcttcatcatcgaagaaaagatagaacagttgcaactcgaagtggaatacttccgggctccagcaacccccccggaaatttggacattactggtcccaagacacgagggtatggggatgacacagggtgtaatgggggatctccctccaaagaagaggtcaaaaatggagaaatttatgatggagttgatggaacccccatcaacgaaaccgaaacatgttagaatgaaggccatcatctggaatgtgaggggagctaacagtaaagctttcctttggcacgctttagatcttgtgaaaatgcacaaacctgaccttctgattttactggaaaccaagtgttcgagcttacgtgctgaccaggctacgaagcgtcttgggtatgtaaattttagaataattccggcttttggtaaaaggggtggcatctggttgatgtggaaggctgacattgctctggtgcactatgcggattatcaacccaaccacttccatgctcttttcaagcttcggtctgatattccggaggttctccttactgggatgcatgccccaagtgtggtgtcagagagaaacaagtactgggttgacttaacagaggactcgccgcctaggggtactccgtggttggtggcaggtgacatgaatgaagtcctgcatggcaatgagaagatgggaggtagacaagtgggtaaagagcaagggaaacaatgcaaggattggatcgctgctaatgccctgttggacttaggttttcaaggtccaaagtttacttggactaatggaagaactggaggatccctgataaaagaaaggttggacagagccttggtcaattcggagtggctggaccttttccctgacacaaaggtaattcatttacctcgtactttctcagatcattgtcccctccttattctttttaatgagaatcctaggtcggagtctttcccttttagatgtaaggaggtttgggcttatcatccagattttacaaatgttatagaagaaacctggggtagtcaccataatagttatgtggcggctagggacctttttttgtctagtgttaagagctggagtaagtatgtgtttggtagcatttttcagaagaaaaagaggatcctagctagactggggggaattcagaaatctctttccatccacccttccgtttttctttctaagcttgaaattgatttgttagttgagcttaatgagctttcaaaacaagagagagttttctgggcccagaaggcgggtattgatagggcaaagctgggggatatgaatactaaatactttcataccttggccaaaattagaacctgtaaaaggaaaatttcgtgtcttaagaacgataatcatgattgggtgtcgaataatgaagatttaaaaaagatgatgatgagtcactttgaaaaaatatttactacctccatgtatagccaccagaggaacaatagcttcaggggtgagtgtaggatctctgatgagtggaataagaggttggccaggagggtggaggaagatgagattaaggaggccttggcccaaatggccccgcttaagagcccaggtccggatgggatacaagcgttctttttcaagaaatattgggagcaaatgggcccaagtgttgttagtttgattattagggcttttgagaacaacaggattccaagtgggcttagtgattcctttttggccttgattccaaaaatcgagtctcctgtttgttgtaaagacttcagacctattgggttgtgtaacacagtgtataaaatgattaccaaagtaattgctaataggataaaaccaattttaggggagctcattcatccctcccaaactagttttgttccgggccggaatattcaggagaacattattattgcgaaagaaatggctttcctctttaaaaaaagcaaccctaagaggaatattatggcactcaaaattgacctttccaaagcctatgatagtcttgagtggggttttattagagaaacgcttcagggctttaatttcccccagtctttgattgctttaatcatggattgcatttcttcccctgccatctctctcatttggaatggcgaggtcactcagtccttttctccttctagagggataagacagggagatcccttgtctccctatatttttgttttgtgtatggaaagactttcgatgctgatcagtgataggattagggatgggagttggaagccaattaaaattagtagtgatttgggtgtttcacatattttctacgcagatgatgttttcctttttggtcaggcgtctgttagaaatggaggagttattcagaatgttttggaagaatttgggaacatttcaggtctgagagttaatatgtctaagtccctggcaattttccctccaaaaatgaatccacaaagacggcgcatgttagctgattttcttaccatgaaagggtcgactagctttgggaagtaccttggatgtaatatccttccgaacaagcttagaaggggtgattatgatggtttattggaaaaagtaaagtctgctattaatggttggcaagcgaaatatttgaatatggcgggcagatgcacccttatcaaatcagtggtgtcctctttcccggtctatgggatgcagtcctccttactgccggtgtcagttatgaatgagattgagaaagattgtaggaaattcttatggaataagatggataagtctcactatttagccagaatgagctgggatagaatttgtagccctacggggaagggaggtttgggtttccggaggcttcataactggaacttagcctttatggctaagttggggtggatgatcattaaagatgagaccaagctgtgggttcggatccttaaggccagatattgggagaggggttcctttttgagtgcggttggtaaaaatcatcattctcctatatggagagacatagtgaaggggagggagctgcttgagaaaggccttgttaggcgaattgggaatgggagatccacctctctctggtatcattggtgggtgggaggggggccgttggtggatgtgatggggagcaacattcctgagttcatgtctcactggcaggtgagtaatatcatcaaaaggggtaggtgggacacaaagaaaatttctcatttactccctcctgatatccttaagcaaataaaggaaattccccttgcttccatgtctgaggtggaggatgacttcacttggaattttgagaagaatggaactttcagtgttaagtcagcttactatcttattaatagaagggaggaggaaactgggggaaagggaagttggcgaggtttgtggaggaagaatattccgtttaagtacaaattgcttatttggaatgggattcacaatattttgccgaccgctctttttttggctaaaagaattcataattttaatccccaatgtgtggcgtgtgatcaccctattgaagatatgattcacctttttcgggactgttgcgttgcttcaagtgtttggattgaaattttaaaacatcataaaccaaataatcaaaacctttttttcaaccttgagtgggaggaatggattgacttcaaccttaatcagcatgattactgggttaccaagttcaccactgccttctggcatatatggtgttcgagaaataaaactgtttttgaatgtgctgtcaatcaccctaaattcacctataatagggtggtggcagactttttcactaacattagggcttttcaggtgaataatactcagggcaatggaagcaaggtggtgctgcggtggaaaccaccccatcaaggttttctgaagctcaacactgacggcgcgtggaaggccgactgggagaatgctggaattggtggtgtctttagagatgcggtggggaattgggaattgggtttcgcaaagagagtggatgcgggttccccagaggcggcggagctgatggctataagggaaggcttgcaagttgcttgggattgtaactatcacaagctggaagttgaatgtgacgcaaaaggggtggtccagctgcttgctaagcctctcgaagctgagaaccatcctttgggggtgattgttatggacatttgcattctccttactaggcattggagtgtggaatttcttcacatcaaaagagaaggaaacaaggtggcacattgtctcgctgcggaggcggtgaatcaggttgaggaaagagtgatcttcatcaatccgccggaacatgccaaggaggtctacttcaaagacaaagagttcgtcgccagttcatcttgaggtctgggcggggtgttcgatgtggctgttggatggctgctttaattataatgttaggcgggaggtttttggaattgcaagtgtttttaatttaatggtgttattttgtgggtttgtaacttctgttgaaaactctatgtctgttctgaaactgttcatttaatttaagtggtttccttttgatctaaaaaaaaaaggacatgaagagata

SEQ ID NO: 438 - DNA, 6766 bp, Beta vulgaris
gaaaatttgaaatagaatctatacggttgtaaatacaaaaaatatgaaaaaaagaaagagagagaaagtgcagaaaggggcgaaagaaaaccacgaaaccctagaaatccagtccaagaaatccatcccttcctcccatctaattctaaaaaaaagtcagaagaagttgaagagattagttcgaaaatgtgctgatgtgcacttcattaccataattttgcttttgagctgttggtgtgtagtcattcaagttcaatctcaaacccccaaaaaagccccaattcaatttaaaggctactctatctcttttagcccccaaaaatcattatacctatgttttagcttccccaactctacaaaagagtattctatcacctcctcatctgatggtgtgtcaacaattcggttcaatgaattgcatttttgctccaatccagctggagacgctagggttttaggattcagagcatttaatgcaagctcctttaattcttcctttagtgaggggtttaatcatatgtgtgctaaggtggtttttcagaggcgaaattcggccaagcgtggagtgttttctgatgttatgagctttgcagattgcccaagaaatggtaccaaatttgtcagtccattaaatgcgatggaacttcacttaagtatctctcatttcaagcaaatttctccatattatccaagcatcaagctcctctataaaaggggtgggaaggtgagttattacaacacaccaaaatctcacttttctttctattctggtaaattcattactattattctctctactagcagttttaaatttattatgtctactcctcattcgtttaaagatatgctggtgggtaaccataatcacaatagtgaaaattctgagactccacttgtagtgggtcagtctgatagcaccaaaaaatacacgtctgttgttgagtctaaaaatcctctaaatgaatcccccctccctcctaataatcttcatgatccacctgtgttcccagaaacctgtgtgctggatgatctcccccaggtaaaaaaagatatttgtgagctctctaaatcttgcttatttggtaagatgctttctgcacctcttgacattcgcactatcatatctcgtactaaagctgattggagggttgttaaaggtgatgttgattatttagaaatggggaatgggtggatcctcttgagatttgccaatccccaggatcttgctcttgtttggagtgagaggccttggcatatccaaggggatttgcttgttcttcaaccatggaagccttcttttgatccatatttagaagaaattaagtgggtggacctttgggtcagaatcccaaggcttcctactgagctcttgaactttgattcaatagcaaatttgttggcttctaatgatattggagctttgatcaagcttgatcaaaggtctttgttgagaaataaaatcaggtttgctcgggcatgtattcgagtggatattcaaggccccctattggagttcgctgaggtaagtaggtctggtgacttgaggcatggctatgtcatatggtatgaagacttttctgctggttgttctttttgtggtgagattgctcatcttattgaggcatgtcctttattgaactctcctaagaaagaaatttctatccaattactaaagaatcctaaacagcaagctctgtataaaactcttgctaaggctgctgggcaagactctcatattaccactgctgagccagcacaagtggtatatgtcaagcccaagcatcttagcaagaaccatgtccctctatctgggttctctaaggaaaagaatgctagagtctctgatggtttactccctatgccggttgctaaaggtattgttttgaaggaatcttcacagaatcaagcaaagctatctcctgctcctgtgtatggcaaaggtaagggtaaaatggttgtatctgacccatatgagtccgaggattcctctgatgatgatgctgatttcttagctccctctatctctcctcctcctatgcttgccactggtgagaacagaggagacactgatgttgaggtatcctccttgctgcccctggatgttgctaaaccattgtccccccttgagggttctggtgtgaatatagttcagctcttatctgaggacactgcccagatccaatatagcccagatcacttgctggatgatgctaataatttcttactggatgctggtgatgatgttgatgatcttgacactctcaatgcttatgctgaaaattcatttcactccattcaatctgatagttcaattgttaagcaaatccaaagcatggggatggatgcttcattcccagtggagctctcttctcactccagctcagctaagaggatgattgaagatcatgaggaagatgacgatgcctcttctgctctgaagaggaagaggacttaactccctagccccccctgcatatctaattgcttcagttaaatggtttttgtgttttctatcttagaatatcatgtcaattgcgttttggaatgtccgaggaggttgcagaaaaaatgtaatggaagagtgcagtgacttttgtaagaataacaacattaagatattaatgttgtgtgagacaaaatctcaatcccccccttcccaattagctgttagtgcagctgggttcctccatcatgattctattcctgcgatgggatattcagggggattatggcttttttggagagattgtatcttaaatccattctctctagttgtaatatataaatctgttcgtttcattgcttgttctatcaatcttttgaatcagaatttacagtttgtagcaattttcatttatgcacctgctcaaaaggaattcaaatcttctttttgggatgaactgatagcttatgtttcgtctttatccttcccatttataattcttggggattttaatgaaattaacagcccatctgataagcttggtggtgcccctttctcatcatctagagcttactatatgcaaaatttatttagtcaagtggactgcacagaaatttctttcactgggcaaatctttacttggagaaaaaagaaggatggccctaataacattcatgaacgcctagataggggggtagctagcacatcttggctgatgttatttccacatgcatttcttaaacatcatatttttacctcatctgaccattgtcaaatatccctcgagtatcttgctaataacaaatcaaaagctcctccttttagatttgagaaaatgtggtgcactagaaaagattatgattcactagtaaaacgtacgtggtgtactaagttctatgggtcacatatgttcaactttgttcagaaatgtaaactagtgaagatcaattctaaagagtggaataaaacacaatttggcaacatatttcgtcaattacgtcaagttgatgaaagacttgaagagatccaaaggaaccttctaatagaccacaacaacacttctctcaaaactcaacaagaattatttctcgctaaacgtaataagttgcttgaatataacactacttattggaagcaaaaatgtaaatctgactttatggtgctaggcgacactaattctaaattttaccatacacatgcttcaattagaaaatatcgtaatcaaattaaggaatttattcctgacaatgctcaacccataacgcaacctgaccttattgagaaagaaataacattagcctttaaaaaaagatttatttccaatccagcttgcaaatttaatcaaaatgtggattttaatctcctctctccgattgtgtctgaggcagataatgcttacttaacttcggctgtttctcctgaagaaattaaaaatgcggtttttgatttggctcctgacaagtctccaggtccggatggatttcctccctattttttccagaaatattggacattaattgggaaatctgtatgtcgcgcagttcaagccttttttcattcgggctacatgctaaaggaagttaaccatactttccttgcgttaattcctaaagttgataaaccagttaatgcaaatcattttcgcccaataagcctttgctctactatatacaaagtcatatccaaaataatcaccaatcgcctaaaaatcactttgggtaagataattcacccattacaaggtgcttttattcctgagcgtcttattcaggataacattcttattgcgcatgaggtttttcattctttcaaaaataaaacagggaggggaggatggattgcgattaaactagatatggagaaggcgtacgatagactggagtggaagtatatttatactaccatggataaaatgggatttagtccaatttggatcgaatggattcgtagctgtatatcctctgcatctttttccgttttagttaatggtatccctggtgaaaggttcttcccttctagaggaattagacaaggagatcctttgtctccctatttattcattttatgcgctgagcttctagcgcgagaattctctaaggcttgtcatgaacctgggaaattgatcggtgttcctattggtagaacacgaactagaattcccttccttaccttcgcagatgataccatgatttttgcaaaagctactgaggctagctgtcataaaattagacaaatccttgacaaatattgtttaatgtctggacaattagtaaactatcataaatctgcctttcaatgttcccccaatgtcagagatattgataaagtcaattttgcatccattcttgggatgcaagaatcatcggagttaggtgattaccttggttgtcccatcatcaactctcgggttacaaaggagacctttgctggggttatttctaaaactgtccagcagcttcctaaatggaaagctaattctctatcgcaagctggcagaacagtcttaattcaatctaacttagcctccaaagctagtttccaaatgcagagctttactcttccaaaaaaggtactcaccactttggatacaacctatcggaactttttctggaataaagatcctgctgccaaatcagctaacttcatagggtggaacaaaatttgccaacccaaatctgtaggaggtgttgggtttagaaaagcagaagtgactaatatagccctccaaatgaaacttttgtggaaaattatggtaagtaaggacaacatctgggttaaattggtgacacagaagtatctgaaagagcaaaatttacttgtatgtaaaattccctcaaatgcttcatggcaatggaaaaaccttctacgtcataggaatttcttttccaaaggtctcagatggctgataggggacggtcaggacatctccttttggactgataattggatcttccaatatcctctaaactctaaatatgtgcctacagtgggctcagaaaatatcaaagtagcagagtgtttcaatggattaggaggttgggacattcctaaactccttaccttagttcctccaaacattgttaaggctatttcttcagtgttcattccctcttcctcccaacaagatagacttctttggggtcttaccccgactggccaatactctgttaaatcaggtgcctccctcattcgagaagttaatggggggacaattgagaaagtggaatttaactggatctggggtattcatgctccgcccaaaattaagaattttctttggaaagcttgtaatgatgggttggctactactagtagactggagagaagtcatatatttgttccccaaaattgttgtttttgtgactgcccttcagagacaatatgtcatctctgctttcaatgcccttttactttagatatctattctcatcttgaggataagtttcaatggcctgcctatcctagttggttttctacccttcaattgagttctttccgttcggttttagaagcctgtcacatcaatttgacgttggagtaccttacgaagttaagtatagtgtggtggcatgtgtggtattttcggaataaattaattttcaataacgagagtacgtccttttctcaagctagttttattattcactcttttatgggaaaatgggagaaggccaacttagaaatcccttcttttaatacccctctccccaaggattgtaaactcccagtccgttcaggcaaaaatcttatttggtccccgcctaatgaggatgtgctgaaagttaactttgacggatccaagctggacaatggccaagcggcatatgggtttgtcatcagaaactccaatggagaagtgctcatggctagggcgaaagcgttgggcgtttacccttcgattcttatggcggaagccatggggcttttagagggcataaaaggagccatttcgctccaaaattggagtagaaagatcatatttgaaggagataacattgctgttatcaacgctatgagcccaagtgccactggtccctggaccattgctaacattatcttggatgcaggtgctctcttgggccattttcaagaggtcaagtttcaacattgctatagggaggctaaccgactggcggatttcatggctcacaaggggcattctcaccctgaagtattgtgttggctccccccctactgtattgatttttcccttcttatccgtaaggatgttttaggttggccccctgactaagttgggccatctaaggtttttctttcccaatcaaaaaaaaaaaaaaaaaaaaagaaaatttgaaatagaat

SEQ ID NO: 439 - DNA, 4774 bp, Beta vulgaris
taagtcttgtagatggtttgaaattatataacttttgtacatagttaaaaaaaaaaaaaaaaaaaaaaaaaataaccttaaccctaaaccctctgctggcgtaggttaaggtgtatagctaacttgcgcctcttagagaatgggccggaaaaagaaggtgaacacgccggtggctagctcgtcggcgcaggggaaaccttgtgaaacaccacagacacaaaaagtacaatctttagtgagagagagtgagaaaatcaatgtaactgtaactgaagaaatatcaaaggtagtgacttctccgatggagattgttagtaatatagagctggaaaagagtgtggagggtgacaaaagcaagttcaatgaagcagcgaagcaggtggaaaggatgagtgaatgctggttaaatgctgttgtggtgtatgttgttgggcaaaatccaaccttaaatgctatttctcagtatgttaaatctcattggcaatctcaggatgacccacaaatttttaaacatgatgaaggttactttattgtgcgaatgaaaactagagaggaaagagataaaatattgttttcaggaccacatttgttttatgggaaagcaatgatagtgaagcaatggagtgctaattttaactttcatgaggaagttcagaaagttattcctatttgggttaaattgcctaatctaccgttgaattgctggggagaggattctttgagtaggataggaagtgtgttaggtgtgcctctttatgcagatgaatgtaccagcaaaggtttgagagtttcatatgcaagaatgttggtagaaatggatgtaacacaagaaattcccataacggtagcagtggaagatcctaatggggtggtgtttaaacaaaaattagaatatgattgggtgcctcatttttgtaaaaagtgtcaaatggtgggtcataattgtggaggaaagtcagtaactgctcgagtagttcaaaggtggattcctaagcagaaagtgccggatgaaaagatagtagctcaacatccacctatcagtgatgctgcaacagaacaagtagtggaagttatggtgcatgatcatacagaggaggggaatgtggtgtctgaggagactactgtaactcctataaaaactccagttaatattccagatgcagaggaaggtgagtggagattggttacaaggaagacaaaagacaaaggaaagcaagtgtataatcagagtggaacacaactgctttttggatcaggtttacctgggagctgtcctgggggtgctaggggaccaaacccctatttgtcttaatgaagatcacaacatggaacgtgcggggtttgaatgaccctattaaagtgaaggaagtcaagcactttcttcactcacaaaaaatttcattatgtagcctttttgaaacaagagtaagacagcagaatagtgggaaaattcagaagaagtttggtaataggtggagttggattaacaactatgcttgttccccaaggggtagaatatgggttggttggttgaataatgatgtgaacattaatgtcttatctgtcactgaacaagtcattacaatggaggtcaagaatagttatgggttgaatatgttcaagatggctgcagtgtatgggttgcatacaattgcagatagaaaggtgctttgggaggaactttataattttgtttcagtttgccatgagccttgcattctgattggagactataatgctgtttatagtgctcaggatagattgaatgggaatgatgtgagtgaagcagaaactagtgatcttagaagttttgttctgaaggctcagttgttggaagctcctaccactggtctcttttactcttggaataataagagtattggagcagatagaatctcaagtaggattgacaaaagctttgtaaatgtagcctggattaatcaatatccagatgtggttgttgagtacagggaagcagggatttcagatcattctcctctgattttcaatttagctactcagcatgatgaaggtggtagacctttcaaattcctgaattttcttgctgatcaaaatggttttgttgaagttgtgaaggaggcttggggatcagcaaatcatagattcaaaatgaaaaatatatgggtgagactgcaggctgtcaaaagagctttgaaaagctttcactcaaaaaaattttctaaagctcactgtcaagtggaagaattaagaagaaagctagctgctgttcaagctttaccagaagtgtcacaagtaagtgaattgcaggaggaagaaaaggatttgatagctcagctgagaaagtggtccactattgatgaaagtatcctgaagcaaaaatcaagaatacagtggttgtcacttggagattccaattccaagttttttttcactgcaatcaaagtgagaaaagctaggaataaaattgtactattgcaaaatgatagaggagatcagctgacagaaaacactgaaattcagaatgaaatttgcaatttttacagaaggttgttggggacaagttcaagtcagctggaagccattgatttgcatgttgtgagagtaggggcaaagttaagtgctacttcttgtgcccagcttgtgcagcctatcactatacaagagattgaccaagctctagctgatattgatgatacaaaagctccaggtttggatgggtttaactcagtcttttttaagaaaagttggttggttattaaacaggagatttatgaaggcatactggatttctttgaaaatggctttatgcacaagccaatcaactgcactgctgttacattgattccaaaaatagatgaagcaaagcatgctaaagattacaggcctattgcctgttgttccactctctacaaaataatttctaaaattttaacaaagagattgcaggcagtcattacagaggtggtggattgtgcacagacaggattcataccagagagacatattggtgataacattctcttagctactgagcttatcagaggatacaatagaaggcatgtttctcctaggtgtgtgatcaaagtggatattagaaaagcttatgactcagttgagtgggtgttccttgaaagcatgctcaaagagttaggcttccctagtatgtttattaggtggataatggcctgtgtaaagacagtgtcttactctatcctattaaatggaatcccatctattccttttgatgcccagaaaggcttaaggcaaggagaccccttgtctccttttttatttgctttgagcatggagtatttgagtagatgtatgggtaatatgtgcaaggatccagagtttaacttccatccaaaatgtgagagaatcaagctaactcatctcatgtttgcggatgatttattaatgtttgcaagagctgatgcaagctccatctccaagattatggcagcattcaactcattttctaaggcatcaggcttacaagcaagtatagagaaaagctgtatttattttgggggagtctgtcatgaagaagcagaacaattggctgatagaatacagatgcctattggttcattaccatttagatatttaggagtgccccttgcctcgaaaaagcttaatttttctcaatgtaaacctctcattgataagattacaactagggctcaaggatgggtagctcacttgctatcttatgctggaagattgcaattggtgaagaccatactctatagtatgcaaaattattgggggcaaatatttccattgcctaagaaattgataaaggcagttgaaacaacctgtagaaaatttctatggactggaacagtggatactagctataaggctcctgtggcttgggattttttacagcaaccaaaaagtactggaggcctcaatgttactaacatggtcttatggaacaaggcagcaatactaaagcttctgtgggctataaccttcaaacaagataaattgtgggttagatgggtgaatgcctattatatcaagaggcagaacattgaaaatgttactgttagcagtaacacctcatggattctgagaaaaatttttgaatctagagagttattgacaagaactggaggatgggaggcagtgagtaaccatatgaatttcagcatcaagaaaacttacaagctgctgcaagaagactatgagaatgtggtatggaaaaggcttatttgcaataacaaagctacaccaaaaagccaatttattctctggctagctatgctaaatagattagctacagcagaaagagtaagtagatggaatagagatgttagccccctttgcaaaatgtgtggcaatgagattgaaacaatacaacacctgttctttaactgcatatatagtaaagaaatctggggcaaggtgctgctgtatttgaatttgcaacctcaggctgatgctcaggcaaaaaaggagttggccataaaaaaagcccgtagcacaaaagatagaaacaagctgtatgttatgatgtttacagaatctgtgtatgccatctggctactgaggaatgccaaagttttcagagggatagagattaatcagaatcaagctgttaaaagtattatctttagaatagcagttagatgtaatgataaacaaaagcaaatgctagtaaagtaagtttgatttggtgttttggaggcattaggagtaggatgttactctaatgcagtagattgtaacttattttttttggttatcaataacaattttgaattgccaaaaaaaaaaataagtc

SEQ ID NO: 440 - DNA, 6708 bp, Beta vulgaris
aaacaatactttagtgaaaagttagagagaaaaacagagagatgggagagaacattcctagagagagaaacccacaaaaaagccaaccagaaaataaagagaatccatggatcacggtgaacaggaagaaaaccagaactccaaatcctcaagcctcacgaacctgttttgtcaaccacctacctcaatccatcaccatctcagaaattgcaagagtgttcagaactcatggcgccattgcagacataaccataccaaagaaccaaaaacaactcgcacataaatttgcttttgtgcaattccattatcctcaatccctcatcaccgccattagggatgaaaatagaagaaaggtcgaagacaacctgatttctgtattccctgcaaaatatgataaatcccaaaccaccctaaccaacacatataactacaaacaatcaggccccagcacaaacaaaaaaataccaatcaaggtagcaagcgcaccctatgtcagagatggtcggtcctacaaagaagcaacaaacaccacaaaaacgtcaaacaacctgagtaaccaccaccaaaccccgcacccaaaccatcatcagaaacccaccccagccaatcaaccccaccaacgaaatgaaccagccctcccttttgaagaatatgtccccacaataaactcatgcaaacccaaaccaacaactcatcgaataatgagttcaagagctcttggagaagatacggaaaaaatccgaaactcactgggtgccatagacccagatagtgactatgctgctgccataaaaggccaaatttgtgaggagaacgaggaaatgcttcaaaggagctcaattgcacttgccttggcatcacaaaaatcggaaattatactggatcatattcttgcagagggtgtcaactgcctatcaattaaacctatgggaggtatgctacacctcattactttcgatacatttgagaacaaaaaagcaataatcgaaagtgagtggctacaaagatggttttcaaaaataatcaatgttaatacaagaagtgtatcactatggagagaaacatgggtgaatatttacggagtccccctcattgcctggggatacaacaactttcacaacattggcagcatgttggggagagtattgtcagtcaattacaacaactttgattgtgcaaaagtcctcatctatacagattgcttctttgacataaactgtaaaatatcatttgaaattggcgaagagaaatacccagtttatgtgtcagaaaagcaacaactatggcaaacccagtcgaaaccaaaatctacagatggtgaactgaagaatgaaaaagatgagaatatcatgtcaaatcagtcagagcaattcccaggtatgtctccccctgtagaaaatgacgtcactcacaactggaatgtgaagagtccatttccaaacactgaacatatgacaatcaatgatgaaaatgatgaaattaatacagcagacacctttttgcctcccctacctatttccaagaccgacaaccaaacaaaaaataataaaaacatgcataacttgtcttcccaagacaatgtactgaattgcaatcatcatcaagagacaaattcgaaccaacagcgacacctcacctaccctacctcaccagatggcataccagtacctacaccaaaaaatcctaagccccaatcatcagctctatctcctgaaaacagaaacgatccaaacacattacaccacgaaagcccaaaaatacaaccaaatgaccaaaacaagcaaataaccccaattaaaatatccaacccttttgggcctctaatgagaccaaacaagtcatcaacaacatccacaacaactctagggtcctcgtccagttcgggacctctctttccaccaggatttgaagacaccattccagcccaaatcaaacttgaaagagaaaagaaaagaaaaaagaagatggaaaaaagaaggagattgaagaaagcatcctctgcctcaaaacgtaacatgaaaccttcctcaaatctacatctcccaatgggagtccaagtagatgatgtaattgggattgccaaaatccttggtctctcttttaagggacccgaatctgaactcaaaaaaagaattgagaatatactgcagacccaaagacaactctgggaaacaagtgttgtctaagccctcaactcctcaagctcaaataaaaatttgtcatcatgtcagtactttcatggaatattaggggcttaacagccagggttaaaagaagtgccatacgaaaattgatacaaaaacataccccagattttgtcttcgttcaagagacaaaaatggaaggtatctcgctggaaattgtgaaaacaatgtggaagtctcaggatgttgaatggacatggtacccgtcggttggtaactcgggtgggctaatttcaatgtggaataaatcagccttctctatgaagtccagttcagtcaatcaacattggatagcgatcagtggaagtttttcaaggataaacttcgagtgtattctcttcaatgtctacaacccaaacacagtgggagcccgagccagtgtatgggaggaaatagtgacatttcataaaacaaatccactgccaagcctcctcataggcgatttcaatgaaacgcttgaaccagatgatcgtggcagcctactattctccaacattgggactgataatttcaaaaatttcttgcaggtcatggaattattagaagtatctccatcaaataaaggcttcacatggttcagaggaagatcaaaaagcgtccttgataggctcctacttaaccctgaatggataaatgaatttccatccatgagattgtcattgctacaaagaggattgtcagatcactgtccgttgctcactaacattcatacgcaaaactggggtccgaaaccttttaggtttcagaattgttggctaacggaccctcattgcctggagattgtgaacaaaacttggcttgaatctacaaacatgccaatgatagataagcttagaagggtgaaaatcaggctaaaagcgtggaatcgagatgaatttgggcatattgacaccaacattaaaataatggaagacgaaatccagaaatttgatacaataagcaatgaaagagaactggatgagcaggagattgaacgaagaaaagaggcacaatctgatttgtggatgtggatgaaaagaaaagagctctactgggcacaaaattccagaatattatggctgaaacatggtgataggaacaccaaatttttccatatggttgcttcaaataagaaaagaagaaacttcatagcaagcatcaaagtcaatggcagacgcatagaaaaaccgaatcaaataaaagaagaggcagttaccttctttaaggagatattcacggaagagtttacagaaaggcccactcttgaaggcctccaattcaatcagctctcacaaaatcaagcagattccctgattcaacctttttcagatgaagaaatagattatgcagttaactcatgtgcatcagataaagcgccagggcccgatggcttcaattttaaattcattaaaaatgcgtgggaaacaatcaaggaggatgtatacacactggttcgtgaattttgggccacatctaaactccccaaaggatccaattccaccttcatcacactcatcccaaagatcgataacccggaaaatttcaaggactttcgccctattagtatggtagggtgcgtttataaaattattgccaaactaatggcaaaaagaattcaaagggtaatgagttccctcataggcccacttcaatcatcatatgttgaaggaaggcaaatattggacggagccctagtggctagtgaagtgattgacctgtgtaaaagaaagaagatggaagcaattctcctcaagctagactttcataaagcatatgacagtgtgtcttggagctttctacagtggacacttgctcaaatgaaatttcctcctcagtggtgtaaatgggtaatggcgtgtgtggcatcggcttcggcttcgattttgatcaacggctcacctagccgccccttcaaacttcatcgtggcttacgacaaggtgatcccttatcaccctttctttttgtgattattggagaagctctcaaccagttaataataaaggccacaagactaaatctatggcggggaatcgaaacatccagagatggaccaatgatctcacacttgcaatatgctgatgacaccctggtattcagtgatactagtacggattctctcaaaagtattaaaagcaccctcatcctattccaactagtatcgggcttacaagtgaatttccataaaagctcgctaatagggcttaacatatctgatgctcgggctaataatgccgcaaacctgctgcaatgtaaggtagggtccattccattcacctaccttggcctcccaattggaggcaacccttctcgaattcaattctggaaaccagtcattgagaaactttgcgagaaacttgcaatgtggaaaagcaagatgctgtcaattggtgggagactcactctaattaaatcttctctggcaagtctcccactatatttcatgtccctttttcccattcccaaaggagtagtggagaaaataaatatgatcactcgccgttttttatggagcggttgtgcggaaaaaaaaacccttcctcctgtgtcttggaaggtagttcaattacctaaaagccgtggtgggcttaatattggtaatgtaatgcataagaacctagccatgctttttaagtggatatggcgattttttcaggagcccaataacctatggtgcaaggttatcaaaagcaaatacaactatgccgcgcctctcacaatatcgagcctgaccattcccaaatcaggtgggccttggtcgaaaatatgtacagccatccttaatgaccaagccgcaaaatcagtgatgaagattggtttacggaaaatcattggaaacggaggaaacacgttattctggctagatccctggatttcatctcatcccttgaaaattttatatccaagacttttttcaatagcaattcatcccaacgcatcagtagcggcacatggattttgggaaggatatttttgggtgtggagcttttcctggcgcagaaatcttcgacccagggacaaaatagagaaggcaaatatggatgctttgttaaaaagtgtatgcccatctctcctttgtgaagataaattggcctggactcatgacaaatcaggaaaattttctaccaaatctttcaatgcagagctcgataaactactgccgcatgtgcatcaagatgcagtcaaaggagtttggagaggacttgtaccccatagaatagagatctttgtgtggtcagcgatgattggcaaaatcaacacacgacacaagctggctacctatggtatcatcccggttgaagatagttcatgtcccatgtgcaattctacccctgaaacaagtgaccacttattactccactgcctctttgcacaaagaatatggacatggtggttggatttatggagcatcaaatgggtcttccctatgagcttgcgaatggcgtttgatcagtggcaatccacaaacaaaagtccttttttcaagaaaatatgggcttcgattttcttcattgtagtgtggtctgtgtggaaagaacgtaacgatcgcatattcaataacaaaaatacctccattaaagacatcagagatatggtactcctgagacttgggtggtggatcagtggttggtccgaaaagtttccctactctccccttgatatccagagaaacccctcatgcttgagatgggaggaaaacaggtgcatagtggattgttctccagcctcagtcacgacatggcaggcccctgggtgttcgagcattaaatggaatgttgatgcttccgtcgacccgagaacatcatgttcagccattggaagagttttaagaaaccaacatggcaactttatgtgtctattttcatctcccattcccccaatggagataaattgtgctgaagtcctagccatacatcgggcaatatcaatctccctcgcaagtgattcaataaaagacgcaaagataattcttgaatcggactcggctaatgcggtgtcatggtgtaatggggaggaaggagggccttggaacatgtctcaccatcttaatttcattcggaatgcaaggaataaattccttgatgtgacgatatctcacaaagggaggggctcaaatatggtggccgacgcacttgcaaagcagggacttcgacgtcaagatgagttcattgcatggttataaccacctcgaagggaagctgtcacttattccccctggataggcgcagatgtaacactttaaaaaggaacgggtgggggcggacgctttttgatactgcagaaaactcattcatgtatttctacttgttttattttgtaaaagttccggttgaactcatagtattttattaggttgtaatcatcgcgaggatatagcaccttccgctaaatcgggggtacctagtactataaaagtttcccttgctggaaggaatacctggtttattgatagagggtgctatcctcttttggaaaatgaatgagaaattacaaattatcaaaaaaaaaaacaatactttagtgaaa

SEQ ID NO: 441 - DNA, 457 bp, Chironomus circumdatus
acttagctcaattagcaaaatactggaaagagttctgctgagcagaatcaatgaatatctagaagacaacaacatcattccaaatcagcagtgtggtttccgaacaggaagatcaacatcgcatcaacttatcaaagtaatcaaaacagccagagaaagcataaaaagcaaagaatcaactggaatgatctttcttgacgtggagaaagcatttgacagagtctggcataacggactcttgtacaaaatgatcaagctagggtttccactgccgcttataaaaactgtaagatctttcctcagtgaaagaaccttctcagtttttattaaaggccagttctcggaaatctacaaaatcaaatatggagttccacaaggagcagtgctttcaccaactctctacaacatcttcacgtacgatgttgtacgagaaacaactgaaaatatcgcacttttc

SEQ ID NO: 442 - DNA, 6585 bp, Beta vulgaris
aagatcaaagtgtaataaaaaaccatgagagagagagagaaagcccctagtgagagaaacccctccctccaatggaacgtagtatccaagagaaaacctagatcaccctccacccccaaagcttctcgaacctgttttgtaaacttcctccccagcaccatgaacacaacggatattgcagccatgttcaagatccatgggacagttgactctgtctacatcccctcaggccaactcaaaaaacctcaccaatgtgcttttgtgcgtttcatataccctcaatctttattatcagcaattagagatgagcatggaagatgccttggtaaccatagaatcactgtacatcatgcgaagtttgataaacccccagataaaccaaaccatagacatcacaatccctcccctcttcataccaaaccccccgcctttgaccacaagaccttccacccaacccatcgcccagcgcacagagattccagaacctataaggaggccttctccaacattcatcctgagaaatcctcatcccagagcaccccaaaaccgccacctgtacccaaatcgacctacaccttaccaaatccgccgctccaccgagtcatgagttcccgtgcattgggggaggatacagaaaagacaagagaatcactgggagaaattgacatagaaggtgagttcgcggctgcattgaaaggagaagcatgtgaagaaataaaagagatgcttgaaagaagtgctgtagccgtggcaaactcttcacaatcctctgaagatattctaagtcatatcctagctgaaggagtaaactgtctcaagataaaaccaatggggggaatgcttcatctcatcatttttgaaacatttgcagacaagaaggaaatgatggaatgcaaatggctagagaagtggttcctcgtactcaggaatgtcaatgatgaatcagccatggtctggagagagacatggttaaaagtgcaggggatgccccttatagcatggagtcatgaaaatttttataagatcggatgtgtatacggcagggttatctcagtcaatcaaaaagacttcgaatgtgcatatattttggtattcactgattatctttttcagataaacaatttgatatctatggagattcaaggtaaacaatattcaatctttgtctccgaggcaaatagtccagggtcagtcatgcaaaaatcaagtcatcatcctgggaatcatgtgcatgggattgctgcaaatcagtctccaaatggtatggggtccccttcaaaaagcaaccctaggaatctcactcctccctccgcaaaatctgaccaatggaagtcaaaagaggttgacacaaatcatttgatctcaatatctaaaaagccaccaaaaagccaaaacgtcatctcattccccccagaaaatctcaatgaaccttttcctgggaagcctcatggacagccttttcgtcaatcttcagtaaatgattggtcgggcctcgggtactgctcccctcagaaaaggaaaaataaccattctcaatctcccatgcgagaacccattgacttctcttctccctctaaaatcatagaggtcccaccaccaaaaagcctacctcccaaaaagccaccagcccagcccactacatctactcccctcataaactccccaaacaaacctcacctcaaaaatgggccgattcccaacccaccaaaacaaaaccattcttcttcaggaacaatagactcctcatctgggtctgggcctttattcccaccaggttttgaagacagagtaccatcccacataaaaattgcacaattagaaaaaaggaagaaaaaactagaaaagaaaaaaagattaaaattcaatgctcagagcaagatgacagcaactccccctccaaaacaactatatggagctattgcagtagatgatgtcattgagctggcgagtttgctgggcttatcatttgatggtcaattatctgaactcagaaggcgtatccaagtgatcctacaggggcaagtgcacacttgggacaaccaccaatagtaagtctgtcttcaattctcattcccaaaattatttcttatgatgataataatatcatggaatataagaggcctcaatgcccgggtaaaaaaatcctccttgaggaagctgatctctcgacatgacccgaaattcatttttttacaagaaacaaaaatggaatctctcaacccaaaaacaatacgctccatctggaactcggacgatattgattggcttttcattccatcaattgggaactctgggggtctcctatcaatgtggaaaattgactactttagcctaacctcccataaatctgaaaataactggattgcattgaacgggaagattccatcaaaaaatttccaaggagtcttggtgaatgtatataacccatgctgtagagttagcaggagtaaagtgtggacatccatcagtgattactgggcagaatcccaatccccaatgctcatggttggagacttcaacgaagtcttggacccaagtgacagagggagtggaatctcctcccaattaggggttttggattttaaaaacttcattcaacaaacccacctgatggaaatctcagcttcagacggatggtttacatggttcagtgggcaggctaaaagcaagttggatcgactccttgtaaacccggaatgggtctcattattcccttctctgcaggtatcgattctaagaaggaatctctctgatcattgtcccctacttgtgaaatctgatgaattaaactggggtccaagaccctttaggtttcaaaactgctggttatctcaccccgggtgtttgcaaatcataaaggatgtgtgggcttcacatacctctgggaacctcacggataaactgaaggaaacaaaaaaaaggctgaaaatctggaactcttctgaattcgggcatattgatcgcaatatcgaggagcttgaagataggatacataaccttgatcttatctcaaatggcagagacctacaattagaggagttggctgaaagaagatcgtctcagatggaattgtgggtatggcttagaaggaaagaggctttctgggcccaaaattctcgtgcaaagtggattaaggagggggacaaaaacaccaaatatttccacactctcgcatccaccaggaaaaagaaaaatactatacctgctcttattactaacaatggtgttgtatctgaccctgcaggtattcatcacgaggcggtttcttttttcaagtccattttcaaagaggacttttcatctaggcccgtctttaatgggctccaattcagatcactatcctgtgagcaagtatcacaacttacggagccttttagtcacaaggaggtggacgaagcagttgaatcatgtgatccgcaaaaggcgcctgggcctgatggctataattttcggttcataaaggactcatgggacataatcaaactggatgtttacaatatcgtggaaaatttctggaattcgggctctctcccgaagggatcgaatgtggcttttatcgcactcatagccaaacgtgaagttccggagggtctaaatgactttaggcctattagtatggtgggttgcatttataagataatagcaaagcttcttgcaaggcgccttcaaaaggttatggactcactcataggtccataccaatcatcatttatagcggggagacaaattttggatggggctctgatagcgggggagcttattgatacatgtcggagaaagaaagtgcaactatcgattctcaagctagattttcacaaggcctttgacagcgtggcttggagtttccttgattggactttggataaaatgggattcccacccagatggaggatgtggatttcatcttgtataacgagtgctgctgcttctattctcataaatgggtcccccacggctcctttcaaattacatagggggttgagacaaggcgaccccctctctccctttttgttcgatttagtggtggagacccttagcctagttatccaaaaggcctctcacttgggtttatgggaaggagtggaagtaacaaaaaatggtgaaaaaattactcatctacagtatgctgatgatacgataattttttgccccccaaacttggattatctgctcaatataaaaaaaaccctcattttgttccaactcgcttcgggtcttcaagtcaattttcataaaagttccatcatgggcatacatgttgatgagatatggttacaagaggcggcaaatgctttattatgcaaagtgggaaggctccccttcacttaccttggtctcccaatcggggggaatatttcgagactagctcattgggatcccatcataaaaaaaatagaggggaaattggcatcgtggaaagggagaatgttatcgattgccggaagaattacactcattaaggcgtccatctctagtttgcctctctactacatgtccctttttccggctcctagaggagtgatagaggctatcaacaaattacagaggaacttcttatggagtggagagctgcgaaaatcctccctagcactggtagcgtggaatcaggttgtactcccaaaagaaagcggtggattgaattgtggtaatctgttgaataggaatatctctctactatttaaatggatatggagattatctcatgatccggaatcgttgtggcaaaaggtaatcaaggaaaaatatgggtattcgcacactacaacggtgcatgatctatgtatcccgaaagggagtggcccatggagattcatttgtgcaagtatcctaaatcacccatctgctcgatccttcgtgaaaacaaagctaaggaaagcagtgggtaatggtgtaaagacccttttttggcttgatacatggctaggggactctcctctaaagctgcgcttcccacgcctattcactatcgtggacaatcctatggcatacattgcatcctgtggctcgtggtgtgggcgggagtgggtgtggaatttctcttggagcagggttttcaggccacgagatgccgaggaatgggaagagcttcagggtctgctaggctcggtctgtttgtctccttcaacagacgatcgcttgatatggactcctcacaagtcaggtgcgttttcggtaaagtcatgctcaaaggaactgaccaatactgctctcaagccgcagtcaaaaatccgtatatggggaaggctttggaggggtttaatccccccaagaatcgaggttttcagttgggttgctcttttagggaaattaaactcaaggcaaaaactggccaccttgaatataatccctcctgatgatgcagtttgtattatgtgtaatggggcccccgaaacttcggaccacctgcttttgcattgtcccttcgcatcctcaatctggttatggtggctgggaatttggaatgtgtcttgggtctttcctaaaaatctatttgaagctttcgagcaatggtactgccacaaaaaaaacccgttcttcagaaaggtatggtgttcaattttttctatcatcatatggacgatttggaaggagcggaatgctagaattttcaggggaatctcatgctcctccaacaaattacaagatctagtgataatccgtctcatgtggtggattaagggatggggtgaagcattcccctactcaattgtggaggttctccgccatccccaatgcctctcatgggattatttgaaggctgctccggcagcaacggcggtctctgtagatgggatgctttggtccccgccaaatgatggtgttatgaaatggaatgtcgatgcttcagtgaatgcaggaaggtccgcaattggaggggtccttcgaaactctcagggaatttttgtgtgtgtattttcttgcccaattccttccatagaaattaattctgcagaaattattgcgatttatcgggcaatgcaaatctgctactcttttgaattcttgaaacgggcccctttggttcttgaatctgattctgcaaatgcggtcatgtggtcgaacgaaaacgagggtggtccatggaatctgaatttccaattaaacttcatccgcaatgcgaggaaggcgggactcaacatctccattgttcataagaaaaggagctcaaacgcggtggcggatgccttggccaagcaaggcttatcaaggaccgatgattttttggcatggctttgaaggatatagatgagaaaacctgaattgggggaagaattatatggggtcaatgcaggggcaagctggatcgagctcgcatgaagttttcgtccctagcacctggtttcattgctcatgttgcattcctattttatgtgattgtatctgtgttccttatgtgtactaatgggactatgtactgttgtaattgatgaattttgtggcttcctcctagtaaggtgtgttttttcgaaacactataaaagttctccttcatggagatacctcacttggagttgaatcctcaactttccggaatttaatggaatgcaaacaaattatcaaaaaaaaaagatcaaagtgtaataa

SEQ ID NO: 443 - DNA, 6637 bp, Beta vulgaris
aacaatttatatatattattataaaaatacccaaaacaaattagaacatgagagagagagagcgtattcctagagagagaaaccaggaagaccagtggacagtagttactcggaaaaaacccagaacccaccatagccaagcccttcaaacttgcttcatcaaccatctacctaaatacatcaccacatctgacttagccaagattttcagaacccatggagctataaacaacatacacatcccagaatcccaaacaaacccaaaccatttgtatgcttttgtccaattcgcctatcctcaatctcttgctacagctatcagggatgaaaatggcagattgattggtaagtcaagaattacagtcttcccagctaagtatgataaaaggcaacccccacccagacatcagaacacaacatccagccattccagaagacaaaacaaaaacccactccaccttagaagtgcaccaaaaatggcgttcatccaaagtgggaagtccttcaaagaagcagcagaggctagcaaccaaaagggacaaccaacacaaaaaaacccatcagaaaaaaccccaaacacaaaccacactctatccaaacctaacccgacaaaacatcgtattatgagttcaagagttctgggggaagacacagaaaagattcgaggagaactgggggaaatcgacttggaaagtgacatcgctgcggcaatgaaaggaaagatctgcgaagaaaacaaggaatggctagaaagaagctccattgccatctcacagaactttcaatcttcagaatcaatacttgaacacatcctagcagagggagtcaataatcttacaatcaagtcgatgggagggttacaacacctgataatatttgattccaaggaggataaggaatctatgattgaaagcgaatggttggggagatggttcatggcctttaaggatgtggacaagcagagcaaagcactttggagggagacgtggattagcattcatggagttccattagtagcctggggttatgataatttctatgatataggatgtgtttttggcaaagtcatatctgtacaatacaagcaacttgattgtgcgtacatcaaagtctgcactgattgcatgtttgacattcactgtaaaatttccatggacgtggatgacaaacaatatcacgtgtttgtatctgaaaaacaacaacagtggcagcaagaccaaaagcaaagtcagaaagctcatgaggaagtaaaggtcaaatcagccagtgagaatggaggaagcaaagggtctgacgaaccaaatccaggtaatgttcctaaccacgaaggtgacgaaccagtgacagctgaaccgaaaagtcatttcttgaacgatgaaccattaaatgcaacaaaaacagacatagaaaagcgtgcccttgaaaatcatgaacaacctctggcgtccaacagtcttaatcattcatcagaccacctagaaaacataaagctgacaaatgatgatgtcgactcaaataagtggaagcccaatcaccaactgattagaagtcccaatcatagccaatctaatcagtttacccaaaaaacccctgagccaacacagcagaccttttacctagacaaaccaactcaagaactccacaaaagtcagggtaaaagaaaaagcccagcccgcagcctatcattccaaaacaccattttctcaccaatcaaaactacaaacacctttgggccccttctcaggccaaacaaaacaaaagcctcctcttcctcaacattaggctccacctcctgttcagggcctctttttccacctggatttgaggagtccatcccaagtcagaccaagagagatcaagaaaaaagaagaaaaaggaaacttgaaagaagaaacaagatgagaaaagctctaacatatgttaaatcaacaagcccaaaaccttcgcctatccacttgcccaagtccattcagattgacgatgtgatacaaatggcaaacaccttaggactatcctttgatggtccagttgaagaattggagagaagaataggtgtgattctaacgaatcaaaaactcaactgggatgccaacctcagttgagtcagatcccaataatccagacaaacaaaaatactcatgataatgaagccgatcttatcatggaacatccgaggcctcaatgcaagaatgaagagagcctcactcagaaaactaatagcaataaacaacccaggttgcgtttttgtgcaagaaacaaaaatggagaatataaatgcaagattgatgagaacttgctggaaatcaaatgagattgaatggattttcagcccctctagaggcagctcaggtggaattctcgccatttgggacaaaaatatcttcaatgcaaactctaatgtcattcaccagagttggattgcgataagtggcatcttctcaactgaccagtttgaatgtacactcattacggtgtataatccatgtgaaatagcagcaagatcagaagtatggaagcaaattattgagttccaaaactcgaatccactaccatgtctccttgtaggagattttaacgaagttcttcgcccctcagaaagaggtagcctctcattctctcataatggtattaatgatttcaaaagctttgtgcaggaactaaagcttctggagatcccgtcttcatccagagcatacacatggtatcgagcaaactcaaaaagcctccttgacaggctcttagtgagccctgaatgggtctctcactgcccaaatattaaagtatcaatcctgcaaagagggttatcagatcattgcccgctgctagtgcactctcacatacaagaatggggaccgaagccatttcgcttcaacaactgctggctgacagatcccaagtgcatgaaaattgtggaagcttcatggagcagttcaccaaaaatcagtgtggttgaaaaattgaaagagacaaagaaaagactcaaggaatggaacctcaatgaatttggcagtattgatgcaaacatcagaaagctagaagattgtattgcaaactttgacaaagaagccgatgagagagagcttgacaaagaagaacttgaaaaaaggagagaagctcaggctgacctatggaagtggatgaagaggaaagaaatatactgggcccagcggtctcgaattacttggctaaaagcaggtgacaaaaacacaaagttctttcatgcaatcgcctcgaataagaaaagaaagaacatgatggcatgtatagaaacagatggacaatccactaatgatccctcacagatcaagaaagaagctcgggcctttttcaagaaaattttcaaggaagatcatgtcaagagaccaacccttgaaaacttgcacttaaagagactgtcacagaatcaagcgaacagccttattactccattcacgacagaagaaatagatacggcagtatcatcatgtgcatccgataaagctccgggtccggatggatttaacttcaaattcgtgaagagtgcctgggacattattaagacggacatttatggcatagtgaatgatttctgggaaacaggctgccttccccagggatgtaacacagcgtacatagcacttattccaaagattgacaatccatcaagcctcaaagactatcggccaatcagcatggttggtttcatatataaaatagtcgcaaaattattggcgaaaaggcttcaatcagtaataagctctctcatcagtcctctccaatcctcgtatgtgaaaggcagacaaattctagacggagccttggttgcaagcgaaattatcgagtcgtgtaaaaagaggaacattgaggctattcttctaaaactggatttccacaaggcatacgatagtgtctcttggaacttccttcaatggacacttgatcaaatgaattttccggtgaaatggtgtgagtggataaagacatgtgtaaccagtgcatcggcctcaattcttgtgaatggatcgccaactccgccctttaaattacatcgagggcttaggcagggggaccctctttcccccttcctttttgtgctcgttggtgaagttcttagtcagatgattagcaaagcaacaagtctgcaattatggagaggaattccggcatgttcaagaggttcagagattacgcatctgcagtatgcagatgacacacttatgttttgtgaagcaaacaccaactctctcaaaaatatccaaaaaaccctgatcatatttcagttagtatccggtctccaagttaacttccacaagagctcattaatgggcttaaatgtaacatcatcctggattcaagaggcggcaaattccctaatgtgcaaaattgggactattcctttctcatatctaggtcttcccatcggagacaacccagctcgcatccggacatgggatccaatcatagacaaattagaaaaaaagttggcatcatggaaaggtaaattgctatcactaggtggtaggctcactctcatcaaggcctccctctcaaaccttccgctttattatatgtctctctttccggtcccaaagggagtgatagaaaaaatcaataagctcatgcgagccttcttatggtgtggggactttggcaaaagacctttttctatggtctcatggagcatagttcaacagccaaaaacttcgggtggcctggggattggtaatattctacataaaaatctgtccctcctcttcaagtggatttggaggctttttgaaaatccttcgtcaatgtggggcagcattattcgctccaaatataattattcttcaacatgctcaatatctgacctaaaaaagccagtttcgggtgggccgtggaaatctatttgtgccgcagtcttgggccatgaaggggcgagattaattgcggtgaatggaatgagaaaaaatgttggtaatggcatatcctctcttttttggcatgacacatggctatgcgagcagcccttaaaacgcatagctccaagacttttctccattgccattaataaaaattcatcaatagcctcatatggagtgtgggagggcttcaactgggtttgggttttctcatggaagagagtattacgccctcaagacctagtggaaaaggcgcatctggatgaattactcaaatcagttagacttgacccaaatgcggatgaccagcttatttgggcccctgaaaaatcgggccgtttctctactaagtctttctcaaaagaattgagtaaaatgactcctccaactcactccgatgcagttaaaggagtatggcgagggcttgtccctcaccgcatcgaagttttcgtgtggatagcattgctgggtaaaataaattctagacacaagctagcggcgtttggaataatctcagaagaagaagacatctgccccctttgcgacgagggatctgaaacaagtgatcacctcctgttacactgtgttgaagcgcaaaagctatgggcgtggtggttagatatatggaaggtcaaatgggtcttcccctctagcctccttgatgctttctctcaatggaagtgtattaaaaagaaaagcaacttcttcaaaaaggtatgggctgcctctttcttcgtcattatttggaccatatggaaggaaagaaaccttcgtatattccacaattcatcatcaaacgcaatgaacctacaagaccttgtattgctaaggttaggatggtggattggcgcgtgggattgtagatttccatactctccaactgatattcaaagaaaccccctttgtcttgaatggagcgaccaaagggtatgtgctcagcttctgaaacagcagcccgaaaatgattcatgggtcccccctccgccccaagttctaaagtggaatgtggatgcctcggtgatcaattccaactcatgttctgcaattggaggaattctacgaaatcataagggtgaattcatgtgtgttttctcttctcccgttccgtacattgaaataaattgtgcagaaatcttagcaattcacagagcgattcaaatttcgcttcaatcggacaagacaaagaatgccaatctcctgcttgaatcagattcggccaacgctgtcatgtggtgtaatagcgaaagcggaggcccatggaacatgaactttcagttaaacttcataaggagcatgagaaaaaagggcctcaatatttcaatcacttacaaaggtagaagctcaaatgtggtggcagattcgttggcaaaacaagggcatcatcgcaaatccgaattcattgcgtggttatgaggggcgcaaaaggcgagccgtcggaaaattcatacaagtcttcgggcttggataagtcaggagtattgaaatctgaatgtatgagcatggagtaattcgtgtaaagttactttgcattgtaactggagtaaggtcgggttatatatccctcctagcagttttgtaatatgtaatattgaaggttaatgagaacttcctcaatcaagggtgtgctatgcactatgaaagtttccatctctggatggaatacccttccttgagtactagaggttttccttaccttcctttctttgagtaataaaactgctgcatcaaatatcaaaaaaaaacaatttatatat

SEQ ID NO: 444 - DNA, 6631 bp, Beta vulgaris
aactaagaaaagttccttagaaattatacaaagagagaatgtttagagagagaaagagtgagaaaccgagagagtgggagcctgcgaggagccaaggtcgccattcgagagaaagagaagcagacgaatggatcacagtaaaaaggaagaatatgagaccaaaaccatacccacccatagcctgcaaaaccatctttatcaacttccttcccccagaaacccatcctcaaacactggtagacatctttagccactatggagacatcgctgaattatcactgccccatagaacccgaaacaattgtaaccatcgttacgcctttatcaagttctactctactcaggcagtaatcaatgcaatcagacaggagaatggaagaagaatagggatgttcaagataaaggttaaccctgccaaatatgataaaccttatatgagccaatttcatcgccccatccaccatcgcccacacaaactaccccctgcaaaaaccttcctttctcacaggaacccagcatggagggaccatagatcttacaaagaggcaaccaacccaaataaagaaaaccaaaacaaaactttcccaaccacaaaccctaaagaccaaccacaggataaacccttccagaaatcccctgaaccatcctcggatacaaaatatgataacctaattcctaaccagattcttgaacctatcccgcaaaacctaattcgagaaatgagttcaaaaagaatcatgagttcgaaagtacttggagaagcaacagagagagtcagggaggaaatggagataggtgaaatggatggagaacagtacttatggatcaaagggaagaaaaacccagaactggaggaacttctaaagcgaagtgtaatagcagtggccattgccccctcaccttcctcaattattttggaccacatactggcagaaggagtttcttgcgttaaaattaagcctttaggggggctcctccacttgctttcttttgacagcatcgaggacaaaaaagccatggtggagtgtcaatggcttcaaagatggtttgtggagattcgagatgtgtcggagtccaatgctgcaatttggcgggagacatggattacaatatatggtgttccaatatcagcatggggatatgaaaattttttcgaaataggaagcatatacggaaaagttcaatcagttgattattccaggatggattatgctcgagtattggtaatcaccgactgtttctttcaaataaatcaccctgtcttattcagtgttgaaggaaagaatttcaaaatatacgtctctgaggagaatggattccaatcgaagtatgtacagccggggaacggaatctcgccggaaacagcccaactgcagatgaaagattcaagggggaagggagttgaagcatcaattgaaaaacccagtgagagtcctccacgtggcatttcagaggtaagtccaataaacttgggaactgatgagagacaacacaattatgagataatgatttctcccactaaaacaaaaacccctagcccaccctcgaaaaaccaaaagccgctcaaatatccaaatcaatcaaaaactcaactgattttcaattccccaatgaaatcccccataagccagagtagtcagaggaacttgatgaattcccatgcaaataaggacgttcagtctctagaaaacataattctttcatctcccacctttgtagagcagcccgctgccttgggtgacctgggccctaatgaggggtcaaccaaaatggggctggggaaaaacttctcttttcaatattttaacccaacactgaacacccttgatttatctaaatcaccaaagcccatcaaacaaaaatctaccccatcttcgcctattccaacaaccaacctggatcaaactcaagtagcccaacccaattatagcttccactatgttaatcccacaattccaacctcgaataacttctttcccctggtgagaccttcccaaaaaacttcaaccactaactcattttcctcttctacctcaacatcgagcccatctataccaccgggttttgaagattacataccctctcctttgaagaaatttcgtgaacaaaggaagatcaggaaaactcaaaaaaagaaaatgagaaggcaagcctcagtatcatcccaaacaccccatatctcccacccagctcatgaccaaccagacaaccaaagaaaaacaattgcaaatgaaatcattgacctaggcctcaagctaggaatgaattttaaggggcccttgtcagaattacatgatcggatcatggacatcttggcccgacaaaaagaggattggcaatccaatccatgaggttattcctcaactctcataaaacaagccaatgttactcttttcgtggaatattcggggcctaggggccaagatcaaaagaaatgtacttaaaaaatcattgctcacttatgagccatggtttgttttcattcaagaatccaagcttgaatcaatctcaggtataatgatgaaaacaatctggaataacagtgacctggaattttgtctcagcccttcaataggaagttcaggaggaatattaactttatggagggcttcaaagttcagaatggatttcagtaggtgtgaaaggaattggatcgcagttggagggtgtgtactttcctcagattttaactgccttcttatcaacatctataattcttgtgacgatgtgataagagaggaaacctggaattctttgttcgaattttgctcaaactctaatcttccatgcttaattgcgggagacttcaatgaagtcttatcctcgaaagacagaggtagtcaccagatagatgaatcaagctccttgaaattcagaaactttataaacaaccttcgactcattgaagtttcaccagtggaagggtggtacacgtggttcagaggcaactcgaggagtaaattggatagagtgttggtccaggccgaatggattgaaaaattccctgcgcttgcggtatcaatacttaatcgcagcatatcggatcactgtcctcttcttctccaatcctctattgtagattggggccccagaccatttaagtttcaagatgtatggctctctcataaagggtgcatggaaatcgtcgaaaaggcatggatacagtcgaaggagttgacgttaatgcagaaactgaaaaaggtgaaattagatctgaaaacatggaactcggagagctttgggaacattgatgcaaatatcttactcagggaggccgaaatccaaaaatgggactctgaggcaaattctagggacttagaaccggaagagattaagacgagagcccaagcccaactggagctttgggagtggttaaaaaagaaagaaatctattgggcccagcaatcaaggattaaatggctcaaatctggtgaccgaaacacaaagttttttcacatctgtgcgtcaataaggagaagcaaaaacaacatatcttccatacttttacagggcaaaaagattgaagacccgatcataataaaagaggaggctgtgaagtatttcaaaaatctcttcactgaagatttcaaagagagaccaacattcacaaacttgagttttaaaaaactctcagaatcccaggcatttagcatcagtgctccgttctccacaacagaaattgatgaggcagtggcctcatgtaacccatcgaaatccccgggaccggatggttttaatttcaaatttatcaaagcatcatgggatcttatcaaacacgacttttacagcataatccaagaattctggcataccgggattctacctagagggagtaatgtggcgtttattgccctgattgcgaagattgaatccccttcgggattcaaagacttccgaccaataagtatggtaggatgtgtgtacaagataatttcaaaacttttagcaggaagattgaaacaagttatgaatgatcttgtggggcctcatcaatcctcattcattgaagggcgtcagatattggatagcattcttattgctagtgaactatttgaatcttgtaaaagaaggaaaaaggcaactgtcatgctcaagatcgactttcataaggccttcgattcggtctcatggtccttcttggattggacccttagtcaaatggggttccctcctagatggaaaaaatggatatcttcgtgtgtctcatcagcggcggcaagtgttcttctcaatggctccccttctctccctttcaaacttcaaaggggtctccgtcaaggagatcctctctctccttttctctttgtcctagtggtagaggttatgaatctcatgataaaaaaagcggaatcactgaactcatggcaaggaattgaaattacaaaaaatggacccatactaacacatttacaatttgcagatgatacgattctttttgctccccacaacatggaagctttggagaacattaagaagactttgatactttttcaactgtcgtcaggcctgaagatcaacttccacaaaagcgaattacttggcatcaatgtaccgcaagactggatgcaaagagcagcaaaaaatctatgttgtaaggtgggctcattcccaattacatatcttggcatgccggtgggtggaagctgctcgaaactatctttctgggatcccttgatcgaaaagataagcaagaaattgtcgttgtggaagggcaacttgttgtccttgggaggaaggctcacactaatcaaagcgtcgctattaaatctcccaatatattatatgtccttatttcccatgcctcaaggagtaattgataaaattactcgaattcaaagaaactttttatggagtggtggattaaacaagaaatcgttggcactcatcaaatggtcttacgctcaattgcccaaaatcttcgggggtctcaacattggaaacctcttagcaagaaatttgggtctcctttttaaatggatatggcgatattttcaggaaccaaatgcattgtggaggcagatcattgaagctaagtatggatacccgaaagaattatgcatctctgacttagagcttttgaagaatgggggcccatggaagctaatatgcaatagccttttaaaaaaggaagaagtgagagaactgattaatcaaggcttaagaatgagggtaagtaatggagagagcaccagattttggcacgacatctggatagataattcagctttgaagtttcaatttcctaggcttttcttgattgcggagcaacctctagctgtggtatcctcaatgggccagtttcagggcaacgaatggcgatggttaatcccttggtccagggagctcagatctagagaccaagtggaatgggaaactctttgttcacttcttcagaatatcaagataagtaaggaaggagaggatgtcttgatatggagacatgataagtcaggtattttttcggtcaaatcgttttattcgaagctctctcaatcatctggtttaacagtagaaagagtggtgcccaggctgtggaaaggccttgtcccttatagaatagaagtctttttttggctagctctattagaaaggattaacacaaagaacaagctatcgcgattgggtatcattcctcctgaggataccatgtgccctttatgtagctcatgggccgaagatgtggctcacctatttcttttctgtccttatgcaagagaaatttggggatggtggttgaaaatttggaatttgaattgggtctggccttcctctctggtgcttgcatttgaacaatggtcattcccaagtgcaaataaactattcaagaaagtatgggcagcgtcatttcaaatcatagtttggtcgctatggaaggaacgtaatgcccggattttcaataataaggctagcccagctatggaaactcaaaatttgatattagtaagaatttgttggtggatgaaagcgtggaaggaatcctgtccctacactgtggaagaagttttgagaactcctcattgccttcaatggggaggagccttacagcagcatcgcagatctcatattggatcaaagccatcttgtacacaagcaactctagtatggaacctgagtgccttgtactttccagactcgctcgatgatcttcaaggtggagttattgggggttttctatcggatgagaacaagaagatactgtgcatattttcatgcccatacccgcctatgaatcctcacgctgcagctacaatagctattcatagagcaatccagatctcaattagcaacaaaagtttcaatgggaagagcatatgcttcagctcggcatcaaaagaagcaattcgctggtgctcctatcctagatcgggtcctcctaatctgcaatttcttctaaacttcattcgatcatctcataagaaaggaatcacagcaatgttctcatggaatgaaggctgtggaaaagaagtcaataacattctttcggccaaaagaatttctcgtttctcaaatgttgtaatttggatgtaacgtagaacccctaaatggcttccattagtttttttctaagacgaatgtaatggattactaccattaatcaaatgatcaaaaaaaaactaagaaaagttcctta

SEQ ID NO: 445 - DNA, 6609 bp, Beta vulgaris
aaatctgtatgtacaacaatcataaaagatgatgagagagaaagagagagaaaaccctcctagagagagaaacaacaaccaacaatggtcagtggtgtcgcgaaagagaaccaagcccccacaagctcaggccaccagaacatgcttcataaaccacctaccctcaaccttctccatatctgatattgcaaaaatcttccgcagccatggcgccatcctctacatcaacatccctacaacccagaaacatccagactacaaatgtgcctttgtgcaattctattacccccaatccctcacaacagccatcagagatgagcatggcaagagaattgaagggagcagaataacagtgttcccagccaaacaagacaaacctgtcccgattaaccaccataccaaaagttcccaccaaacacctcgagaaaatcagccaagcagacataaccaagtgaaatatgcagtgaaggataatcgttcctacagagaagtcactcaacccacaaagccaaaagagaaaatcaacagtcacatgaaccacattaaccctcacatcccaacccaacagccctacccacatgaagactttgtgtctatacctaacaccactaaccctcaaccatcacaacacagaataatgagctcaagggccctaggagaacacactgagaaaatcagaaactcactaagtgcagttgagattgatggggaatatgcagcagctctcaaaggagctccttgtacagaaattactgaaatgctacaaagaagcgcggttggagtggcatcatcatctatgtcatcaaatgaaatcctaaacctcatccttgcagaaggagtaaatggcttgaaaataaaaccaatggggggcatgctacacctcataacttttgatacttttgaagagaaaaaaagcatgatggaaagtcagtggctattgcagtggttcatgacaataacaaatgttaatgatcatagtacgaccttgtggagagaaacatggattgccatctatggagtccccttatttgcatggggctatgaaaattttcataacattggaagcgtaatgggaagagtaatttcggtggaatatagcaactatgactgtgcaaagatcctcatcttcaccgattgtctgtttgacatcaactgcaaggtgtcattaaaaattgcaggggaaagctaccctatttttgtcacaaaggaaaaacaaatctggcgacaagtgtcaagttcagcacaaaatgtcaaaatcacgtccatcacatcagatgaatcaaaccctacagaatcatgcaaaggtccgcccacttatcagggagaagcttctgatgttgagaattttaaaagtcacaatcagaatgaaaagctgcaaattgacaactgtacttttcttgaggatagtgccaaaatagtaaatgaacatatcccccacaaaaacctgtcagattccccaagtttgacacgtgagataatatgcaccagttccccaaatcctgaaaatgtcaatcataatactatcataaatcaatcacagccgccaatgcatcatccttctgttcaccttctcagccccctacctgaaacaccacaaagtagaaacaggaaaaaaaagaaaaaaacacaaaccaagcctaaaaaaatcagaagcccagacaagcccaaaaacactaaaatccaatccacagccacacttaagacccagccacctataaccattatcacccacaacaaatatgggcctctgatccgcccagccaagtccagatcctcttctaccatccagagttcgtcctcctcctctggacctttatttccaccaggctttgaaaaatttatcccaaaccacatcaaatcagcccaaatagaaaaacggaaaagaagactagagaaaaagatgaaaatgaagcttgcatcttccatacccaagcctagtcagccccctccaactaacctgcaccttccaaactccatccaagctgatgatgtcattaatatggcaaacactctaggccttgtttatgaagggcccatgtcagagcttagagagcgaatagatgcaatcttagctaatcagaaacaaagctggtctgcgcaccaagcctaatcccatctctctcattacaacacaatatgatccccatgtctgtcatatcatggaatgttaggggcctagggagcagggccaaaagaagctccttgaggaaacatatcaccaaacatgaaccaacttttgttttcatacaagagactaagatggaggagatgcccgaaaaaataatgagatcaatatggaaatcagacaatgttgagtggataatcagcccatctcaaggaaattctggagggattctatctatctggaacacatctttctttgcaaaaaaatcaagcataatcaaaaggcactggattgctatcaagggatcactagtctcacacaactttgactgtatcctaatcaatgtgtataattcatgcctagcctccattagagctgaagtgtggactgaaatcagggacttctggaaggaatgcgcattaccaagtctcataattggagacttcaacgaggtcctcaactcatcagaaagacgaagcctaattgcgtcgcaatctgagatgaccaagttcagggactttgttcaaaacttgcaacttttagaaatcccatcatcatctggtggtttcacttggtttagaggtaattcaaaaagccttctagacagattatttattaatccggagtggctgattttgttcccaggtctcaagttatcactccttatgcgcgggctatctgatcattgccccttactcgttcacaatgaggataaaaattggggtcccaaaccttttaggtttcaaaattgttggctatcggaccccaactgtttaaagattgtaaaagaagtgtggcaagcatccagtggagtctccgcagttggaaaactgaaagcagtaaggaagagactcaaagtctggaatcaagaagagtatggcaatattgacaacaggatatcaaagatggaaaacctaattcaacaatatgatgaaatctccaatcaaagaatcctaactgaggatgaacttgaagaaaaacaaaaggctcaggttgaattatggaaatggatgaaaaggagagaagtttactgggcacaaaatgcgcggatttcgtggcttaaagaaggagaccgaaacacaagattctttcacactattgcttcaaacaaaagaaggaaaaactcaattatatgcattgaagtgaaaggcaaagaatctggtgatcctcaaatcatcaagagagaagcagtatcccacttcaagaaaatctttgcagagaacaattataacagacctaccttcaagggtctaagcttcaggcaaatcacagatgatcaagcatccgatctcacacaacccttctcaaacaaagaaattgatgaagcagtttcttcgtgcgctgctgataaggcgccgggcccagatggtttcaatttcagatttataaagagtgcctgggaaacggtaaaatcagacatttatgcaatggttcgtaaattccatgattcatctaccctccctcaaggatgcaacatagcatatataacactcatacagaaaatcgacaacccaaaaaatttcaatgactatcgcccgatcagtatggtcgggtgcatctataaaataatagccaagctgttggctagaagattgcaaggtgttataaactccctcattggaccgctacaattctcatacattgaaggaaggagtatacttgatggggcactaattgccagcgagttaattgatcactgcaaaaggaagtccattgaggctgcgcttctcaaactagattttcataaagcctatgattccatatcttggagtttccttgaatgggtactcaaggagatgaactttccagatcagtggtgcaaatggataatgaattgcgtatcaacggctgcagtatccatcttagtcaacggctcaccgtgtgctcccttcaaactccagcgtgggttaaggcagggggatccgctgtcgtccttcctctttgtgctaattgctgaatccctaaatcagattatcatgaaagcgacttctcagaacttatggaaaggagtagaagttgggcagggtgagataattgttacccatctccaatatgctgacgacacccttattttctgtgatgccaatattgaatctctcaaaaatgtcaaaaaagccctcatattatttcaactcgcatcgggcctgcagataaattttcataaaagctctctgattgggcttaacacttcaagtggctggataaaagtggctgcagaagcattgttatgcaaaattggtgaaatcccttttacctatcttggtgttcctataggaggtcaatgctcaagaattcaactatgggacccgattatagcaaagatctccaggagactagcaacatggaaatgtaagatgctatcaattggggggaggcttactctaattaaatcttcattgattagccttccggtgtatttcatgtctatttatcctatgcctcaggatgttgtcaataaaatcataggccttgcaaggcaatttctatgggctggatctgacggaaaaaatgcaatgccacttgtagcatggagcgtacttcaattaccgaaatcactgggtggaatggggattggaaacataaaacacaagaatcaagcgttactgttcaaatggatatggaggctctttgatgagccatcccaattatggtgcaaaatcatccgagcgaaatacaaatacccgaacactctcaccatttctgacattaaaattcccaatgcaggtggtccatggaggtcaatatgtgcttcctatctccgaaatcaagatgtaaaagatatggctatcaagggagtaaggaaaaatgtgaagaatggccatgactccctcttttggcatgatgtatggattggggaggctactttgaagtcactttttcctcgcctcttcacaattgccatgtccccaaatggatcagtcgcatcttatggattttgggatggcctagcgtgggtatggagcttctcttggcgcaggatgcttaggccccaagatctcattgagaagacccatctggatagtcttcttcagcaggcccatgtagcatatgaaaagaaagatcaactaatatgggcttatagctcttcaggaaaattctccacgaagtccttttctttggaggtggataaattaagcccccctcctcaccatgatgcaattaatggagtgtggcgagggcttgtgcctcaccggatcgaaatatttgtatggatggctcttctagggaaaataagcactaaacacaagcttgcgaaaattggaattattccaaaagatgatgatatatgtatcttgtgctcgaattcatcagagaccagcgaccatcttctccttcactgcaattttgctagatctctatggcactggtggttctctctatggaatatccaatgggttttccctcataccctaagggaggcttttgatcaatggcaaaccaggtcaagatgtgttttcttcaaaaaagcttggctcacaatttttttcatcattgtatggtcggtttggaaggagagaaactctagaatttttgaaaaatcagaaagctccgtaaaggacatccaagacttgatcttgctccgacttggatggtggatcaaaggatggtgtgatgaatttccgtactcacccaatgatgttttgcgctccccctcgtgtcttatatggaatggtgcgaattctctcatgcaatatccaaagctgcagccatgtccaattgtttggactccacctattgaaaattttctcaaatggaatgtggatgcctcggctaatccattgctctctacttcggccatgggaggggttttgcgcaatagtcaaggtaatttcatgtgcttattttcatcccccattcctttcatggaaataaattgcgcagaaattttgggtatctatagagcggtcaagatatcaatctcttctgattgcatcaaggaaaaaaatctcataattgaatcagactcagcaaatgcggtctcttggtgtaaccaagatgagggtggcccctggaatatgaatttccagctcaattttatacgaaatgcgaggaaaaagaatctcaggttaacaattactcatgaaaggcgcagcgcaaactttgtagcagactcaatggcaaagcaagggatacatagacaatctgaattcatagcttggatgtgaagtgggatatgatcttcctttggtcctgccaactcatgttttaagtcatgttgtttttgtttctcttcgagttttttagtttctgtgataggaatcaaatgttgagactcatgtatgtgtttttctgtattgtatcatgtacttctatctcaaaggttgaaaggtccctcctctctttgggtgtgcttggcactatgaaagttttcacccttgtggtgaaatacctgatttgagtactagaggcttctttcacctttggcccctactgttaataaaatggcaggataaattatcaaaaaaaaatctgtatgtacaaca

SEQ ID NO: 446 - DNA, 457 bp, Chironomus alpestris
acttagctcaataagcaaaatactggagagagtattgctatacagaatcaacgagcatctcgaggataataacatcattccaagtcagcaatgtggcttccgaacaggaagatcgacatctcaccagctcatcaaagttatcaaaacagcaaaagaaaacataaagaacaaaaagtcaacaggcatgatcttcctagatgtggaaaaagcatttgacagagtctggcataacggactcttgtacaaaatgctcaaactgagattcccactgccacttataaaaactgtaaggtctttcctaagtgaaagaactttctcagtttttattaaaggtcagttctcagacatcaaggtaatcaaattcggagtgccacaaggagcagtgctttcaccaactctctacaacatcttcacgcatgatattgtaagagagacaaccaacaatatcgcactcttc

SEQ ID NO: 447 - DNA, 6422 bp, Beta vulgaris
aacatggaatgaaagatagtaggattaagctgtttaagagagatgagagattctagagagagaaagagcgtcttccaacttgaacagccatggaccattgtcaatcgccggaaatccccagtcaaatctaccccagcctccaaaacttgcttcattgatttccttccttctaacatttgccattacgacctagccaaaaccttcggaatctatggagctatcaccaatatccatatcccagaaaagctcagaccaaattgccaacaccgcttcgctttcatccgcttttcaacgtcggaatctttagagagagccattcatggagaaaatggaagaaaactcaaaaatggtagcctcagggtatttgcagctaagtatgactctcgtcccccaaagaccagcctgaaacaaaaaactttcacaaaaccatctcataccaaccccatgccaaccaacaaaaaaccatatcaaaggccatcatacaaccaattctcgcctcttgttgataacagatcttataaagatgccaccatcactccaaatcctaatcctccaaaccctaatcctcaatgtactccaactggtaacccccaacctggaccctctgtaccctcacatgtatcgaagcgccaaccaatccctctccaagaccctgagcctgctccggactgttttcactttgaaccatgctcagctaagagattatcttctcggttgttgggggagagtgtggaaaaaattagggatgaacttgaagtagataaatttgaaggggaagacttgatagccattaaagggtcgagatttcatggaaatgatgaattattcagtaggagcattgtagctgtatcttcgtcatcacaatcctctactcaaatccatgatcatattcttgctgaaggtgtcacttgtatcaccattaaaccaattgggggccttcaacatctggtcacattctcgtcaatggaggacaaattagctattatggaaagcaaatggctcgaaaattggtttgatgacatgagagaggtatacgactcctgtgcagcaaaatggaaggaaacttgggttaaagtttacggagttcccattaaaagttggtcatatgaaaattttttcaatatcgggaatgtgttcggaagagtcttgtcaatcgaatattctgggtttgaatatgccaggatacttctcctcacggattgccttttcaatattaactgtaagatgatttttcagcttgaagggaaaaattcgagaatttttgttgcagaagatgtcaggcaccatgtgcaacctgtcatctctgttcctcacaagtccccgccgccatcagttgaagaatctaaagggtcggatgaagatgacatcaacataccctctttctccactctcaaggtcagcaaatgcaacctttcctctccccatgacaagaatttaattgaagtaacacaacctagtcaaaacactggttacaacattaatgcggctgatgactgtgaaaaaggtgcgccaatcattaatgcaatcatcacctctgtcccatctgccccctcagctactagattctctcctttgggccataagccaaataacgaccttcaccaccaagcccaaattatttccccacctcatgaccaaaagcccccctttgggcccatacccatctctcttagctcctctcctatcactactcaaaatagatttgggcctttattgccaaacactaaaccacagctaaattctcaaacctcctctacatcctccctttcatcagggccaatgtttccccctggtttcgaaaattctatcccaacagcggccaaaagacgtcatgcccaaaaaagaatccgaaaactacagaaaaaaatcaagaaaaaaacaaaaacaatcacttcttcttcctcccaaccttctcagccttccccctcaatcattacatcccaagacgttctaaaacttgcctctgaactcggacttcgtgttgaaggtccactctcgtgtattgaaaaccttatcactgctatactaaaacgtcaaaaagaagactgggacgcatctctccagtaactttttgcttcttccaccctccaaaaaatagtaaccatgtctttgttatcctggaattgccgaggaattggcgcacgtgaaaagcgctctcaaaccagaaaattaatcaatacacacaaaccttccttcctcttcatccaagaatcaaagtccgaaaatataaaccccaaaatcataaaaaccatttggcataatgacgatatcgaatggcttttcagcccatctgttggtaactcggggggacttatatccatctgggaaaaatcggccttccaaatggaatcatcccacatccagagaaattggattgccattcaaggaagtatagtacatccccgcttccgatgccttctcattaacatctataatccctgcaacattgaagggagggcggtggtctggaatgacatctcggaattctgtagaatcaacatctttcccacccttattatgggggattttaacgaagtcctttcatcctctgaaagaggcagtgggctctcatctcaagaaggtgtggaggatttcaggaactttatccaatctttgggcctaattgatatctcatcagcaaatgggcgcttcacatggttccatggtaaccgtaaaagtaggctggatcgctgtttagttacatctgattggatccaacagtatccaaatctatcactccaaattctcaaccggacagtctcggaccattgtcctatcctagcccactccccagctaccaattggggcccaaaaccttttcggttcttgaactgctgggtctctcatccgaatttcctgcctacgatctcattagcctgggctaatgcccaaaacctcccattacccgataaactcaagcaattaaaactgaagctgaaagagtggaataaatcggaatttggagcaattgataccaagataaaagaactcgaagaccttatccaacactttgatgatattgcaaatgatcgtaccctttcagattctgaattggactcgaggaaatctgtgcagatggatttatggtcctggctgaaaaagagggaagcctattgggctcaagtctcacgctcaaaatggcttaaagagggggacaggaataccaaattttttcatacactagcctcaatccgaaggcaaaaaaactcaatctcttcaatacttattgataatactaaccttgttgattgtgcaggaataaagtctgaagcagtttcatatttccagaaaatctttcaagaggacattaagaacaggcctaaatttgaaaaccttgagttcaaaaagctgattccttctcaaaccaatatgctgtgtgagcccttttcacttgatgaaattgatgcggctgtcgcatcttgtgatggcaataaagctcccgggcctgacggatttaattttaattttataaaatctgcatgggaagtgatcaagcaggatgtgtatgacatggttcgaagattttggaatacaggctaccttccaaaaggttgcaacactgccttcattgctctaattccgaaagttgagtctcctatgagtttcaaggattacagacctattagtatggttggatgtgtctataaaattgtctcgaaaatacttgcaaggcgattacaaagggtgatggatcatttggtgggaacccttcaatcgtcctttattgggggccgtcaaatccttgacggagctttagtagccggagagattattgattcctgtaaaagactcaaaaccgaagcagttcttctaaaacttgactttcataaggcattcgacagcatttcatgggattatctggattgggttcttgaacagatggggtttcccgatctttggcgcgcatggatgaagtcatgtgttatgtcagcctcagcttccatcctgattaatggatcaccaactcaacccattaagttacagcgaggtcttcgccaaggagaccctttgtccccttttctctttaacttggctgttgaacctctgaatctcctcatgaagaaagggctaaatatgcgattatgggaagggattgcctctcgacctaatggatacattatatcgcatcttcagtatgctgacgatacgattatattttgccctccttctatggaatacttatgcaacatcaagaaaaccttgattgctttccaattagcatcgggtttgagtgtcaactttcacaaaagtgctttgtatggtattaacgttgaccatctatggctcgaaaccgcagctaagacactactttgcagaacgggctcgcttcccttcaagtatcttgggcttccaattgggggcaatctatctagaatcgacacttgggatcctattgtggataggatgggaaaaaggttagcaacttggaagggtaaaatgctctctatcggggggcgtattaccctaataaaagcctctctttcaagccttcctttatattttatgtccctcttccccatccctaaaggggtcattgataaacttgttagaattcaaaggaactttctttggagtggagtggaaggaaaacgggctcttcctctagttgcatgggaaaagttggagttgcccaaaattcttgggggtcttggaattggaaacttattacaaaaaaatgtggcattgctctttaagtggatttggagactctttaatgagcccaatgcattttggagaggtttcatttgggataaatatgaatatcctcaatccctctctttccatgatcttaaaatcccatgtaatggtgggccttggaggtccatttgtaactcggtgctcaaacatcccactgccagcttatttgggctgcagaagatacgaaaaaatgtgggaaaaggcacccaaactgccttttggcaggagatatggattggtgagctcccattaaaaaccctcttccccaggttataccggctcacaataaatcctctggctacaatatcgtctctggggatctgggatggccatgaatggcactgggtcttgccatggcaaagagcccttaggccgcgggacattgaagaacgtgatgctcttcatgagctattaaaagacgtggttcttgatctcacaaatgatgactatttagtgtggactccaaataaatctggagtgttctctgtcaaatccgcaactctagaattggctaagtgctccaaattttcatctcatgaaattatcaaggggatatggaggggtttagtaccccatagagtcgaaatattctgctggctcgctcttttggaaaaaataaacacaaaatcgaaactggggcgaattggaattattccaattgaagatgctgtatgtgtattctgcaacattggtcttgagacaaccaatcatctcctccttcactgtgagttttcttggaagctttggacttggtggctgaacatttggggatactcttgggcttttccgaaatccataaaaaatgcctttgctcaatggcaaatctatggtagaggagcatttttcaaaaaaatttggcatgcaatttttttcatcatcatttggtccctttggaaagaaagaaattccaggattttcaataattctaattcttctttggaggaaattcaagatctaattctaacaagattatgttggtgggttaaagcttgggatgatggcttcccattcgcatgttcggaagtaatccgcaatccagcctgtctcaagtggacacaatccaaaggatgcaactttggaaccattgggccaacaaatttattaaaagcagcatggtctcctcctccctcaaaccacctccagtggaatgtagatgcgtccttcaaaccggggcttgagcacgcagctgtaggtggagtattgagggatgaaaacggttgctttgtttgtctattttcaagccccattccgagattagagatcaactccgctgagatctacgctattttcagagctctcaaaatctccctcagctcagaccgaatcaaggcccaacatcttataatagtctcggattctgccaatgcagtgagatggtgtaatcaagatgaaggagggccttggaacctcaatttcatgatcaattatattcgtaatgcaaggaaagcatggttagcattaaccataatccacaaaggcagagagacgaatggagttgcagataccttagcaaaacaagggttgagtagatctgatgagtttttagcttggttataacttctctcatgtactctctctctatattctgctctagagttttctgggttctctccaatgctttcataggcggatgatgtattactgatgtatcgagtttcataagccagtaggcacttaaataaaaaatctccaacaaattatcaaaaaaaaaacatggaatgaaa

SEQ ID NO: 448 - DNA, 1030 bp, Bacillus rossius
aacgactatcagttcgttgaataggcttgatattgcggttcggtccactgtgcgcaagtggctgaacctaccgcattatgtgcccagcgcgtatattcacactgacgctcgggatggaggcctttccattctctcctatcgttggacagtccccctgcagcgcctcaataggctgaaggccctttccatcctttgtggtgagggagggcccgatgaaatggttgtgtctgtaggggaagagatcaagcgggcaagtgcctgcttatatgatcaaggtacgaccatcagtacccgtaatgcctacagagttcgctttgctaggttattacattcctccaacgatgaagcacctcttaagggatcaaagcaggtggaggaccagcaccggtggattaccgatgggtctctcatgttgtcaggtcactcattgcttgcaataggatcaggatcaatgccatcctgctcaggaagcggactgctcacggacttgtccgtgacacccgttgccgggcaggctgtgacagcattgagacacatcatgtgctagcaatgacatcagacccatgacatgcgactcaaaaggcacgatgaatgtgtgaagtaattactagaccagcaacgctctcgcggtaaaacagtggtagaggagatgcatttctgcacggcagaaggccttttgaagcctgactctgtcatgctttatgacacgactactggggtagttgtagatgctttggtggatggagaaaagtcagatttagaccaagagcacgaccgtaaggtcagcaagaatgaaccactggctgatctagtaaagtaccgtactccgtcgaaaaggtgattttatcttccctcacaatcagtgcgcgaggtgtgtggggaggaaaatcattcaggcatctatcaaagcagagattgcttggcatctctgatgccaagaccttgtcaacccgagttctgctaggggataggggctgtacgagttttcaatcgccgtacagctttaggtgggagggcctttggctggtga

SEQ ID NO: 449 - DNA, 413 bp, Oreochromis niloticus
  modified_base (8)..(8): a, c, g, or t
  modified_base (163)..(163): a, c, g, or t
ctggaagncccaagatcaaagtgggacacgcccacaggggtgatggagaatgaccgagctaagatcctgtgggacttccagatacagacggacaaaatggtggtggctaaccaaccagacatagacaaatagaagaagacgtctgtagtgttagatgtagcgnttccaaatgacagcaacatcaggaagaaggaacatgagaagcttgaaaaataccaagggctcagagaagagcttgagaagatgtggagggtgaaggtgacggtggtcccagtggtaatcagaacactaggtgtgttgactcccaagctagacgagtggctccagcagatcccaggaacaacattggagatctctgtccagaagagtgcagtcctgggaaaagctaagatactgcgcaggaccctcaagct

SEQ ID NO: 450 - DNA, 421 bp, Oreochromis niloticus
  modified_base (192)..(192): a, c, g, or t
ctggaagtcctgaggtcaaaatgggagacgcccccaagggtggtggagaataaccaagctaagatcctgtgggacttccagatatagacgcacaaaatggtggtggctaaccaaccggacatagtggtggaagagaaacagaagaagatggctgtagtgatagatgtagcagttccgaatgacagcaacatnagaaagaaggaacacgagaagctggagaaataccaagggctcagagaagagctcgagaggacgtggagggtgaaggtaacggtggtccccgtggtaatcggagcactaggtgcggtgactcccaagctaggcgagtggctccagcagatcccgggaacgacatcggagatctctgtccagaagagcgcagtcctgggaacagctaagatactgcgcaggaccctcaagc

SEQ ID NO: 451 - DNA, 422 bp, Oreochromis niloticus
ctggaagttccgaggtcaaaatgggagacgcccccaagggtggtggagaatgaccgagctaagatcctgtgggacttccagatacagacagacaaaatgctggtggctaaccaaccggacatagtggtggtagacaaacagaagaagacggccgtagtgatcgatgtagcggttccgaatgacagcaatatcaggaagaaggaacacgagaagctggagaaatgccaagggctcagagaagagctcgagaggatgtggagggtgaaggtaaccgtggtccccgtggtaatcggagcactaggtgcagtgacctccaagctaatcaagtggctccagcagatcccaggatcaacatccgagatctctgtccagaagagcgcagtcctaggaacagttaagatacttggcaggaccctcaagct

SEQ ID NO: 452 - DNA, 422 bp, Xiphophorus maculatus
ctggaaaccccgggatcaaagtgggaaacacccccaaaggtggcggagaacgccagagctaagatcctgtgggacttccagatccagacagacaaaatggtaatggcgaaccaaccagacattgtcgtagtggataaacaacagaggaaagccgttgtgatagatgtagcaataccaagcgactgcaacatcaggaaaaaggagcacgagaaactagagaaataccagggcctcagggaggaactggagagggcctggaaggtgaagaccacagtggtgcctgtggtcatcggggccctcggggcagtcacccccaaactggaccaatggctacaacagatcccaggaacaacatcagacatctcagtccagaaatgtgcagtccttggcacagccaagatactgcgcagaaccctcaagct

SEQ ID NO: 453 - DNA, 422 bp, Xiphophorus maculatus; identical to SEQ ID NO: 452

SEQ ID NO: 454 - DNA, 422 bp, Xiphophorus maculatus
ctggaaaccccgagatcaaagtggaaaacacccccaaaggtggcagagaacgccagagctaagatcctgtgggacttccagatccagacagacaaaatggtaatggcgaaccaaccagacattgtcgtagtggataaacaacaaaggaaagccgttgtgatagatgtagcaataccaagcgactgcaacatcaggaaaaaggagcacgagaaactagagaaataccagggcctcagggaggaactggagagggcctggaagatgaagaccacagtggtgcctgtggtcatcggggccctcggggcagtcacccccaaactggaccaatggctacaacagatcccaggaacaacatcagacatctcagtccagaaatgtgcagtccttggcacagccaagatactgggcagaaccctcaagct

SEQ ID NO: 455 - DNA, 422 bp, Xiphophorus maculatus
ctggaaaccctgggatcaaagtgggaaacacccccaaaggtggcggagaacgccagagctaagatcctgtgggacttccagatccagacagacaaaatggtaatggcgaaccaaccagacattgtcgtagtggataaacaacagaggaaagccgttgtgatagatgtagcaataccaagcgactgcaacatcaggaaaaaggagcacgagaaactagagaaataccagggcctcagggaggaactggagagggcctggaaggtgaagaccacagtggtgcctgtggtcatcggggccctcggggcagtcacccccaaactggaccaatggctacaacagatcccaggaacaacatcagacatctcagtccagaaatgtgcagtccttggcacagccaagatactgcgcagaaccctcaagct

SEQ ID NO: 456 - DNA, 422 bp, Xiphophorus maculatus
ctggaaaccctgagatcaaagtgggaaacacccccaaaggtggcggagaacgccagagctaagatcctgtgggacttccagatccagacagacaaaatggtaatggcgaaccaaccagacattgtcgtagtggataaacaacagaggaaagccgttgtgatagatgtagcaataccaagcgactgcaacatcaggaaaaaggagcacgagaaactagagaaataccagggcctcagggaggaactggagagggcctggaaggtgaagaccacagtggtgcctgtggtcatcggggccctcggggcagtcacccccaaactggaccaatggctacaacagatcccaggaacaacatcagacatctcagtccagaaatgtgcagtccttggcacagccaagatactgcgcagagccctcaagct

SEQ ID NO: 457 - DNA, 422 bp, Xiphophorus maculatus
ctggaaaccccgggatcaaagtgggaaacacccccaaaggtggcggagaacgccagagctaagatcctgtgggacttccagatccagacagacaaaatggtaatggcgaaccaaccagacattgtcgtagtggataaacaacagaggaaagccgttgtgatagatgtagcaataccaagcgactgcaacatcaggaaaaaggagcacgagaaactagagaaataccagggcctcagggaggaactggagagggcctggaaggtgaagaccacagtggtgcctgtggtcatcggggccctcggggcagtcacccccaaactggaccaatggctacaacagatcccaggaacaacatcagacatctcagtccagaaatgtgcagcccttggcacagccaagatactgcgcagaaccctcaagct

SEQ ID NO: 458 - DNA, 422 bp, Poecilia formosa
ctggaagccccgaggtcaaaatgggggacacccccaaaggtggtggagaatgaccgagctaagatcctgtgggacttccagatccagacagacaagatggtaatggcgaaccaaccggacattgtggtggtggataaagaacagaggaaagccgttgtggtggatgtagcaataccaagtgaccacaacatcaggaaaaaggagcatgagaaactggagaaataccagggcctcagagaggaactggagaaggcctggaaggtgaagaccacagtggtgcctgtggtcatcggggccctcggggcagtcacccccaaactggagcagtggctcaaacagatcccaggaacaacatcagacatctcagtccagaaatgtgcagttctaggcacagccaagatactgcgcagaaccctcaagct

SEQ ID NO: 459 - DNA, 422 bp, Poecilia formosa
ctggaaaccccgaggtcaaaatgggggacacccccaaaggtggtggagaatgaccgagctaagatcctgtgggacttccagatccagacagacaagatggtaatggcgaaccaaccggacattgtggtggtggataaagaacagaggaaagccgttgtggtggatgtagcaataccaagtgaccacaacatcaggaaaaaggagcatgagaaactggagaaataccagggcctcagagaggaactggagaaggcctggaaggtgaagaccacagtggtgcctgtggtcatcggggccctcggggcagtcacccccaaactggagcagtggctcaaacagatcccaggaacaacatcagacatctcagtccagaaatgtgcagttctaggcacagccaagatactgcgcagaaccctcaagct

SEQ ID NO: 460 - DNA, 422 bp, Poecilia formosa
ctggaagccccgaggtcaaaatgggggacacccccaaaggtggtggagaatgaccgagctaagatcctgtgggacttccagatccagacagacaaggtggtaatggcgaaccaaccggacattgtggtggtggataaagaacagaggaaagccgttgtggtggatgtagcaataccaagtgaccacaacatcaggaaaaaggagcatgagaaactggagaaataccagggcctcagagaggaactggagaaggcctggatggtgaagaccacagtggtgcctgtggtcatcggggccctcggggcagtcacccccaaactggagcagtggctcaaacagatcccaggaacaacatcagacatctcagtccagaaatgtgcagttctaggcacagccaagatactgaggagaaccctcaagct

SEQ ID NO: 461 - DNA, 416 bp, Poecilia formosa
ctggaagccccgaggtcaaaatgggggacacccccaaaggtggtggagaatgaccgagctaagatcctgtgggacttccagatccagacagacaagatggtaatggcgaaccaaccggacattgtggtggtggataaagaacagaggaaagccgttgtggtggatgtagcaataccaagtgaccacaacatcaggaaaaaggagaaactggagaaataccagggcctcagagaggaactggagaaggcctggaaggtgaagaccacagtggtgcctgtggtcatcggggccctcggggcagtcacccccaaactggagcagtggctcaaacagatcccaggaacaacatcagacatctcagtccagaaatgtgcagttctaggcacagccaagatactggaggagaacctgaagct

SEQ ID NO: 462 - DNA, 422 bp, Poecilia formosa; identical to SEQ ID NO: 459

SEQ ID NO: 463 - DNA, 416 bp, Poecilia formosa
ctggaagccccgaggtcaaagtggggaacacccccaaaggtggtggagaatgaccgagctaagatcctgtgggacttccagatccagacagacaagattgtaatggcgaaccaaccggacattgtggtggtggataaagaacagaggaaagccgttgtggtggatgtagcaataccaagtgaccacaacatcaggaaaaaggagaaactggagaaataccagggcctcagagaggaactggagaaggcctggaaggtgaagaccacagtggtgcctgtggtcatcggggccctcggggcagtcacccccaaactggagcagtggctcacacagatcccaggaacaacatcagacatctcagtccagaaatgtgcagttctaggcacagccaagatactggaggagaacctgaagct

SEQ ID NO: 464 - DNA, 422 bp, Poeciliopsis gracilis
ctggaaaccccgagatcaaagtgggaaacacccccaaaggtggtggagaatgccagagctaagatcctgtgggacttccaaatccagacagacagaatggtaatggcaaaccaaccagacattgtcgtagtggacaaacaacagaggaaagccgttgtggtagatgtagcaataccaagcgattgcaacatcaggaaaaaggagcacgagaaactggagaaataccagggccttagggaggaactggagagggcctggaaggtgaagaccacagtggtgcctgtggtcatcggggccctcggggcagtcacccccaaactggagcagtggctacaacagatcccaggaacaacatcagacatctcagtccagaaatgtgcagtccttggcacagccaagatactgcgcaggaccctcaagct

SEQ ID NO: 465 - DNA, 422 bp, Poeciliopsis gracilis
ctggaaaccccgagatcaaagtgggaaacacccccaaaggtggtggagaatgccagagctaagatcctgtgggacttccagatccagacagacagaatggtaatggcgaaccaaccagacattgtcgtagtggacaaacaacagaggaaagccgttgtggtagatgtagcaataccaagcgatttcaacatcaggaaaaaggagcacgagaaactggagaaataccagggccttagggaggaactggagagggcctggaaggtgaagaccacagtggtgcctgtggtcatcggggccctcggggcagtcacccccaaactggagcagtggctacaacagatcccaggaacaacatcagacatctcagtccagaaatgtgcagtccttggcacagccaagatactgcgcaggaccctcaagct

SEQ ID NO: 466 - DNA, 422 bp, Poeciliopsis gracilis
ctggaaaccccgagatcaaagtgggaaacacccccaaaggtggtggagaatgccagagctaagatcctgtgggacttccagatccagacagacagaatggtaatggcgaaccaaccagacattgtcgtagtggacaaacaacagaggaaagccgttgtggtagatgtagcaataccaagtgattgcaacatcaggaaaaaggagcacgagaaactggagaaataccagggccttagggaggaactggagagggcctggaaggtgaagaccacagtggtgcctgtggtcatcggggccctcggggcagtcacccccaaactggatcaatggctacaacagatcccaggaacaacatcagacatctcagtccggaaatgtgcagtccttggcacagccaagatactgcgcaggatcctcaagct

SEQ ID NO: 467 - DNA, 422 bp, Poeciliopsis gracilis
ctggaaaccccgagatcaaagtgggaaacacccccaaaggtggtggagaatgccagagctaagatcctgtgggacttccagatccagacagacagaatggtaatggcgaaccaaccagacattgtcgtagtggacaaacaacagaggaaagccgttgtggtagatgtagcaataccaagcgattgcaacatcaggaaaaaggagcacgagaaactggagaaataccagggccttagggaggaactggagagggcctggaaagtgaagaccacagtggtgcctgtggtcatcggggccctcggggcagtcacccccaaactggagcagtggctacaacagatcccaggaacaacatcagacatctcagtccagaaatgtgcagtccttggcacagccaagatactgcgcaggaccctcaagct

SEQ ID NO: 468 - DNA, 422 bp, Oryzias latipes
ctggaaaccccaaggtcaaaatgggacacacctccaaaggtggtagagaatgagagggcaaagatcctgtgggacttccagattcagactgataggattgtaatggcaaaccaaccagacattgttgtggtggataaagaacagaggaaagccgttgtggtggatgtggcagtgccaagcgatggaaacatcaggaagaaggaacatgagaaactggagaaataccagggactcagagaagaactggagaaagcatggaaagtgaaggtgacagtggtgcctgtggtaattggagcactcggggcagtaacccccaagctggaggagtggctacaacagatacctggaaagacctcagacctctcagtccagaagagcgcagtgctaggaacagctaagatactgcgcagaaccctcaagct

SEQ ID NO: 469 - DNA, 422 bp, Oryzias latipes
ctggaaaccccaaggtcaaaatgggaaacacctccgaaggttgtagagaatgggagggcaaagatcctgtgggacttccagatccagactgataggatggtgatggcgaaccaaccagacattgtagtggtggataaagaacagaggaaagccgttgtggtggatgtggcagtgccaagcgatgggaacatcaggaagaaggagcatgagaaactggagaaataccagggactcagagaagaactggagaaagcctggaaagtgaaggtgacagtggtgcctgtggtaattggagcactcggggcagtaacccccaagctggaggagtggctgcaacagatacctggaaagatctcagacctctcaatccagaaaagcgcagtgctaggaacagctaagatactgcgcaggaccctcaagct

SEQ ID NO: 470 - DNA, 422 bp, Oryzias latipes
  modified_base (3)..(3): a, c, g, or t
  modified_base (399)..(399): a, c, g, or t
ctngaaaccccaaggtcaaaatgggaaacacctccgaaggtggtagagaatgagagggcaaagatcctgtgggacttccagatccagactgatagaatggtaatggcaaaccaaccagacattgtagtggtggataaagaacagaggaaagccgttgtggtggatgtggcagtgccaagcgatggaaacatcaggaagaaggaacatgagaaactggagaaataccagggactcagagaagaactggagaaagcctggaaagtgaaggtgacagtggtgcctgtggtaattggggcacttggggcagtaacccccaagctggaggagtggctacaacagatacctggaaaaacctcagacctctcagtccagaaaagcgcagtgctaggaacagctaanatactgtgcaggaccctcaagct

SEQ ID NO: 471 - DNA, 422 bp, Oryzias latipes
  modified_base (406)..(407): a, c, g, or t
ctcgaaaccccaaggtcaaaatgggaaacacctccgaaggtggtagagaatgagagggcaaagatcctgtgggacttccagatccagactgataggatggtaatggcgaaccaaccagacattgtagtggtggattaagaactgaggaaagccgttgtggtggatgtggcagtgccaaacgatgggaacatcaggaagaaggaacatgagaaactggagaaataccagggactcagagtagaactggagaaagcatggaaagtgaaggtgacagtggtgcctgttgtaattggagcactcggggcagtaacccccaagctcgaggagtggctacaacagatacctggaaagacctcagacctctcagtccagaaaagcgcagtgctaggaacagctaagatactgnncaggaacctcaagct

SEQ ID NO: 472 - DNA, 422 bp, Oryzias latipes
  modified_base (406)..(407): a, c, g, or t
cctgaaaccccaaggtcaaaatgggaaacacctccgaaggtggtagagaatgagagggcaaagatcctgtgggacttccagatccagactgataggatggtaatggagaaccaaccagacattgtagtggtggataaagaacagaggaaagccgttgtggtggatgtggcagtaccaagcgatgggaacatcaggaaaaaggaacaggagaaactggagaaataccaggggctcagagaagaactggagaaagcatggaaagtgaaggtgacagtggtgcctgtggtaattggagcactcgtggcagtaacccccaagctggaggagtggctacaacagatacctggaaagacctcagacctctcagtccagaaaagcgcagtgctaggaacagctaagatactgnncaggaccctcaagct

SEQ ID NO: 473 - DNA, 422 bp, Herichthys labridens
ctggaagtcccgaggtcaaaatgggacacgcccccaagggtggttgagaactacagagctaagatcctgtgggacttccagatacagacagacaaacttgtggtggctaaccaaccggacatcgtagtggtggacaaacaaaggaagaaagtcgtggtgatagacattgcaataccaagtgacaggaacatcaagaagaaggaacacgagaagcttgacaaatacctagggctcagagagcagctggaaaggatgtggaagatgaaggcaacagtggtccccgtggtaatcggaacactcggggcagtgacccccaagttgggagagtggctccagcagattcctggaacaacatccgagatctctgtccagaagagcgcaatactgggaacagctaagatactgcgcaggaccctcaagct

SEQ ID NO: 474 - DNA, 389 bp, Herichthys labridens
ctagaagtcctgaggtcaaaatgggatttgcccccacgggtggtaatgactgagctaagaccctgagggtcttcagatacagatggacaaactggtgatggctaaccaaccggacatccgtagtgtccgtagtgatagacgtagcaataccaagcgaaagtaacatcaagacgaaggaacacgagaagctgccaagggctgagagaagagctagagaggatgtgaaaggtgaaggcaacagtggtccccgtggtaatcggaaccctcgaggcaatgacccccaaactagaacagtggttccaggagattccaggaacgacatccgagatctctgtccagaagagcgcagtcctaggaacggctaagatactgtgcaggaccctcaagct

SEQ ID NO: 475 - DNA, 422 bp, Pseudoxiphophorus bimaculatus
ctggaagccccgagatcgaagtggggaacacccccaaaggtggtggagaatggccgagctaagatcctgtgggacttccagatccagacagacaaaatggtaatggcgaaccaaccggacattgtggtggtggataaagaacagagggaagccgttgtggtggatgtagcaataccaagtgaccacaacatcaggaaaaaggagcatgagaaactggagaaataccagggcctcagagaggaactggaaaagacctggaaggtgaagaccacagtggtgcctgtggtcatcggggccctcggggcagtcacccccaaactggagcagtggctcaaacagatcccaggaacaacatcagacatctcagtccagaaatgtgcagttctaggcacagccaagatactgcgcagaaccctcaagct

SEQ ID NO: 476 - DNA, 422 bp, Pseudoxiphophorus bimaculatus
ctggaagccccgagatcgaagtggggaacccccccaaaggtggcggagaatgaccgagctaagatcctgtgggacttccagatccagacagacaaaatggtaatggcgaaccaaccggacattgtggtggtggataaagaacagaggaaagccgttgtggtggatgtagcaataccaagtgaccacaacatcaggaaaaaggagcatgagaaactggaggaataccagggcctcagagaggaactggaaaagacctggaaggtgaagaccacagtggtgcctgtggtcatcggggccctcggggcagtcacccccaaactggagcagtggctcaaatagatcccaggaacaacatcagacatctcagtccagaaatgtgcagttctaggcacagccaagatactgcgcagaaccctcaagct

SEQ ID NO: 477 - DNA, 422 bp, Pseudoxiphophorus bimaculatus
ctggaagccccgagatcgaagtggggaacacccccaaaggtggcggagaatgaccgagctaagatcctgtgggacttccagatccagacagacaaaattgtaatggcgaaccaaccggacattgtggtggtggataaagaacagaggaaagccgttgtggtggatgtagcaataccaagtgaccacaacatcaggaaaaaggagcatgagaaactggagaaataccagggcctcagagaggaactggaaaagacctggaaggtgaagaccacagtggtgcctgtggtcatcggggccctcggggcagtcacccccaaactggagcagtggctcaaacagatcccaggaacaacatcagacatctcagtccagaaatatgcagttctaggcacagccaagatactgtgcagaaccctcaagct

SEQ ID NO: 478 - DNA, 422 bp, Pseudoxiphophorus bimaculatus
ctggaagccccgagatcgaagtggggaacacccccaaaggtggtggagaatggccgagctaagatcctgtgggacttccagatccagacagacaaaatggtaatggcgaaccaaccggacattgtggtggtggataaaggacagaggaaagccgttgtggtggatgtagcaataccaagtgaccacaacatcaggaaaaaggagcatgagaaactggagaaataccagggcctcagagaggaactggaaaagacctggaaggtgaagaccacagtggtgcctgtggtcatcggggccctcggggcagtcacccccaaactggagcagtggctcaaacagatcccaggaacaacatcagacatctcagttcagaaatgtgcagttctaggcacagccaagatactacgcagaaccctcaagct

SEQ ID NO: 479 - DNA, 422 bp, Pseudoxiphophorus bimaculatus
ctggaagccccgagatcgaagtggggaacacccccaaaggtggtggagaatgaccgagctaagatcctgtgggacttccagatccagacagacaaaatggtaatggcgaaccaaccggacattgtggtggtggataaagaacagaggaaagccgttgtggtggatgtagcaataccaagtgaccacaacatcaggacaaaggagcatgagaaactggagaaataccagggcctcagagaggaactggaaaagacctggaaggtgaagaccacagtggtgcctgtggtcatcgaggccctcggggcagtcacccccaaactggagcagtggctcaaacagatcccaggaacaacatcagacatctcagtccagaaatgtgcagttttaggcacagccaagatactgcgcagaaccctcaagct

SEQ ID NO: 480 - DNA, 422 bp, Pseudoxiphophorus bimaculatus
ctggaagccccgagatcgaagtggggaacacccccaaaggtggtggagaatgaccgagctaagatcctgtgggacttccagatccagacagacaaaatggtaatggtgaaccaaccggacattgtggtggtggataaagaacagaggaaagccgttgtggtggatgtagcaataccaagtgaccacaacatcaggaaaaaggagcatgagaaactggagaaataccagggcctcagagaggaaatggaaaagacctggaagatgaagaccacagtggtgcctgtggtcatcggggccctcgaggcagtcacccccaaactggagcagtggctcaaacagatcccaggaacaacatcagacatctcagtccagaaatgtgcagttctaggcacagccaagatactgcgcagaaccctcaagct

SEQ ID NO: 481 - DNA, 422 bp, Gambusia affinis
  modified_base (52)..(57): a, c, g, or t
ctggaacccccgagatcaaagttggaaacacccccaaaggtggtggagaatnnnnnngctaagatcctgtgggacttccagatccagacagacaaaatggtaagggtgaaccaaccggacattgtcatagtggataaacaacagaggaaagccgttgtggtggatgtggcaataccaagtgactgcaacatcagaaaaaaggagcatgaaaaactagagaaataccagggcctaagggaggaactggagagggcctggaaggtgaagaccacagtggtgcctgtggtcatcgggaccctcggggcagtcacccccaaactggaacagtggctacaacagatcccaggaacaacatcagacatctcagtccagaaatgtgcagtcctaggcacagccaagatactgcgcagaaccctcaagct

SEQ ID NO: 482 - DNA, 422 bp, Gambusia affinis
ctggaacccccaagatcaaagtgggaaacacccccgaaggtagtggagaatgaccgagctaagatcctgtgggacttccagatccagacagacaaaatggtgagggcgaaccaaccagacatagtcgtggtggataaacaacagaggaaagccgttgtggtggatgtggcaataccaagtgactgcaacatcaggaaaaaggagcatgagaaactagagaaataccagggcctaagggaggaactggagagggcctggaaggtgaagaccacagtggtgcctgtggtcatcgggaccctcggggcagtcacccccaaactggaacagtggctacaacagatcccaggagcaacatcagacatctcagtccagaaatgtgcagtcctaggcacagccaagatactgcgcagaaccctcaaact

SEQ ID NO: 483 - DNA, 422 bp, Gambusia affinis
ctggcacccccaagatcaaagtgggaaacacccccgaaggtagtggagaatgaccgagctaagatcctgtgggacttccagatccagacagacaaaatggtgagggcgaaccaaccagacatagtcgtggtggataaacaacagaggaaagccgttgtggtggatgtggcaataccaagtgactgcaacatcaggaaaaaggagcatgaaaaactagagaaataccagggcctaagggaggaactggagagggcctggaaggtgaagaccacagtggtgcctgtggtcatcgggaccctcggggcagtcacccccaaactggaacagtggctacaacagatcccaggaacaacatcagacatctcagtccagaaatgtgcagtcctaggcacagccaagatactgcgcagaaccctcaagct

SEQ ID NO: 484 - DNA, 422 bp, Gambusia affinis
ctggaacccccaagatcaaagtgggaaacacccccgaaggtagtggagaatgaccgagctaagatcctgtgggacttccagatccagacagacaaaatggtgagggcgaaccaaccagacatagtcgtggtggataaacaacagaggaaagccgttgtggtggatgtggcaataccaagtgactgcaacatcaggaaaaaggagcacgaaaaactagagaaataccagggcctaagggaggaactggagagggcctggaaggtgaagaccacagtggtgcctgtggtcatcgggaccctcggggcagtcactcccaaactggaacagtggctacaacagatcccaggaacaacatcagacatctcagtccagaaatgtgcagtcctaggcacagccaagatactgcgcagaaccctcaagct

SEQ ID NO: 485 - DNA, 422 bp, Gambusia affinis
ctggaacccccaagatcaaagtgggaaacacccccgaaggtagtggagaatgaccgagctaagatcctgtgggacttccagatccagacagacaaaatggtgagggcgaaccaaccagacatagtcgtggtggataaacaacagaggaaagccgttgtggtggatgtggcaataccaagtgactgcaacatcaggaaaaaggagcatgaaaaactagagaaataccagggcctaagggaggaactggagagggcctggaaggtgaagaccacagtggtgcctgtggtcatcgggaccctcggggcagtcacccccaaactggaacactggctacaacagatcccaggaacaacatcagacatctcagtccagaaatgtgcagtcctaggcacagccaagatactgcgcagaaccctcaagct

SEQ ID NO: 486 - DNA, 422 bp, Gambusia affinis
ctggaacccccaagatcaaagtgggaaacacccccgaaggtagtggagaatgaccgagctaagatcctgtgggacttccagatccagacagacaaaatggtgagggcgaaccaaccagacatagtcgtggtggataaacaacagaggaaagccgttgtggtggatgtggcaataccaagtgactgcaacatcaggaaaaaggagcatgaaaaactagagaaataccagggcctaagggaggaactggagagggcctggaaggtgaagaccacagtggtgcctgtggtcatcgggaccctcggggcagtcacccccaaactggaacagtggctacaacagatcccaggaacaacatcagacatctcagtccagaaatgtgcagtcctaggcacagccaagatactgcgcagaaccctcaagct

SEQ ID NO: 487 - DNA, 504 bp, Symphysodon discus
aggaacatgtgtgcagaatatgacctggaagtcctgaggtcaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaatatcaagtgatggcagcatcaagaagaaagaacatgagacgcttgataaataccaagggctcagcgaagagctagaaaggatgtggaaggtgaaggcaagagtggtccccgtggtagtcagtacacttggggcagtgacctccaaactgggagaatggctccagcagattccaggagcaacatccgagatctctttgcagaagagcgcagtcctgggaacagctaagatactgagcaggaccctcaagctcccaggcctctggtagcggacccgatcttggaggagaaaccacc

SEQ ID NO: 488 - DNA, 504 bp, Symphysodon discus
aggaacatgtgtgcagaatatgacctggaagtcctgaggtcaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaatatcaagtgatggcagcatcaagaagaaagaacatgagacgcttgataaataccaagggctcagcgaagagctagaaaggatgtggaaggtgaaggcaagagtggtccccgtggtagtcagtacacttggggcagtgacctccaaactgggagaatggctccagcagattccaggagcaacatccgagatctctttgcagaagagcgcagtcctgggaacagctaagatactgagcaggaccctcaagctcccaggcctctggtagcggacccgagcttggaggagaaaccacc

SEQ ID NO: 489 - DNA, 504 bp, Symphysodon discus
aggaacatgtgtgcagaatatgacctggaagtcctgaggtcaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaataccaagtgacagcagcatcaagaagaagaaacacgagaaccttaacaaataccaagggctcagagaggacctggaaaggatgtggaagatgaaggtatcagtggtccccgtggtaattggaacacttggggcagtggcccccaaactgggagagtggctccagcagattcctggaacaacatctgagatctctgtccagaagagcgcaatactgggaacagctaagatactgcacaggaccctctgtctcccaggcctctggtagaggacccgagcttggaggagaaaccacc

SEQ ID NO: 490 - DNA, 500 bp, Symphysodon discus
aggaacatgtgtgcagaatatgacctggaagtcctgaggtcaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaatatcaagtgatggcaacatcaagaagaaagaacatgagacgcttgataaataccaagggctcagcgaagagctagaaaggatgtggaaggtgaaggcaagagtggtcctggtgctactctgtacacttggggcattgaactccttctgggatttgggtcccccagaactgggaacgacatctgagccctcttaacattgtatccagggatgggaagaactaagacactgcgcaggaccctcaaggtcccaggcctctggtaaaggacacgagcttggaggagaaaccacc

SEQ ID NO: 491 - DNA, 503 bp, Symphysodon discus
aggaacatgtgtgcagaatatgacctggaagtcctgaggtcaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaatatcaagtgatggcaacatcaagaagaaagaacatgagacgcttgataaataccaagggctcagcgaagagctagaaaggatgtggaaggtgaaggcaagagtggtccccgtggcagtcagtacacttgggccagtgacctccgaactggcagattgggccagtagatgccgggaacggcaggttagatctcttaacaaagtagggttgccttggaaagctctaagacactgcgcaggaccctcaaggtcccaggcctctggtaaaggacacgagcttggaggagaaaccacc

SEQ ID NO: 492 - DNA, 504 bp, Symphysodon discus
aggaacatgtgtgcagaatatgacctggaagtcctgaggccaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaatatcaagtgatggcaacatcaagaagaaagaacatgagacgcttgataaataccaagggctcagcgaagagctagaaaggatgtggaaggtgaaggcaagagtggtccccgtggtagtcagtacacttggggcagtgacctccaaactgggagaatggctccagcagattccaggaacaacatccgagatctctttgcagaagagcgcaggcctgggaacagctaagatactgagcaggaccctcaagctccccggcctctggtagcggacccgagcttggaggagaaaccacc

SEQ ID NO: 493 - DNA, 505 bp, Symphysodon discus
aggaacatgtgtgcagaatatccacctggaagtcctgaggtcaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaacatcaagtgatggcaacatcaagaagaaagaacatgagacgcttgataaataccaagggctcagcgaagagctagaaaggatgtggaaggtgaaggcaagagtggtccccgtggtagtcagtacacttggggcagtgacctccaaactgggagaatggctccagcagattccaggaacaacatccgagatctctttgcagaagagcgcagtcctgggaacagctaagatactgagcaggaccctcaagctcccaggcctctggtagcggacccgagcttggaggagaaaccacc

SEQ ID NO: 494 - DNA, 504 bp, Symphysodon discus
aggaacatgtgtgcagaatatgacctggaagtcctgaggtcaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaatatcaagtgatggcaacatcaagaagaaagaacatgagacgcttgataaataccaagggctcagcgaagagctagaaaggatgtggaaggtgaaggcaagagtggtccccgtggtagtcagtacacttggggcagtgacctccaaactgggagaatggctccagcagattccaggaacaacatccgagatctctttgcagaagagcgcagtcctgggaacagctaagatactgagcaggaccctcaagctgccaggcctctggtagcggacccgagcttggaggagaaaccacc

SEQ ID NO: 495 - DNA, 504 bp, Symphysodon discus
aggaacatgtgtgcagaatatgacctggaagtcctgaggtcaaaatgggacacgcccgcaagggcggtcgagaataacagtgcttagatcctgtgggacttccagatacagacagacaaacttgtgatggctaaccaaccggacacagtagtgggtgacaaacaaaggaaaaaagccgtgtgatagatagcctagtgatagacgatgcaatatcaagtgatggcaacatcaagaagaaagaacatgagacgcttgataaataccaagggctcagcgaagagctagaaaggatgtggaaggtgaaggcaagagtggtccccgtggtagtcagtacacttggggcagtgacctccaaactgggagaatggctccagcagattccaggaacgacatccgagatctctttgcagaagagcgcagtcctgggaacagctaagatactgagcaggaccctcaagctccccggcctctggtaaaggacacgagcttggaggagaaaccacc

SEQ ID NO: 496 - DNA, 491 bp, Symphysodon discus
aggaacatgtgtgcagaatatggcccggaagtcccaaggtcaaaatgggatgtgcctccaagggtggttgagaaagaccgagctaagatcctgtgggatttccagaaagaaaaggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagagaagagctagagaggatgtggaaagtgaaggcaagagtggtcccctgtggaaatcagaacacttgggacagtgacccgcaaactggaagaatggctccagcagattccaggaaggacatcagagatctctgtccatatgagtgcagtcttgggaacagctaagacactgcgcaggaccctcaaggtcccaggcctctggtaaaggacacgagcttggaggagaaaccacc

SEQ ID NO: 497 - DNA, 491 bp, Symphysodon discus
aggaacatgtgtgcagaatatggcccggaagtcccaaggtcaaaatgggatgtgcctccaagggtggttgagaaagaccgagctaagatcctgtgggatttccagaaagaaaaggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagagaagagctagaggggatgtggaaagtgaaggcaagagtggtcccctgtggaaatcagaacacttgggacagtgacccgcaaactggaagaatggttccagcagattccaggaaggacatcagagatctctgtccatatgagtgcagtcttgggaacagctaatacactgcgcaggaccctcaaggtcccaggcctctggtaaaggacaccagcttggaggagaaaccacc

SEQ ID NO: 498 - DNA, 491 bp, Symphysodon discus; identical to SEQ ID NO: 496

SEQ ID NO: 499 - DNA, 490 bp, Symphysodon discus
aggaacatgtgtgcagaatatggcccggaagtcccaaggtcaaaatgggatgtgcctccaagggtggttgagaaagaccgagctaagatcctgtgggatttccagaaagaaaaggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagagaagagctagagaggatgtggaaagtgaaggcaagagtggtcccctgtggaaatcagaacacttgggacagtgacccgcaaactggaagaatggttcccgcagattccaggaaggacatcagagcctctacccatttgagcgcagtcttgggaacgtccaagaccctgcgcaggaccctcaaggtcccaggcctctggtaaaggacacgagcttggaggagaaaccacc

SEQ ID NO: 500 - DNA, 491 bp, Symphysodon discus; identical to SEQ ID NO: 496

SEQ ID NO: 501 - DNA, 491 bp, Symphysodon discus; identical to SEQ ID NO: 496

SEQ ID NO: 502 - DNA, 491 bp, Symphysodon discus; identical to SEQ ID NO: 496

SEQ ID NO: 503 - DNA, 491 bp, Symphysodon discus; identical to SEQ ID NO: 496

SEQ ID NO: 504 - DNA, 491 bp, Symphysodon discus
aggaacatgtgtgcagaatatggcccggaagtcccaaggtcaaaatgggatgtgcctccaagggtggttgagaaagaccgagctaagatcctgtgggatttccagaaagaaaaggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagagaagagctagagaggatgtggaaagtgaaggcaagagtggtcccctgtggaaatcagaacacttgggacagtgacccgcaaactggaagaatggctccagcaaattccaggaaggacatcagagatctctgtccatatgactgctgccttgggaacagctaagacactgcgcaggaccctcaaggtcccaggcctctggtaaaggacacgagcttggaggagaaaccacc

SEQ ID NO: 505 - DNA, 492 bp, Symphysodon discus
aggaacatgtgtgcagaatatggcccggaagtcccaaggtcaaaatgggatgtgcctccaagggtggttgagaaagaccgagctaagatcctgtgggatttccagaaagaaaaggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagaaaaagagctagagaggatgtggaaagtgaaggcaagagtggtcccctgtggaaatcagaacacttgggacagtgacccgcaaactggaagaatggctccagcagattccaggaaggacatcagagatctctgtccatatgagtgcagtcttgggaacagctaagacactgcgcaggaccctcaaggtcccaggcctctggtaaaggacacgagcttggaggagaaaccacc

SEQ ID NO: 506 - DNA, 491 bp, Symphysodon discus; identical to SEQ ID NO: 496

SEQ ID NO: 507 - DNA, 491 bp, Symphysodon discus; identical to SEQ ID NO: 496

SEQ ID NO: 508 - DNA, 491 bp, Symphysodon discus
aggaacatgtgtgcagaatatggcccggaagtcccaaggtcaaaatgggatgtgcctccaagggtggttgagaaagaccgagctgagatcctgtgggatttccagaaagaaaaggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagagaagagctagagaggatgtggaaagtgaaggcaagagtggtcccctgtggaaatcagaacacttgggacagtgacccgcaaactggaagaatggctccagcagattccaggaaggacatcagagatctctgtccatatgagtgcagtcttgggaacagctaagacactgcgcaggaccctcagggtcccaggcctctggtaaaggacacgagcttggaggagaaaccacc

SEQ ID NO: 509 - DNA, 491 bp, Symphysodon discus; identical to SEQ ID NO: 496

SEQ ID NO: 510 - DNA, 491 bp, Symphysodon discus
aggaacatgtgtgcagaatatggcccggaagtcccaaggtcaaaatgggatgtgcctccaagggtggttgagaaagaccgagctaagatcctgtgggatttccagaaagaaaaggataaactggtaatggctaaccgaccagacatagtagtggtggacaagcagaggaggaaggccatagtgatagatgtagcaatacaaactgacagtaacatcaagaagaaggaacacgagaagcttgagaaacaccaagggctgagagaagagctagagaggatgtggaaagtgaaggcaagagtggtcccctgtggaaatcagaacacttgggacagtgacccgcaaactggaagaatggctccagcagattccaggaaggacatcagagatctctgtccatatgagtgcagtcttgggaacagctaagacactgcgcaggaccctcaaggtcccaggcctctggtaaaggacacgagcttggaggagaaaccacc

SEQ ID NO: 511 - DNA, 490 bp, Symphysodon discus
aggaacatgtgtgcagaatatggcccggaagtcccaaggtcaaaatgggatgtgcctccaagggtggttgagaaagaccgagctaagatcctgtgggatatccagaaagaaaaggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagagaagagctagagaggatgtggaaagtgaaggcaagagtggtcccctgtggaaatcagaacacttgggacagtgacccgcactttggaataagggctccagcaaattccaggaaggacatcggagtcctctgtccatttgagtgtttccttgggaatatctaacacgctgcgaaggaccctcatggtccccggccttggaaacggccacgagcttggaggagaaaccacc

SEQ ID NO: 512 - DNA, 491 bp, Symphysodon discus; identical to SEQ ID NO: 496

SEQ ID NO: 513 - DNA, 491 bp, Symphysodon discus; identical to SEQ ID NO: 496

SEQ ID NO: 514 - DNA, 491 bp, Symphysodon discus
aggaacatgtgtgcagaatatggcccggaagtcccaaggtcaagatgggatgtgcctccaagggtggttgagaaagaccgagctaagatcctgtgggatttccagaaagaaaaggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagagaagagctagagaggatgtggaaagtgaaggcaagagtggtcccctgtggaaatcagaacacttgggacagtgacccgcaaactggaagaatggctccagcagattccaggaaggacatcagagatctctgtccatatgagtgcagtcttgggaacagctaagacactgcgcaggaccctcaaggtcccaggcctctggtaaaggacacgagcttggaggagaaaccacc

SEQ ID NO: 515 - DNA, 491 bp, Symphysodon discus
aggaacatgtgtgcagaatatggcccggaagtcccaaggtcaaaatgggatgtgcctccaagggtggttgagaaagaccgagctaagatcctgtgggatttccagaaagaaagggataaactggtaatggctaaccaaccagacatagtagtggtggacaagcagaggaggaaggccatagtgatagatgtagcaatacaaactgacagtaacatcaagaagaaggaacacgagaagcttgagaaacaccaagggctgagagaagagctagagaggatgtggaaagtgaaggcaagagtggtcccctgtggaaatcagaacacttgggacagtgacccgcaaactggaagaatggctccagcagattccaggaaggacatcagagatctctgtccatatgagtgcagtcttgggaacagctaagacactgcgcaggaccctcaaggtcccaggcctctggtaaaggacacgagcttggaggagaaaccacc

SEQ ID NO: 516 - DNA, 491 bp, Symphysodon discus; identical to SEQ ID NO: 496

SEQ ID NO: 517 - DNA, 491 bp, Symphysodon discus; identical to SEQ ID NO: 496

SEQ ID NO: 518 - DNA, 491 bp, Symphysodon discus
aggaacatgtgtgcagaatatggcccggaagtcccaaggtcaaaatgggatgtgcctccaagggtggttgagaaagaccgagctaagatcctgtgggatttccagaaagaaaaggataaactggtaatggctaaccaaccagacatagtagtggtggacaagcagaggaggaaggccatagtgatagatgtagcaatacagactgacagtaacatcaagaagaaggaacacgagaagcttgagaaacaccaagagctgagagaagagctagagaggatgtggaaagtgaaggcaagagtggtcccctgtggaaatcagaacacttgggacagtgacccgcaaactggaagaatggctccagcagattccaggaaggacatcagagatctctgtccatatgagtgcagtcttgggaacagctaagacactgcgcaggaccctcaaggtcccaggcctctggtaaaggacacgagcttggaggagaaaccacc

SEQ ID NO: 519 - DNA, 460 bp, Pterophyllum scalare
aggaacatgtgtgcagaatatgacctggaagtcctgaggtcaaaatgggacacgcccccaagggtggttgagaacaacagagctaagatcctgtgagacttccagatacagacagacaaacttgagatggctaaccaactggacatcgtagtggtggacaaacaaaggaagaaggtcgtagtagatgttgcaataccaagtgacggcaacatcaagaagaaggaacacgagaagctcaataaatcccaagggctcagagaggagctggaaaggatgtagaaggtgaaagtaacaatggttcccgtggtaatcagaacacttggggaaactgggggagtggctccagcagattccagaaacgacatctgagatctctgtccagaagagcgcaatactgggaacagctaagatactgcgcaggacctctggcagaggacccgagcttggaggagaaaccacc

SEQ ID NO: 520 - DNA, 460 bp, Pterophyllum scalare; identical to SEQ ID NO: 519

SEQ ID NO: 521 - DNA, 460 bp, Pterophyllum scalare; identical to SEQ ID NO: 519

SEQ ID NO: 522 - DNA, 459 bp, Pterophyllum scalare
aggaacatgtgtgcagaatatgacctggaagtcctgaggtcaaaatgggacacgcccccaagggtggttgtgaacaacagaggtaaaattcttccagattccagatacagacagacaaacttgcgatggctaaccaaccagacatcgtagtggtgaacaaacaaaggaagaaggctgtagtagacgttgcaataccaagtgatggcaatatcgagaagagggaacacgagaagcttgacaaataccaagggctcagagaggagctggaaaggatgtggaagatgaaggtaacagtggttcccgtggtaattggaacactcggggaaactgggggagtggctccagcagattccagaaacgacatcggagatctctgtccagaggagtgcaatactgggaacagctaagatactgcgcaggacctctggtagaggacccgagcttggaggagaaaccacc

SEQ ID NO: 523 - DNA, 460 bp, Pterophyllum scalare; identical to SEQ ID NO: 519

SEQ ID NO: 524 - DNA, 489 bp, Geophagus proximus
aggaacatgtgtgcagaatatgacctggaagtcccgagatcaaaatgggatacacccccaagggtggtcaagaataacataaccaagatcctgtgggacttccagatacagacagacaaacttgtgatggctaaccaaccggacataatagtggaggacaagcagaggaagaaagctgtagtgatagacgttgaaataccaagtgatggtagcatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 525 - DNA, 489 bp, Geophagus proximus
aggaacatgtgtgcagaatatgacctggaagtcccgagatcaaaatgggatacgcccccaagggtggtcgagaatgaccaagctaagatcctgtgggacttccagatacagacagacaaacttgtgatggctaaccaaccagacatcatagtggtggacaagcagaggaagaaagctgtagtgatagacgttgaaataccaagtgatggtagcatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 526 - DNA, 489 bp, Geophagus proximus
aggaacatgtgtgcagaatatgatccggaagttccgaagtcaaaatgggatacgcccccaagggtggtcgagaataacagagctgagttcccgtgggacttccagatacagacagacaaacttgtgatggctaaccaaccggacatagcagcattggacagacagagcaagaaggtcgtagtgatagacgttgaaataccaagtgacagcaacatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 527 - DNA, 489 bp, Geophagus proximus
aggaacatgtgtgcagaatatgacctggaaatcccaaggtcaaaataggatacgcccccaaggtttgtcgagaacaacagagctaagatcatgtgggacttccagatacagacagacaaacttgtgctggctaaccaaccggacatcatagtggtggacaagcagaggaagagggccgtagtgatagacgttgcaataccaagtgacggcaacatcaggaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 528 - DNA, 489 bp, Geophagus proximus
aggaacatgtgtgcagaatatgacctggaagtcctgaaatcaaaatgggatacgcccccaaggtttgtcgagaacaacagagctaagatcctgtgggacttccacgtacagacagacaaacctgtgatggctaaccaaccggacatcatagtcgtggacaaacaaaggaagaaagctgtagcgatagacgttgcaatcccaagtgacagcaacatcaagaagaaagaacacgagaagcttgataaataccgagggcctacagaagagctggaaaggatgtgcaagttgaaggtaacagtggtctctgtggtaactggaacactcggtgaagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 529 - DNA, 489 bp, Geophagus proximus
aggaacatgtgtgcagaatatgacctggaagtcccgagatcaaaatgggatacgcccccaaggtttgttgagaacaacagagctaagatcatgtgggacttccagatacagacagacaaacttgtgctggctaaccaaccggacatcatagtggtggacaagcagaggaagagggccgtagtgatagacgttgcaataccaagtgacggcaacatcaggaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 530 - DNA, 489 bp, Geophagus proximus
aggaacatgtgtgcagaatatgtcctggaagtcccgagttcaaaatgggatacgcccccaaggtttgtcgagaacaacagagctaagatcctgtgggacttccacgtacagacagacaaacctgtgatggctaaccaaccggacatcatagtcgtggacaaacaaaggaagaaagctgtagcgatagacgttgcaatcccaagtgacagcaacatcaagaagaaagaacacgagaagcttgataaataccgagggcctacagaagagctggaaaggatgtgcaagttgaaggtaacagtggtctctgtggtaactggaacactcggtgaagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 531 - DNA, 489 bp, Astronotus ocellatus
aggaacatgtgtgcagaatatgacatggaagtcccgaggtcaaaatgggctacgcccccatgggtggtagagaatgaccgctaagatcctgtgggacttccaatacagacagacaaactggtaatggctaaccaaccggacatagtagtggtggacaagaagaggaaggaagccgtagtgatagatgttgcaataccgagtgatggcaacatcaggaagaaggaacacgagaagctcgaaaagtaccaagggctgagagaagagctgcagaggatgtggagggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 532 - DNA, 492 bp, Astronotus ocellatus
aggaacatgtgtgcagaatatgacatggaagtcccgaggtcaaaatgggctacgcccccacgggtggtagagaatgaccgagctaagatcctgtgggacttccagatacagacagacaaactggtaatggctaaccaaccggacatagtagtggtggacaagaagaggaaggaagccgtagtgatagatgttgcaataccgagtgatggcaacatcaggaagaaggaacacgagaagctcgaaaagtaccaagggctgagagaagagctgcagaggatgtggagggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 533 - DNA, 492 bp, Astronotus ocellatus
aggaacatgtgtgcagaatatggcctggaagtcccgaggtcaaaatgggatatgcccccataggtggtagagaatgaccaagctaagagcctgtgggacttccagatacacacagaaaaactggtaatggctaaccaaccagacatagtagtggtggacaagaagaggaaggaagccatagtaatagacgctgcaataccaagtgataccaacatcaggaagaaggaacacaagaagctcaagacataccaaggactaagagaggagccagagaggatgtggaaggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 534 - DNA, 492 bp, Astronotus ocellatus
aggaacatgtgtgcagaatatggcctggaagtcccgaggtcaaaatgggatacacccccataggtggtagagcataaccaagcttagatcctgtgggacttccagatacagatggacaaactagtgatggctaaccaaccagacatagtagcggtggacaagcagaggaggaaggctgcagagatagacgttgcaataccaagcggcagtaacatcagaaagaaggaacacgagaagttcaataaataccaagggctaagagaagagcctgagaggatgtggaaggtaaacataacagtgatccctgtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 535 - DNA, 492 bp, Astronotus ocellatus; identical to SEQ ID NO: 533

SEQ ID NO: 536 - DNA, 492 bp, Astronotus ocellatus; identical to SEQ ID NO: 534

SEQ ID NO: 537 - DNA, 490 bp, Astronotus ocellatus
aggaacatgtgtgcagaatatggcctggaagtcccgaggtcaaaatgggatacccccccaaggtggtagagcataaccaagcttagatcctgtgggacttccaatacagatggacaaactagtgatggctaaccaaccagacatagtagcggtggacaagcagaggaggaaggctgcagagatagacgttgcaataccaagcggcagtaacatcagaaagaaggaacacgagaagttcaataaataccaagggctaagagaagagcctgagaggatgtggaaggtaaacataacagtgatccctgtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 538 - DNA, 489 bp, Cichla monoculus
aggaacatgtgtgcagaatatgacctggaagtcccgaggtcaaaatgggctacgcccccacaggtggtagagaatgaccaagctaagattctgtgggacttcctgatacagacagacaaactggtaatggctaaccaaccggacatagtagtggtggacaagaagaggaaggaagctgtagtgatagatgttgcaataccgagtgatggcaacatcaggaagaaggaacacgagaagctcgaaaagtaccaagggctgagagaagagctgcagaggatgtggagggtgaaggttgagtgttccccgtggtcatcggaacactcggggcgatgacgcccacactgggagaggggccccctctcattccaggaatgacatctgagatttctgtccagaagagcgcagtcctaggaacagctaagatactgcgcaggacgctgaagctcccaggcctctggtagaggacccgagcttggaggagaaaccacc

SEQ ID NO: 539 - DNA, 491 bp, Cichla monoculus
aggaacatgtgtgcagaatatgacatggaagtcccgaggtcaaaatgggctacgcccccacgggtggtagagaatgaccgagctaagatcctgtgggacttccagatacagacagacaaactggtaatggctaaccaaccggacatagtagtggtggacaagaagaggaaggaagccgtagtgatagatgttgcaataccgagtgatggcaacatcaggaagaaggaacacgagaagctcgaaaagtaccaagggctgagagaagagctgcagaggatgtggagggtgaagataacagtggtcccagtggtaatcggaacactcggggcagtgacccaagcctctggtagagtggctctcgcagattccaggtacaacatctgagatctctgtccagaagagtgcagtcctgggaacagctaagatactgcgcaggaccctcaatctcccaggcctctggtaaaggacccgagcttggaggagaaaccacc

SEQ ID NO: 540 - DNA, 478 bp, Cichla monoculus
aggaacatgtgtgcagaatatgacctggaagtcctgaggtcaaaatgggctacgcccccacgggtggtagagaatgaccgagctaagatcctgtgggacttcccacaggaagacaaactggtgatggctaaccaaccggacatagtagtggtggacaagaagaggaaggaagccgtagtgatagatgttgcgataccgagtgatggcaacatcaggaagaaggaacacgagaagctcaaaaagtaccaagggctgagagaagagctgcagatgatgtggagggtgaaggtaacagtggtcctcggaacacttggggcagtgacccccaaactggtagagtggctctcgcagattccaggtacaacatctgagatctctgtccagaagagtgcagtcctgggaacagctaagatactgcgcaggaccctcaatctcccaggcctctggtaaaggacccgagcttggaggagaaaccacc

SEQ ID NO: 541 - DNA, 477 bp, Cichla monoculus
aggaacatgtgtgcagaatatgacctggaagtcccgagttcaaaatgggatacggccccacgggtggtagagaatgaccaagctaagatcctgtgggactgctagatacagacagacaaactagtgatggcaaaccataagacatagtagtggtggacaagaagaggaaggaagccgtagtgataggcactgtaataccaagtgatagcgacatcaggaagaaagaacaaaagaagctcgagaaataccaagagctgcagaggatgtggaaggtgaagataacagtggtccccgtggtaactggaacacttggggcagtgacccccaaactgggagagtggctccagcagattccaggtacaacatctgagatctctgtccagaagagtgcagtcctgggaacagctaagatactgcgcaggaccctcaatctcccaggcctctggtaaaggacccgagcttggaggagaaaccacc

SEQ ID NO: 542 - DNA, 489 bp, Cichla monoculus
aggaacatgtgtgcagaatatggcctggaagtctcaagtttaaaatgggatatgcccccacgggtggacgagaatgaccaagcttagatcctgtgggacttccagatacagacaaacaaacggctaacggctaacccacctaacccaatagtggtggacaagaagaagaagaaagccatagtgatagacgttgcaataccaagtgatctcaacatcaggaagaaggaacacgagaagctcgagaaataccatgggctcagagagggctagagagaatgtggaaggtgaaggtaacagtggtccttgtggtaatcggaacactcgggggagtgacccccaaactgggagagtggctccagcagattccaggaatgacatctgagatttctgtccagaagagcgcagtcctaggaacagctaagatactgcgcaggacgctgaagctcccaggcctctggtagaggacccgagcttggaggagaaaccacc

SEQ ID NO: 543 - DNA, 483 bp, Cichla monoculus
aggaacatgtgtgcagaatatggcctggaagtcccgaggtcaaaatgggatatgcccccataggtggtagagaatgactgagcctgtgggacttccagatacacacagaaaaactggtaatggctaaccaaccagacatagtagtggtggacaagaagaggaaggaagccatagtaatagacgctgcaataccaagtgataccaacatcaggaagaaggaacacaagaagctcaagacataccaaggactcagagaggagtcagagaggatgtggaaggtgaagataacagtggtcccagtggtaatcggaacactcggggcagtgaccccaaactgggagagtggctccagcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 544 - DNA, 473 bp, Cichla monoculus
aggaacatgtgtgcagaatatggcctggaagtcccgaggtcaaaatgggatacaccccccagagctaagatcctgtgggacttccagatacagatggacaaactagtgatggctaaccaaccagacatagtagccatggacaagcagaggaggaaggctgcagagatagacgttgcaataccaagcggcagtaacatcagaaagaaggaacacgagaagttcaataaatatgaagggctgagagaagagcctgagaggatgtggaaggtaaacataacagtgatccctgtggtaatcggaacactccgggcagtgacccccaaactgggagagtggctccagcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 545 - DNA, 469 bp, Cichla monoculus
aggaacatgtgtgcagaatatgacctggaagtcccgaggtcaaaatgggatacacccccataggtggtcgagaatgacagtgctaagatcctgtgggacttccagatacagacagacaaacttgtgatggctaaccaaccagacatagtagtggtggacaagcagaggaagaaagccatagtgatagacattgcattaagaagatcaagaagaaggataacaagaagctcaagaaataccaagggctaagagaagagctagagaggatgtggaaggtgaaggtaaagtggaattgaaccttgggggcggtgacccccaaactgggagagtggctccagcagattccaggaatgacatctgagatttctgtccagaagagcgcagtcctaggaacagctaagatactgcgcaggacgctgaagctcccaggcctctggtagaggacccgagcttggaggagaaaccaccc

SEQ ID NO: 546 - DNA, 458 bp, Pterophyllum scalare
aggaacatgtgtgcagaacatgacctggaagtcctgaggtcaaaatggaacacgcccccaagggtggttgagaacaacagagctaagatcctgtgagacttccagatacagacagacaaacttgagatggctaaccaactggacatcgtagtggtggacaaaaaaggaagaaggccgtagtagatgttgcaataccaagtgatggcaacatcaagaagaaggaacacgagaagctcaataaatcccaagggctcagagaggagctggaaaggatgtagaaggtgaaagtaacaatggttcccgtggtaatcagaacactcggggaaactgggggagtggctccagcagattccagaaacgacatcggagatctctgtccagaagaggcaatactgggaacagctaagatactgcgcaggacctctggcagaggacccgagcttggaggagaaaccacc

SEQ ID NO: 547 - DNA, 459 bp, Pterophyllum scalare
aggaacatgtgtgcagaatatgacctggaagtcctgaggtcaaaatgggacacgcccccaagggtggttgggaacaacagagctaagatcttgtgagacttccagatacagacagacaaacttgagatggctaaccaactggacatcgtggtggtggacaaacaaaggaagaaggtcgtagtagacgttgcaataccaagtgacggcaacatcaagaagaaggaacacgagaagctcaataaatcccaagggctcagagaggagctggaaaggatgtagaaggtgaaagtaacaatggttcccgtggtaatcagaacacttggggaaactgggggagtggctccagcagattccagaaacgacatctgagatctctgtccagaagaggcaatactgggaacagctaagatactgcgcaggacctctggtagaggacccgagcttggaggagaaaccacc

SEQ ID NO: 548 - DNA, 457 bp, Pterophyllum scalare
aggaacatgtgtgcagaatatgacctggagtcctgaggtcaaaatgggacacgcccccaagggtggttgagaacaacagagctaagatcctgtgagactccagatacagacagacaaacttgagatggctaaccaactggacatcgtagtggtggacaaacaaaggaagaaggcgtagtagatgttgcaataccaagtgacggcaatatcaagaagaaggaacacgagaagctcaataaatcccaagggctcagagaggagctggaaagaatgtagaaggtgaaagtaacaatggttcccgtggtaatcagaacacttggggaaactgggggagtggctccagcagattccagaaacgacatctgagatctctgtccagaagagcgcaatactgggaacagctaagatactgcgcaggacctctggcagaggacccgagcttggaggagaaaccacc

SEQ ID NO: 549 - DNA, 459 bp, Pterophyllum scalare
aggaacatgtgtgcaggatatgacctggaagtcctgaggtcaaaatgggacacgcccccaagggtggttgagaacaacagagctaagatcctgtgagacttccagatacagacagacaaacttgagatggctaaccaactggacatcgtagtggtggacaaacaaaggaagaaggtcgtagtagatgttgcaataccaagtgacggcaacatcaagaagaaggaacacgagaagctcataaatcccaagggctcagagaggagctggaaaggatgtagaaggtgaaagtaacaatggttcccgtggtaatcagaacacttggggaaactgggggagtggctccagcagattccagaaacgacatctgagatctctgtccagaagagcgcaatactgggaacagctaagatactgcgcaggacctctggcagaggacccgagcttggaggagaaaccacc

SEQ ID NO: 550 - DNA, 460 bp, Pterophyllum scalare
aggaacatgtgtgcagaatatgacctggaagtcctgaggtcaaaatgggacacgcccccaagggtggttgagaacaacagagctaagatcctgtgagacttccagatacagacagacaaacttgagatggctaaccaactggacatcgtagtggtggacaaacaaaggaagaaggtcgtagtagatgttgcaataccaagtgacggcaacatcaagaagaaggaacacgagaagctcaataaatcccaagggctcagagaggagctggaaaggatgtagaaggtgaaagtaacaatggttcccgtggtaatcagaacacttggggaaactgggggagtggctccagcagattccagaaacgacatctgagatctctgtccagaagagtacaatactgggaacagctaagatactgcgcaggacctctggcagaggacccgagcttggaggagaaaccacc

SEQ ID NO: 551 - DNA, 460 bp, Pterophyllum scalare
aggaacatgtgtgcagaatatgacctggaagtcctgaggtcaaaatgggacacgcccccaagggtggttgagaacaacagagctaagatcctgtgagatttccagatacagacagacaaacttgagatggctaaccaactggacatcgtagtggtggacaaacaaaggaagaaggtcgtagtagatgttgcaataccaagtgacggcaacatcaagaagaaggaacacgagaagctcaataaatcccaagggctcagagaggagctggaaaggatgtagaaggtgaaagtaacaatggttcccgtggtaatcagaacacttggggaaactgggggagtggctccagcagattccagaaacgacatctgagatctctgtccagaagagcgcaatactgggaacagctaagatactgcgcaggacctctggcagaggacccgagcttggaggagaaaccacc

SEQ ID NO: 552 - DNA, 460 bp, Pterophyllum scalare; identical to SEQ ID NO: 519

SEQ ID NO: 553 - DNA, 459 bp, Pterophyllum scalare
aggaacatgtgtgcagaatatgacctggaagtcctgaggtcaaaatgggacacgcccccaagggtggttgggaacaacagagctaagatcttgtgagacttccagatacagacagacaaacttgagatggctaaccaactggacatcgtggtggtggacaaacaaaggaagaaggtcgtagtagacgttgcaataccaagtgacggcaacatcaagaagaaggaacacgagaagctcaataaatcccaagggctcagagaggagctggaaaggatgtagaaggtgaaagtaacaatggttcccgtggtaatcagaacacttggggaaactgggggagtggctccagcagattccagaaacgacatctgagatctctgtccagaagagcgcaatactgggaacagctaagatactgcgcaggacctctggagaggacccgagcttggaggagaaaccacc

SEQ ID NO: 554 - DNA, 459 bp, Pterophyllum scalare
aggaacatgtgtgcagaacatgacctggaagtcctgaggtcaaaatgggacacgcccccaagggtggttgtgaacaacagaggtaaaattcttccagattccagatacagacagacaaacttgcgatggctaaccaaccagacatcgtagtggtgaacaaacaaaggaagaaggctgtagtagacgttgcaataccaagtgatggcaatatcgagaagagggaacacgagaagcttgacaaataccaagggctcagagaggagctggaaaggatgtggaagatgaaggtaacagtggttcccgtggtaattggaacactcggggaaactgggggagtggctccagcagattccagaaacgacatcggagatctctgtccagaggagtgcaatactgggaacagctaagatactgcgcaggacctctggtagaggacccgagcttggaggagaaaccacc

SEQ ID NO: 555 - DNA, 460 bp, Pterophyllum scalare; identical to SEQ ID NO: 519

SEQ ID NO: 556 - DNA, 460 bp, Pterophyllum scalare; identical to SEQ ID NO: 519

SEQ ID NO: 557 - DNA, 459 bp, Pterophyllum scalare; identical to SEQ ID NO: 547

SEQ ID NO: 558 - DNA, 458 bp, Pterophyllum scalare
aggaacatgtgtgcagaatatgacctggagtcctgaggtcaaaatgggacacgcccccaagggtggttgagaacaacagagctaagatcctgtgagacttccagatacagacagacaaacttgagatggctaaccaactggacatcgtagtggtggacaaacaaaggaagaaggcgtagtagatgttgcaataccaagtgacggcaatatcaagaagaaggaacacgagaagctcaataaatcccaagggctcagagaggagctggaaagaatgtagaaggtgaaagtaacaatggttcccgtggtaatcagaacacttggggaaactgggggagtggctccagcagattccagaaacgacatctgagatctctgtccagaagagcgcaatactgggaacagctaagatactgcgcaggacctctggcagaggacccgagcttggaggagaaaccacc

SEQ ID NO: 559 - DNA, 457 bp, Pterophyllum scalare
aggaacatgtgtgcagaacatgacctggaagtcctgaggtcaaaatgggacacgcccccaagggtggttgagaacaacagaggtaagattcttccagattccagatacagacagacaaacttgcgatggctaaccaacagacatcgtagtggtgaacaaacaaaggaagaaggctgtagtagacgttgcaataccaagtgatggcaataccgagaagagggaacacgagaagctcgacaaataccaagggctcagagaggagctggaaaggatgtggaagatgaagtaacagtggttcccgtggtaatcagaacactcggggaaactgggggagtggctccagcagattccagaaacgacatcggagatctctgtccagaggagtgcaatactgggaacagctaagatactgcgcaggacctctggtagaggacccgagcttggaggagaaaccacc

SEQ ID NO: 560 - DNA, 459 bp, Pterophyllum scalare; identical to SEQ ID NO: 549

SEQ ID NO: 561 - DNA, 460 bp, Pterophyllum scalare; identical to SEQ ID NO: 519

SEQ ID NO: 562 - DNA, 460 bp, Pterophyllum scalare; identical to SEQ ID NO: 550

SEQ ID NO: 563 - DNA, 460 bp, Pterophyllum scalare; identical to SEQ ID NO: 519

SEQ ID NO: 564 - DNA, 459 bp, Pterophyllum scalare; identical to SEQ ID NO: 522

SEQ ID NO: 565 - DNA, 460 bp, Pterophyllum scalare; identical to SEQ ID NO: 519

SEQ ID NO: 566 - DNA, 458 bp, Pterophyllum scalare
aggaacatgtgtgcagaatatgacctggaagtcctgaggtcaaaatggaacacgcccccaagggtggttgagaacaacagagctaagatcctgtgagacttccagatacagacagacaaacttgagatggctaaccaactggacatcgtagtggtggacaaacaaaggaagaaggcgtagtagatgttgcaataccaagtgatggcaacatcaagaagaaggaacacgagaagctcaataaatcccaagggctcagagaggagctggaaaggatgtagaaggtgaaagtaacaatggttcccgtggtaatcagaacactggggaaactgggggagtggctccagcagattccagaaacgacatctgagatctctgtccagaagagtgcaatactgggaacagctaagatactgcgcaggacctctggcagaggacccgagcttggaggagaaaccacc

SEQ ID NO: 567 - DNA, 459 bp, Pterophyllum scalare; identical to SEQ ID NO: 553

SEQ ID NO: 568 - DNA, 458 bp, Pterophyllum scalare; identical to SEQ ID NO: 558

SEQ ID NO: 569 - DNA, 459 bp, Pterophyllum scalare; identical to SEQ ID NO: 554

SEQ ID NO: 570 - DNA, 459 bp, Pterophyllum scalare; identical to SEQ ID NO: 549

SEQ ID NO: 571 - DNA, 489 bp, Geophagus proximus
aggaacatgtgtgcagaatatgacctggaagtcccgagatcaaaatgggatacacccccaagggttgtcaagaataacataaccaagatcctgtgggacttccagatacagacagacaaacttgtgatggctaaccaaccggacataatagtggaggacaagcagaggaagaaagctgtagtgatagacgttgaaataccaagtgacggtagcatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 572 - DNA, 488 bp, Geophagus proximus
aggaacatgtgtgcagaatatgacctggaagtcccgagatcaaaatgggatacgcccccaagggttgtcgagaataaccaagctaagatcctgtgggacttccagatacagacagacaaacttgtgatggctaaccaaccagacatcatagtggtggacaagcagaggaagaaagctgtagtgatagacgttgaaataccaagtgacggtaacatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgctaaaatattgcgcaaaaccctcaaactcccaggcctcttaaaaaacccgagcttggaggaaaacccccca

SEQ ID NO: 573 - DNA, 489 bp, Geophagus proximus
aggaacatgtgtgcagaatatgatctggaagttccgaagtcaaaatgggatacgcccccaaggtttgtcgagaataacagagctgagttcctgtgggacttccagatacagacagacaaacttgtgatggctaaccaaccggacatcatagtggtggacaaacagagcaagaaggtcgtagtgatagacgttgaaataccaagtgacagcaacatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 574 - DNA, 488 bp, Geophagus proximus
aggaacatgtgtgcagaatatgacctggaaatcccaaggtcaaaataggatacgcccccaaggtttgtcgagaacaacagagctaagatcatgtgggacttccagatacagacagacaaacttgtgatggctaaccaaccggacatcatagtggtggacaagcagaggaagaaggccgtagtgatagacgttgcaataccaagtgacggcaacatcaggaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatattctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 575 - DNA, 488 bp, Geophagus proximus
aggaacatgtgtgcagaatatgacctggaagtcctgaaatcaaaatgggatacacccccaaggtttgtcgagaacaacagagctaagatcctgtgggacttccagatacagacagacaaacttgtgatggctaaccaaccggacatcatagtcgtggacaaacaaaggaagaaagctgtagtgatagacgttgcaatcccaagtgacagcaacatcaagaagaaagaacacgagaagcttgataaataccaagggcctacagaagagctggaaaggatgtgcaagttgaaggtaacagtggtttctgtggtaatcggaacactcggtgaagtgacccccaaactgggagagtggctccagcatatttctggaacaacttctgagatctttgtccgaggagggcactccgggaaacgcctaaaatattgcgcaaaaccctcaaactcccaggcctcttaaaaaacccgagcttggaggaaaacccccca

SEQ ID NO: 576 - DNA, 489 bp, Geophagus proximus
aggaacatgtgtgcagaatatgacctggaagtcccgagatcaaaatgggatacgcccccaaggtttgttgagaacaacagagctaagatcctgtgggacttccagatacagacagacaaacttgtgctggctaaccaaccagacatcatagtggtggacaagcaaaggaagaaagccgtagtgatagacgttgcaataccaagtgacggcaacatcaggaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 577 - DNA, 484 bp, Geophagus proximus
aggaacatgtgtgcagaatatgtcctggaagtcccgagttcaaaatgggatacgcccccaaggtttgtcgagaacaacagagctaagatcctgtgggacttccacgtacagacagacaaacctgtgatggctaaccaaccggacatcatagtgtggacaaacaaaggaagaaagctgtagcgatagacgttgcaatcccaagtgacagcaacatcaagaagaaagaacacgagaagcttgataaataccgagggcctacagaagagttggaaaggatgtgcaagttgaaggtaacagtggtccctgtggtaactggaacactcggtgaagtgacccccaaactgggagagtggctccagcatatttctggaacaacttctgagatctttgtccagaggcactccgggaaacgcctaaaatattgcgcaaaaccctcaaactcccaggcctcttaaaaaacccgagcttggaggaaaacccccca

SEQ ID NO: 578 - DNA, 489 bp, Geophagus proximus; identical to SEQ ID NO: 529

SEQ ID NO: 579 - DNA, 484 bp, Geophagus proximus; identical to SEQ ID NO: 577

SEQ ID NO: 580 - DNA, 489 bp, Geophagus proximus
aggaacatgtgtgcagaatatgacttggaagtcccgagatcaaaatgggatacgcccccaagggttgtcaagaataacataaccaagatcctgtgggacttccagatacagacagacaaacttgtgatggctaaccaaccggacataatagtggaggacaagcagaggaagaaagctgtagtgatagacgttgaaataccaagtgacggtagcatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 581 - DNA, 489 bp, Geophagus proximus
aggaacatgtgtgcagaatatgacctggaagtcccgagatcaaaatgggatacgcccccaagggttgtcgagaataaccaagctaagatcctgtgggacttccagatacagacagacaaacttgtgatggctaaccaaccagacatcatagtggtggacaagcagaggaagaaagctgtagtgatagacgttgaaataccaagtgacggtaacatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 582 - DNA, 489 bp, Geophagus proximus; identical to SEQ ID NO: 573

SEQ ID NO: 583 - DNA, 489 bp, Geophagus proximus
aggaacatgtgtgcagaatatgacctggaaatcccaaggtcaaaataggatacgcccccaaggtttgtcgagaacaacagagctaagatcatgtgggacttccagatacagacagacaaacttgtgatggctaaccaaccggacatcatagtggtggacaagcagaggaagaaggccgtagtgatagacgttgcaataccaagtgacggcaacatcaggaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 584 - DNA, 488 bp, Geophagus proximus
aggaacatgtgtgcagaatatgacctggaagtcctgaaatcaaaatgggatacgcccccaaggtttgtcgagaacaacagagctaagatcctgtgggacttccagatacagacagacaaacttgtgatggctaaccaaccggacatcatagtcgtggacaaacaaaggaagaaagctgtagtgatagacgttgcaatcccaagtgacagcaacatcaagaagaaagaacacgagaagcttgataaataccaagggcctacagaagagctggaaaggatgtgcaagttgaaggtaacagtggtttctgtggtaatcggaacactcggtgaagtgacccccaaactgggagagtggctccagcatatttctggaacaacttctgagatctttgtccgaggagggcactccgggaaacgcctaaaatattgcgcaaaaccctcaaactcccaggcctcttaaaaaacccgagcttggaggaaaacccccca

SEQ ID NO: 585 - DNA, 489 bp, Geophagus proximus
aggaacatgtgtgcagaatatgacctggaagtcccgagatcaaaatgggatacgcccccaaggtttgttgagaacaacagagctaagatcctgtgggacttccagatacagacagacaaacttgtgctggctaaccaaccggacatcatagtggtggacaagcaaaggaagaaagccgtagtgatagacgttgcaataccaagtgacggcaacatcaggaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 586 - DNA, 489 bp, Geophagus proximus
aggaacatgtgtgcagaatatgtcctggaagtcccgagttcaaaatgggatacgcccccaaggtttgtcgagaacaacagagctaagatcctgtgggacttccacgtacagacagacaaacctgtgatggctaaccaaccggacatcatagtcgtggacaaacaaaggaagaaagctgtagcgatagacgttgcaatcccaagtgacagcaacatcaagaagaaagaacacgagaagcttgataaataccgagggcctacagaagagttggaaaggatgtgcaagttgaaggtaacagtggtccctgtggtaactggaacactcggtgaagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 587 - DNA, 489 bp, Geophagus proximus
aggaacatgtgtgcagaatatgatctggaagtcccgagatcaaaatgggatacgcccccaagggtggtcaagaataacataaccaagatcctgtgggacttccagatacagacagacaaacttgtgatggctaaccaaccggacataatagtggaggacaagcagaggaagaaagctgtagtgatagacgttgaaataccaagtgacggtagcatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 588 - DNA, 489 bp, Geophagus proximus
aggaacatgtgtgcagaatatgacctggaagtcccgagatcaaaatgggatacgcccccaagggtggtcgagaataaccaagctaagatcctgtgggacttccagatacagacagacaaacttgtgatggctaaccaaccagacatcatagtggtggacaagcagaggaagaaagctgtagtgatagacgttgaaataccaagtgatggcagcatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 589 - DNA, 488 bp, Geophagus proximus
aggaacatgtgtgcagaatatgatccggaagttccgaagtcaaaatgggatacgcccccaaggttggtcgagaataacagagctaagttcccgtggacttccagatacagacagacaaacttgtgatggctaaccaaccggacatagcagcattggacagacagagcaagaaggtcgtagtgatagacgttgaaataccaagtgacagcaacatcaagaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccagaggagggcactccgggaaacgcctaaaatattgcgcaaaaccctcaaactcccaggcctcttaaaaaacccgagcttggaggaaaacccccca

SEQ ID NO: 590 - DNA, 489 bp, Geophagus proximus; identical to SEQ ID NO: 527

SEQ ID NO: 591 - DNA, 488 bp, Geophagus proximus
aggaacatgtgtgcagaatatgtcctggaagtcctgaaatcaaaatgggatacgcccccaaggtttgtcgagaacaacagagctaagatcctgtgggacttccacgtacagacagacaaacctgtgatggctaaccaaccggacatcatagtcgtggacaaacaaaggaagaaagctgtagcgatagacgttgcaatcccaagtgacagcaacatcaagaagaaagaacacgagaagcttgataaataccgagggcctacagaagagctggaaaggatgtgcaagttgaaggtaacagtggtctctgtggtaactggaacactcggtgaagtgacccccaaactgggagagtggctccagcatatttctggaacacttctgagatctttgtccagaggagggcactccgggaaacgcctaaaatattgcgcaaaaccctcaaactcccaggcctcttaaaaaacccgagcttggaggaaaacccccca

SEQ ID NO: 592 - DNA, 487 bp, Geophagus proximus
aggaacatgtgtgcagaatatgacctggaagtcccgagatcaaaatgggatacgcccccaaggtttgttgagaacaacagagctaagatcatgtgggacttccagatacagacagacaaacttgtgctggctaaccaaccgacatcatagtggtggacaagcagaggaagagggccgtagtgatagacgttgcaataccaagtgacggcaacatcaggaagaaagaacacgagaagctcgataaataccaagggcctacagaagagttggaaaggatgtgcaagttgaaggtaacagtggttcccgtggtaatcggaacactcggagcagtgacccccaaactgggagagtggctccagcatatttctggaacaacttctgagatctttgtccgaggagggcactccgggaaacgcctaaaatattgcgcaaaaccctcaaactcccaggcctcttaaaaaacccgagcttggaggaaaacccccca

SEQ ID NO: 593 - DNA, 489 bp, Geophagus proximus; identical to SEQ ID NO: 530

SEQ ID NO: 594 - DNA, 490 bp, Astronotus ocellatus
aggaacatgtgtgcagaatatgacatggaagtcccgaggtcaaaatgggctacgcccccatgggtggtagagaatgaccaagctaagatcctgtgggacttccaatacagatagacaaactggtaatggctaaccaaccggacatagtagtggtggacaagaagaggaaggaagccgtagtgatagatgttgcaataccgagtgatggcaacatcagaaagaaggaacacgagaagctcgaaaagtaccaagggctgagagaagagctgcagaggatgtggagggtgaagataacagtggtcccagtggtaatcggaacactcggggcagtgacccaccagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 595 - DNA, 491 bp, Astronotus ocellatus
aggaacatgtgtgcagaatatgacatggaagtcccgaggtcaaaatgggctacgcccccatgggtggtagagaatgaccaagctaagatcctgtgggacttccaatacagatagacaaactggtaatggctaaccaaccggacatagtagtggtggacaagaagaggaaggaagccgtagtgatagatgttgcaataccgagtgatggcaacatcagaaagaaggaacacgagaagctcgaaaagtaccaagggctgagagaagagctgcagaggatgtggagggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 596 - DNA, 490 bp, Astronotus ocellatus
aggaacatgtgtgcagaatatggcctggaagtcccgaggtcaaaatgggatacgcccccataggtggtagagcataaccaagcttagatcctgtgggacttccaatacagatggacaaactagtgatggctaaccaaccagacatagtagcggtggacaagcagaggaggaaggctgcagagatagacgttgcaataccaagcggcagtaacatcagaaagaaggaacacgagaagttcaataaataccaagggctaagagaagagcctgagaggatgtggaaggtaaacataacagtgatccctgtggtaatcggaacactcggggcagtgacccccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 597 - DNA, 491 bp, Astronotus ocellatus
aggaacatgtgtgcagaatatggcctggaagtcccgaggtcaaaatgggatatgcccccataggtggtagagaatgaccaagctaagagcctgtgggacttccaatacacacagaaaaactggtaatggctaaccaaccagacatagtagtggtggacaagaagaggaaggaagccatagtaatagacgctgcaataccaagtgataccaacatcaggaagaaggaacacaagaagctcaagacataccaaggactaagagaggagccagagaggatgtggaaggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 598 - DNA, 492 bp, Astronotus ocellatus; identical to SEQ ID NO: 533

SEQ ID NO: 599 - DNA, 490 bp, Astronotus ocellatus; identical to SEQ ID NO: 537

SEQ ID NO: 600 - DNA, 490 bp, Astronotus ocellatus; identical to SEQ ID NO: 594

SEQ ID NO: 601 - DNA, 491 bp, Astronotus ocellatus
aggaacatgtgtgcagaatatgacatggaagtcccgaggtcaaaatgggctacgcccccatgggtggtagagaatgaccgagctaagatcctgtgggacttccaatacagatagacaaactggtaatggctaaccaaccggacatagtagtggtggacaagaagaggaaggaagccgtagtgatagatgttgcaataccgagtgatggcaacatcagaaagaaggaacacgagaagctcgaaaagtaccaagggctgagagaagagctgcagaggatgtggagggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 602 - DNA, 491 bp, Astronotus ocellatus
aggaacatgtgtgcagaatatggcctggaagtcccgaggtcaaaatgggatatgcccccataggtggtagagaatgaccaagctaagatcctgtgggacttccaatacagatagaaaaactggtaatggctaaccaaccagacatagtagtggtggacaagaagaggaaggaagccgtagtaatagacgttgcaataccaagtgatagcaacatcagaaagaaggaacacaagaagctcaaaaaataccaaggactaagagaggagccagagaggatgtggaaggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 603 - DNA, 491 bp, Astronotus ocellatus
aggaacatgtgtgcagaatatggcctggaagtcccgaggtcaaaatgggatacacccccataggtggtagagcataaccgagcttagatcctgtgggacttccaatacagatggacaaactagtgatggctaaccaaccagacatagtagcggtggacaagcagaggaggaaggctgcagagatagacgttgcaataccaagcggcagtaacatcagaaagaaggaacacgagaagttcaataaataccaagggctaagagaagagcctgagaggatgtggaaggtaaacataacagtgatccctgtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 604 - DNA, 491 bp, Astronotus ocellatus
aggaacatgtgtgcagaatatggcctggaagtcccgaggtcaaaatgggatatgcccccataggtggtagagaatgaccaagctaagatcctgtgggacttccaatacacacagaaaaactggtaatggctaaccaaccggacatagtagtggtggacaagaagaggaaggaagccatagtaatagacgttgcaataccaagtgataccaacatcagaaagaaggaacacaagaagctcaagaaataccaaggactaagagaggagccagagaggatgtggaaggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 605 - DNA, 490 bp, Astronotus ocellatus
aggaacatgtgtgcagaatatggcctggaagtcccgaggtcaaaatgggatacacccccataggtggtagagcataaccgagcttagatcctgtgggacttccaatacagatggacaaactagtgatggctaaccaaccagacatagtagcggtggacaagcagaggaggaaggctgcagagatagacgttgcaataccaagcggcagtaacatcagaaagaaggaacacgagaagttcaataaataccaagggctaagagaagagcctgagaggatgtggaaggtaaacataacagtgatccctgtggtaatcggaacactcggggcagtgacccaccaagcttaggtagaggacccgagcttggaggagaaaccactctgagatttctgtccagaagagcgcagtcctaggaacagctaagatactgcgcaggacgctgaagctcccaggcctctggtagaggacccgagcttggaggagaaaccacc

SEQ ID NO: 606 - DNA, 490 bp, Astronotus ocellatus
aggaacatgtgtgcagaatatggcctggaagtcccgaggtcaaaatgggatacgcccccataggtggtagagcataaccaagcttagatcctgtgggacttccaatacagatggacaaactagtgatggctaaccaaccagacatagtagcggtggacaagcagaggaggaaggctgcagagatagacgttgcaataccaagcggcagtaacatcagaaagaaggaacacgagaagttcaataaataccaagggctaagagaagagcctgagaggatgtggaaggtaaacataacagtgatccctgtggtaatcggaacactcggggcagtgacccaccaagcttaggtagaggacccgagcttggaggagaaaccacctctgagatttctgtccgaagagcgcagtcctaggaacagctaagatactgcgcaggacgctgaagctcccaggcctctggtagaggacccgagcttggaggagaaaccacc

SEQ ID NO: 607 - DNA, 491 bp, Astronotus ocellatus; identical to SEQ ID NO: 595

SEQ ID NO: 608 - DNA, 491 bp, Astronotus ocellatus; identical to SEQ ID NO: 601

SEQ ID NO: 609 - DNA, 490 bp, Astronotus ocellatus
aggaacatgtgtgcagaatatggcctggaagtcccgaggtcaaaatgggatatgcccccataggtggtagagaatgaccaagctaagatcctgtgggacttccaatacagatagaaaaactggtaatggctaaccaaccagacatagtagtggtggacaagaagaggaaggaagccgtagtaatagacgttgcaataccaagtgatagcaacatcagaaagaaggaacacaagaagctcaaaaaataccaaggactaagagaggagccagagaggatgtggaaggtgaagataacagtggtcccagtggtaatcggaacactcggggcagtgacccaccaagcttaggtagaggacccgagctggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 610 - DNA, 491 bp, Astronotus ocellatus; identical to SEQ ID NO: 603

SEQ ID NO: 611 - DNA, 491 bp, Astronotus ocellatus; identical to SEQ ID NO: 604

SEQ ID NO: 612 - DNA, 491 bp, Astronotus ocellatus; identical to SEQ ID NO: 603

SEQ ID NO: 613 - DNA, 490 bp, Astronotus ocellatus; identical to SEQ ID NO: 596

SEQ ID NO: 614 - DNA, 491 bp, Astronotus ocellatus
aggaacatgtgtgcagaatatggcctggaagtcccgaggtcaaaatgggatacgcccccatgggtggtagagaatgaccgagctaagatcctgtgggacttccaatacagacagacaaactggtaatggctaaccaaccggacatagtagtggtggacaagaagaggaaggaagccgtagtgatagatgttgcaataccgagtgatggcaacatcaggaagaaggaacacgagaagctcgaaaagtaccaagggctgagagaagagctgcagaggatgtggagggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 615 - DNA, 491 bp, Astronotus ocellatus
aggaacatgtgtgcagaatatggcatggaagtcccgaggtcaaaatgggatacgcccccatgggtggtagagaatgaccgagctaagatcctgtgggacttccaatacagacagacaaactggtaatggctaaccaaccggacatagtagtggtggacaagaagaggaaggaagccgtagtgatagatgttgcaataccgagtgatggcaacatcaggaagaaggaacacgagaagctcgaaaagtaccaagggctgagagaagagctgcagaggatgtggagggtgaagataacagtggtcccagtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 616 - DNA, 491 bp, Astronotus ocellatus; identical to SEQ ID NO: 597

SEQ ID NO: 617 - DNA, 491 bp, Astronotus ocellatus
aggaacatgtgtgcagaatatggcctggaagtcccgaggtcaaaatgggatacacccccataggtggtagagcataaccaagcttagatcctgtgggacttccaatacagatggacaaactagtgatggctaaccaaccagacatagtagcggtggacaagcagaggaggaaggctgcagagatagacgttgcaataccaagcggcagtaacatcagaaagaaggaacacgagaagttcaataaataccaagggctaagagaagagcctgagaggatgtggaaggtaaacataacagtgatccctgtggtaatcggaacactcggggcagtgacccaccaagcttaggtagaggacccgagcttggaggagaaaccacctctgagatttctgtccagaagagcgcagtcctaggaacagctaagatactgcgcaggacgctgaagctcccaggcctctggtagaggacccgagcttggaggagaaaccacc

SEQ ID NO: 618 - DNA, 491 bp, Astronotus ocellatus; identical to SEQ ID NO: 597

SEQ ID NO: 619 - DNA, 491 bp, Astronotus ocellatus; identical to SEQ ID NO: 617

SEQ ID NO: 620 - DNA, 490 bp, Astronotus ocellatus; identical to SEQ ID NO: 537

SEQ ID NO: 621 - DNA, 490 bp, Cichla monoculus
aggaacatgtgtgcagaatatgacctggaagtcccgaggtcaaaatgggctacgcccccacaggtggtagagaatgaccaagctaagattctgtgggacttcctgatacagacagacaaactggtaatggctaaccaaccggacatagtagtggtggacaagaagaggaaggaagctgtagtgatagatgttgcaataccgagtgatggcaacatcaggaagaaggaacacgagaagctcgaaaagtaccaagggctgagagaagagctgcagaggatgtggagggtgaaggttgagtgttccccgtggtcatcggaacactcggggcgatgacccccacactgggagaggggctcccgcacattccaggaacaacatctgagatctctgtccagaagagcgcagtcctaggaacagctaagatactgcgcaggaccctgaagctcccaggcctctggtagaggacccgagcttggaggagaaaccaccc

SEQ ID NO: 622 - DNA, 491 bp, Cichla monoculus
aggaacatgtgtgcagaatatgacatggaagtcccgaggtcaaaatgggctacgcccccacgggtggtagagaatgaccgagctaagatcctgtgggacttccagatacagacagacaaactggtaatggctaaccaaccggacatagtagtggtggacaagaagaggaaggaagccgtagtgatagatgttgcaataccgagtgatggcaacatcaggaagaaggaacacgagaagctcgaaaagtaccaagggctgagagaagagctgcagaggatgtggagggtgaagataacagtggtcccagtggtaatcggaacactcggggcagtgacccccaagctggtagagtggctctcgcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 623 - DNA, 490 bp, Cichla monoculus
aggaacatgtgtgcagaatatgacctggaagtcctgaggtcaaaatgggctacgcccccacgggtggtagagaatgaccgagctaagatcctgtgggacttccagacacaggaagacaaactggtgatggctaaccaaccggacatagtagtggtggacaagaagaggaaggaagccgtagtgatagatgttgcgataccgagtgatggcaacatcaggaagaaggaacacgagaagctcaaaaagtaccaagggctgagagaagagctgcagatgatgtggagggtgaaggtaacagtggtcccgtggtcatcggaacacttggggcagtgacccccaaactgggagagtggctctcgcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 624 - DNA, 491 bp, Cichla monoculus
aggaacatgtgtgcagaatatgacctggaagtcccgagttcaaaatgggatacggccccacgggtggtagagaatgaccaagctaagatcctgtgggactgctagatacagacagacaaactagtgatggcaaaccaaccagacatagtagtggtggacaagaagaggaaggaagccgtagtgataggcactgtaataccaagtgatagcgacatcaggaagaaagaacaaaagaagctcgagaaataccaagggctgagagaagagctgcagaggatgtggaaggtgaagataacagtggtccccgtggtaactggaacacttggggcagtgacccccaaactgggagagtggctccagcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 625 - DNA, 490 bp, Cichla monoculus
aggaacatgtgtgcagaatatggcctggaagtctcaagtttaaaatgggatatgcccccacgggtggacgagaatgaccaagcttagatcctgtgggacttccagatacagacaaacaaactgctaacggctaacccacctaacatagtagtggtggacaagaagaagaagaaagccatagtgatagacgttgcaataccaagtgatctcaacatcaggaagaaggaacacgagaagctcgagaaataccaagggctcagagagggctagagagaatgtggaaggtgaaggtaacagtggtccttgtggtaatcggaacactcgggggagtgacccccaaactgggagagtggctccagcagattccaggaatgacatctgagatttctgtccagaagagcgcagtcctaggaacagctaagatactgcgcaggaccctgaagctcccaggcctctggtagaggacccgagcttggaggagaaaccaccc

SEQ ID NO: 626 - DNA, 490 bp, Cichla monoculus
aggaacatgtgtgcagaatatggcctggaagtcccgaggtcaaaatgggatatgcccccataggtggtagagaatgactgagctaagatcctgtgggacttccaatacacacagaaaaactggtaatggctaaccaaccagacatagtagtggtggacaagaagaggaaggaagccatagtaatagacgctgcaataccaagtgataccaacatcaggaagaaggaacacaagaagctcaagacataccaaggactcagagaggagtcagagaggatgtggaaggtgaagataacagtggtcccagtggtaatcggaacactcggggcagtgacccccaaactgggagagtggctccagcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 627 - DNA, 490 bp, Cichla monoculus
aggaacatgtgtgcagaatatggcctggaagtcccgaggtcaaaatgggatacacccccacgggtggcagagaatgaccaagctaagatcctgtgggacttccagatacagatggacaaactagtgatggctaaccaaccagacatagtagtgatggacaagcagaggaggaaggctgcagagatagacgttgcaataccaagtggtagcaacatcagaaagaaggaacacgagaagttcaataaatatgaagggctgagagaaggctagagaggatgtggaaggtaaacataacagtgatccctgtggtaatcggaacactcggggcagtgacccccaaactgggagagtggctccagcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 628 - DNA, 489 bp, Cichla monoculus
aggaacatgtgtgcagaatatgacctggaagtcccgaggtcaaaatgggatacacccccataggtggtcgagaatgacagtgctaagatcctgtgggacttccagatacagacagacaaacttgtgatggctaaccaaccagacatagtagtggtggacaagcagaggaagaaagccatagtgatagacattgcattaagaagtgatggcaacatcaagaagaaggaaaacaagaagctcaagaaataccaagggctaagagaagagctagagaggatgtggaaggtgaaggtaaagtggtcccgtggtaatcggaaccttgggggcggtgacccccaaactgggagagtggctccagcagattccaggaatgacatctgagatttctgtccagaagagcgcagtcctaggaacagctaagatactgcgcaggacgctgaagctcccaggcctctggtagaggacccgagcttggaggagaaaccaccc

SEQ ID NO: 629 - DNA, 490 bp, Cichla monoculus
aggaacatgtgtgcagaatatgacctggaagtcccgaggtcaaaatgggctacgcccccacaggtggtagagaatgaccaagctaagattctgtgggacttcctgatacagacagacaaactggtaatggctaaccaaccggacatagtagtggtggacaagaagaggaaggaagctgtagtgatagatgttgcaataccgagtgatggcaacatcaggaagaaggaacacgagaagctcgaaaagtaccaagggctgagagaagagctgcagaggatgtggagggtgaaggttgagtgttccccgtggtcatcggaacactcggggcgatgacgcccacactgggagaggggccccctctcattccaggaatgacatctgagatttctgtccagaagagcgcagtcctaggaacagctaagatactgcgcaggacgctgaagctcccaggcctctggtagaggacccgagcttggaggagaaaccaccc

SEQ ID NO: 630 - DNA, 491 bp, Cichla monoculus
aggaacatgtgtgcagaatatgacatggaagtcccgaggtcaaaatgggctacgcccccacgggtggtagagaatgaccgagctaagatcctgtgggacttccagatacagacagacaaactggtaatggctaaccaaccggacatagtagtggtggacaagaagaggaaggaagccgtagtgatagatgttgcaataccgagtgatggcaacatcaggaagaaggaacacgagaagctcgaaaagtaccaagggctgagagaagagctgcagaggatgtggagggtgaagataacagtggtcccagtggtaatcggaacactcggggcagtgacccaagccctggtagagtggctctcgcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 631 - DNA, 489 bp, Cichla monoculus
aggaacatgtgtgcagaatatgacctggaagtcctgaggtcaaaatgggctacgcccccacgggtggtagagaatgaccgagctaagatcctgtgggacttccgacacaggaagacaaactggtgatggctaaccaaccggacatagtagtggtggacaagaagaggaaggaagccgtagtgatagatgttgcgataccgagtgatggcaacatcaggaagaaggaacacgagaagctcaaaaagtaccaagggctgagagaagagctgcagatgatgtggagggtgaaggtaacagtggtcccgtggtcatcggaacacttggggcagtgacccccaaactggtagagtggctctcgcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 632 - DNA, 489 bp, Cichla monoculus
aggaacatgtgtgcagaatatgacctggaagtcccgagttcaaaatgggatacggccccacgggtggtagagaatgaccaagctaagatcctgtgggactgctagatacagacagacaaactagtgatggcaaaccataagacatagtagtggtggacaagaagaggaaggaagccgtagtgataggcactgtaataccaagtgatagcgacatcaggaagaaagaacaaaagaagctcgagaaataccaagggctgagagaaagctgcagaggatgtggaaggtgaagataacagtggtccccgtggtaactggaacacttggggcagtgacccccaaactgggagagtggctccagcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 633 - DNA, 490 bp, Cichla monoculus
aggaacatgtgtgcagaatatggcctggaagtctcaagtttaaaatgggatatgcccccacgggtggacgagaatgaccaagcttagatcctgtgggacttccagatacagacaaacaaacggctaacggctaacccacctaacccaatagtggtggacaagaagaagaagaaagccatagtgatagacgttgcaataccaagtgatctcaacatcaggaagaaggaacacgagaagctcgagaaataccatgggctcagagagggctagagagaatgtggaaggtgaaggtaacagtggtccttgtggtaatcggaacactcgggggagtgacccccaaactgggagagtggctccagcagattccaggaatgacatctgagatttctgtccagaagagcgcagtcctaggaacagctaagatactgcgcaggacgctgaagctcccaggcctctggtagaggacccgagcttggaggagaaaccaccc

SEQ ID NO: 634 - DNA, 479 bp, Cichla monoculus
aggaacatgtgtgcagaatatgacctggaagtcccgaggtcaaaatgggatacacccccataggtggtcgagaatgacagtgctaagatcctgtgggacttccagatacagacagacaaacttgtgatggctaaccaaccagacatagtagtggtggacaagcagaggaagaaagccatagtgatagacattgcattaagaagatcaagaagaaggataacaagaagctcaagaaataccaagggctaagagaagagctagagaggatgtggaaggtgaaggtaaagtggtccctgtggtaattgaaccttgggggcggtgacccccaaactgggagagtggctccagcagattccaggaatgacatctgagatttctgtccagaagagcgcagtcctaggaacagctaagatactgcgcaggacgctgaagctcccaggcctctggtagaggacccgagcttggaggagaaaccaccc

SEQ ID NO: 635 - DNA, 490 bp, Cichla monoculus
aggaacatgtgtgcagaatatgacctggaagtcccgaggtcaaaatgggctacgcccccacaggtggtagagaatgaccaagctaagattctgtgggacttcctgatacagacagacaaactggtaatggctaaccaaccggacatagtagtggtggacaagaagaggaaggaagctgtagtgatagatgttgcaataccgagtgatggcaacatcaggaagaaggaacacgagaagctcgaaaagtaccaagggctgagagaagagctgcagaggatgtggagggtgaaggttgagtgttccccgtggtcatcggaacactcggggcgatgacgcccacactgggagaggggctcccgcacattccaggaacaacatctgagatctctgtccagaagagcgcagtcctaggaacagctaagatactgcgcaggacgctgaagctcccaggcctctggtagaggacccgagcttggaggagaaaccaccc

SEQ ID NO: 636 - DNA, 491 bp, Cichla monoculus; identical to SEQ ID NO: 630

SEQ ID NO: 637 - DNA, 487 bp, Cichla monoculus
aggaacatgtgtgcagaatatgacctggaagtcctgaggtcaaaatgggctacgcccccacgggtggtagagaatgaccgagctaagatcctgtgggacttcccacaggaagacaaactggtgatggctaaccaaccggacatagtagtggtggacaagaagaggaaggaagccgtagtgatagatgttgcgataccgagtgatggcaacatcaggaagaaggaacacgagaagctcaaaaagtaccaagggctgagagaagagctgcagatgatgtggagggtgaaggtaacagtggtcccgtggtcatcggaacacttggggcagtgacccccaaactgggagagtggctctcgcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 638 - DNA, 491 bp, Cichla monoculus; identical to SEQ ID NO: 624

SEQ ID NO: 639 - DNA, 490 bp, Cichla monoculus
aggaacatgtgtgcagaatatggcctggaagtctcaagtttaaaatgggatatgcccccacgggtggacgagaatgaccaagcttagatcctgtgggacttccagatacagacaaacaaactgctaacggctaacccacctaacatagtagtggtggacaagaagaagaagaaagccatagtgatagacgttgcaataccaagtgatctcaacatcaggaagaaggaacacgagaagctcgagaaataccaagggctcagagagggctagagagaatgtggaaggtgaaggtaacagtggtccttgtggtaatcggaacactcgggggagtgacccccaaactgggagagtggctccagcagattccaggaatgacatctgagatttctgtccagaagagcgcagtcctaggaacagctaagatactgcgcaggacgctgaagctcccaggcctctggtagaggacccgagcttggaggagaaaccaccc

SEQ ID NO: 640 - DNA, 489 bp, Cichla monoculus
aggaacatgtgtgcagaatatggcctggaagtcccgaggtcaaaatgggatatgcccccataggtggtagagaatgactgagctaagatcctgtgggacttccaatacacacagaaaaactggtaatggctaaccaaccagacatagtagtggtggacaagaagaggaaggaagccatagtaatagacgctgcaataccaagtgataccaacatcaggaagaaggaacacaagaagctcaagacataccaaggactcagagaggagtcagagaggatgtggaaggtgaagataacagtggtcccagtggtaatcggaacactcggggcagtgaccccaaactgggagagtggctccagcagattccaggtacaacatctgagatctctgtccagaagagtgcagtcctgggaacagctaagatactgcgcaggaccctcaatctcccaggcctctggtaaaggacccgagcttggaggagaaaccaccc

SEQ ID NO: 641 - DNA, 490 bp, Cichla monoculus; identical to SEQ ID NO: 627

SEQ ID NO: 642 - DNA, 489 bp, Cichla monoculus; identical to SEQ ID NO: 628

SEQ ID NO: 643 - DNA, 377 bp, Silene latifolia
gatgcgcgcagctttcattaaaataaaagtaagagtttacatgaaattggtggggagccgagagacaatctaggctcccacacccttagcaatagcaaagctaagcctagtaaaaatgtaagcggctacccgagcccccgcatcctgagatatcgagaatttctggatccgcttgagcaaggcaacagcatccgaacccaactccccaagggaagagaaagagaaaggtaggaaaccataacccgctaccgcgcacaaatccccatacttagcacactttcgctgagcagcatcagcgacaaccggcccggcacaaaatctgtcaacccagtctgagtcaaaggtgaagaacctgtcaggtcaacgcacacatcacg

SEQ ID NO: 644 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccacttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgctaacccagtctgagtcaaaggtgaagaacccgtcaggtcaacgcacacatcacg

SEQ ID NO: 645 - DNA, 377 bp, Silene latifolia
gatgcgcgcagctttcattaatagaaaaacaaagtttacatgaaattggtggggagccgagaaacaagctgggctcccggacccttagcaacagcaaagctaagtctagtaaaaatgtaagcggccacccgagcccccgcatcctgagataccgagaatttctggatccgcttgagcaaggcaacagcatccgaacccagctccccaagtgatgataaagagaagggaaggaaaccataacccgctgtcgcgcacaaatccatgtacttagcacacttacgctgagcagcatcagcaacaacccggccaagcacaaaatccgtcatcccaatctgagtcaaaggagaagaccatgtcaagtcaacgcacacatcacg

SEQ ID NO: 646 - DNA, 378 bp, Silene latifolia
gatgcgcgcagctttcattaaaataaaaataaaagtttacatgaaattggtggggagccgagatacaatctgggctcccacacccttagcaatagcaaagctaagtctagtaaaaatgtaagcggccacctgagcccccgcatcctgagataccgagaatttatggatccgcttgagcaaggttacatcatccgaacccagctccccaagagatgagaaagagaagggaaggaaaccatatcccgcttccgcacacaaatccccgtacttagcacacttatgctgagcagcatcagcaataacccggccaggcacaaaatctgtcatcccagtctgagtcaaaggagaagaccatgtcaagtcaacgcacacatcacg

SEQ ID NO: 647 - DNA, 379 bp, Silene latifolia
gatgcgcgcagctttcattaaaagaaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacccgtcaggtcaacgcacacatcacg

SEQ ID NO: 648 - DNA, 378 bp, Silene latifolia
gatgcgcgcagctttcattaaaagaaaaacaaaagtttacatgaaattggtggggagccgagaaacaagctgggctcccacacccttagcaacagcaaagctaagtctagtaaaaatgtaagcggccacctgagcccccgcatcctgagataccgagaatttctggatccgcttgagcaaggcaacagcatccgaacccaactccccaagtgatgagaaagagaatggaaggaaaccataacccgctgccgcgcacaaatccccatacttagcacacttccgcagagcagcatcagcaacaacccgtcccggcacaaaattcgttatcccagtctgagtcaaaggaaaggacccggtcaagtcaacgcacacatcacg

SEQ ID NO: 649 - DNA, 378 bp, Silene latifolia
gatgcgcgcagctttcattaaaagaaaaataaaagtttacatgaaattggtggggagccgagaaacaatctgggcccccacaactttagcaacagcaaagctaagtctagtgaaaatataagcagccacccgagcccccgcatcctgagataccgagaatttctggatccgcttgagcaaggcaacaacatctgaccccagctcctcaagtgaagagaaagaaaaggtaaggaaaccataaccaactgccgcacataactccccatacttagcacacttacgctgagcagcatcagcgacaacccggccaagcacaaaatccgtcatcccaatctgagtcaaaggagaagaccatgtcaagtcaacgcacacatcacg

SEQ ID NO: 650 - DNA, 379 bp, Silene latifolia
gatgcgcgcagctttcattataataaaaataaaaggtttacatgaaattggtggggagccgagagacaatctgggctcccacacccttagcagtagtaaagctaatacgagtaaaaatgtaagcggctacccgagccccagcatcctgagataccgagaatttctggatccgcttgagcaaggcaacagcatccgaactcaactccccaagcgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacctgtcaggtcaacgcacacatcacg

SEQ ID NO: 651 - DNA, 376 bp, Silene latifolia
gatgcgcgcagctttcattcagaaaaataaaagtttacatgaaattggtggagagcctataaacaatctgggctcccacacccttagcaacagcaaagctaaatctagtaaaaatgtaaacggccacccgagccctcgcatcctgagatatcgagaatttatggatccgcttgagcaaggcaacagcatccgaacccatctccccaagtgatgagaccgagaatggaagaaaaccataacccgctaccacgcacaaatccccgtacttagcacacttacgctgagcagcatcaacaacaacccggccaggcacaaaatccgccatcccagtctgagtcaaagaagaagaccctgtcaagtcaacgcacacatcacg

SEQ ID NO: 652 - DNA, 366 bp, Silene latifolia
gatgcgcgcagctttcattataataaaaataaaaggtttacatgaaattggtggggagccgagagacaatctgggctcccacacccttagcagtagtaaagctaatacgagtaaaaatgtaagcggctacccgagccccagcatcctgagataccgagaatttctggatccgcttgagcaaggcaacagcatccgaactcaactccccaagcgaagagaaagagaaaggtaggagaccataacccgctaccgcgcacaaatcccatacttagcacactttcgctgagcagcatcagcgacaccggccggcacaaatctgccaccagtctgagtcaagtgagatctgtcagtcacgcacacatcacg

SEQ ID NO: 653 - DNA, 376 bp, Silene latifolia; identical to SEQ ID NO: 651

SEQ ID NO: 654 - DNA, 378 bp, Silene latifolia
gatgcgcgcagctttcattaaaacaaaaataaaagtttacatgaaattggtggggagccgtgaaacaatctgagctcccacacctttagcaatagcaaagctaagtctagtaaaaatgtaagcggcaacccgagcccccgcatcctgagataccgagaatttctggatccgcttgagtaaggcaacagcatccgaacccagctcccctagtgaagagaaagagaaaggaaggaaaccataacccgctaccgcgcacaaatccccatacttagcacactttcgctgagcagcatcagcaacaacccggcccgacacaaaatctgccaacccagtctgagtcaaaggtgaagaacctgtcaagtcaacgcacacatcacg

SEQ ID NO: 655 - DNA, 378 bp, Silene latifolia
gatgcgcgcagctttcattaatagaaaaacaaaagtttacatgaaattgatgatgagccgagaaacaagctgggctcccacgcccttagcaacagcaaagctaagtctagtaaaaatgtaaccggccatccgaacccccgcatcctgagttaccgagaatttctggatccgcttgagcaaggcaacagcatccgaacccagctccccaagtgatgagaaagagaagggaatgaaaccataacccgctgccacgcacaaatccatgtacttagcacacttacactgagcagcatcagcaacaacccggccaggcacaaaatccgccatcccattctgagtcaaaggagaagaccttgtcaactcaacgcacacatcacg

SEQ ID NO: 656 - DNA, 378 bp, Silene latifolia; identical to SEQ ID NO: 655

SEQ ID NO: 657 - DNA, 376 bp, Silene latifolia; identical to SEQ ID NO: 651

SEQ ID NO: 658 - DNA, 376 bp, Silene latifolia; identical to SEQ ID NO: 651

SEQ ID NO: 659 - DNA, 379 bp, Silene latifolia
gaatgcgcgcagctttcattaaaacaaaaataaaagtttacatgaaattggtggggagccgtgaaacaatctgagctcccacacctttagcaatagcaaagctaagtctagtaaaaatgtaagcggcaacccgagcccccgcatcctgagataccgagaatttctggatccgcttgagtaaggcaacagcatccgaacccagctcccctagtgaagagaaagagaaaggaaggaaaccataacccgctaccgcgcacaaatccccatacttagcacactttcgctgagcagcatcagcaacaacccggcccgacacaaaatctgccaacccagtctgagtcaaaggtgaagtacctgtcaagtcaacgcacacatcacg

SEQ ID NO: 660 - DNA, 379 bp, Silene latifolia
gatgcgcgcagctttcattaaaagaaaaataaaagtttacatgaaattggtggggagtcgagagacaatctgggctcccacacccttagcaacagcaaagctaagtctagtaaaaatgtaagcggccacccgagcccctgcatcctgagataccgagaatttctggatccgcttgagcaaggcaacagcatccgaacccagctccccaagtgaagagaaagagaaaggaaggaaaccataacccgctgccgcgcacaaatccccgtacttagtacacttatgctgagcagcatcagcgacaacacggccagacacaaaattttgtcatcccagtctgagttaaaggagaagaccctgtcaagtcaacgcacacatcacg

SEQ ID NO: 661 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgaaagcggccacccgagcccccgcatcctgagataccgagaatttatggatccgcttgagcaaggcaacagcatccgaacccatctccccaagtgatgagaccgagaatggaagaaaaccataacccgctaccacgcacaaatccccgtacttagcacacttacgctgagcagcatcaacaacaacccggccaggcacaaaatccgccatcccagtctgagtcaaagaagaagaccctgtcaagtcaacgcacacatcacg

SEQ ID NO: 662 - DNA, 378 bp, Silene latifolia
gatgcgcgcagctttcattaaaataaaaataaaagtttacatgaaattggtggggagccgagagacaatctgggctcccacacccttagcaatagcaaaactaagtctagtaaaaatgtaagcggccacccgagcccccgcatcctgagataccgagaatttctggatccgctttaggaagacaacagcatccgaacccagctccccaagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacctgtcaggtcaacgcacacatcacg

SEQ ID NO: 663 - DNA, 376 bp, Silene latifolia; identical to SEQ ID NO: 651

SEQ ID NO: 664 - DNA, 378 bp, Silene latifolia; identical to SEQ ID NO: 654

SEQ ID NO: 665 - DNA, 378 bp, Silene latifolia
gatgcgcgcagctttcattaaaataaaaataaaagtttacatgaaattggtggggagccgagagacaatctgggctcccacacccttagcaatagcaaagctaagtctagtaaaaatgtaagcggccacccgagcccacgcatcctgagataccgagaatttctggatccgcttgagcaagacaacaacatccgaacccagctccccaagtgaagagaaagagaaaggaaggaaaccataacccgctaccgcgcacaaatccccatacttagcacactttcgctgagcatcatcagcgacaacccggccaggcacaaaatccgtcatcccagtctgagtcaaaggagaagaacctgtcaagtcaacgcacacatcacg

SEQ ID NO: 666 - DNA, 378 bp, Silene latifolia
gatgcgcgcagctttcattaaaagaaaaataaaagtttacatgaaattggtggggagtcgagagacaatctgggctcccacacccttagcaacagcaaagctaagtctagtaaaaatgtaagcggccacccgagcccctgcatcctgagataccgagaatttctggatccgcttgagcaaggcaacagcatccgaacccagctccccaagtgaagagaaagagaaaggaaggaaaccataacccgctgccgcgcacaaatccccgtacttagtacacttatgctgagcagcatcagcgacaacccggccagacacaaaatttgtcatcccagtctgagttaaaggagaagaccctgtcaagtcaacgcacacatcacg

SEQ ID NO: 667 - DNA, 379 bp, Silene latifolia; identical to SEQ ID NO: 650

SEQ ID NO: 668 - DNA, 378 bp, Silene latifolia; identical to SEQ ID NO: 654

SEQ ID NO: 669 - DNA, 378 bp, Silene latifolia; identical to SEQ ID NO: 654

SEQ ID NO: 670 - DNA, 378 bp, Silene latifolia; identical to SEQ ID NO: 655

SEQ ID NO: 671 - DNA, 379 bp, Silene latifolia; identical to SEQ ID NO: 650

SEQ ID NO: 672 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgaaagcggccacccgagcccccgcatcctgagataccgagaatttctggatccgcttgagcaaggcaacagcatccgaacccaactccccaagtgatgagaaagagaatggaaggaaaccataacccgctgccgcgcacaaatccccatacttagcacacttccgctgagcagcatcagcaacaacccgtccaggcacaaaattcgtcatcccagtctgagtcaaaggagaagacccggtcaagtcaacgcacacatcacg

SEQ ID NO: 673 - DNA, 378 bp, Silene latifolia; identical to SEQ ID NO: 654

SEQ ID NO: 674 - DNA, 376 bp, Silene latifolia; identical to SEQ ID NO: 651

SEQ ID NO: 675 - DNA, 378 bp, Silene latifolia; identical to SEQ ID NO: 665

SEQ ID NO: 676 - DNA, 378 bp, Silene latifolia; identical to SEQ ID NO: 655

SEQ ID NO: 677 - DNA, 378 bp, Silene latifolia; identical to SEQ ID NO: 666

SEQ ID NO: 678 - DNA, 378 bp, Silene latifolia; identical to SEQ ID NO: 654

SEQ ID NO: 679 - DNA, 382 bp, Silene latifolia
gatgcgcgcagctttcatttgaaagaaaaataaaagtttacattgaaatttggtgggcagccgagaagacaatctgggctcccacacccttagcaacaacaaagctaagtttagtaaaaatgtaagcggccacccgagcccccgcatcctgagataccgagaatttctggatccgcttgagcgaggcaacagcatccgaacccagctcccctagtgaagagaaagagaagggaaggaaaccataacctgctgccgcgcacaaatcctcgtacttagcacacttacgctgagcagcatcagcgacaacccggccgggcacaaaatccgtcatcctggtctgagtcaaaggagaagaccctatcaagtcaacgcacacatcacg

SEQ ID NO: 680 - DNA, 390 bp, Silene latifolia
gatgcgcgcagctttcatttaaaattaaaataaaagggtttacattgaaatttggtggggagccgagagacaatctggggctcccacacccttagcaatagcaaagctaagtctagtaaaaatgtaagcggctacccgagcccccgcatcctgagataccgagaatttctggatgcgcttgagcaaggcaacagcatccgaacccagctccccaagtgaagagaaagaaaaagagaaaggtaggaaaccataacccgctaccgcgcacaaatccccatacttagcacacttttgctgagcagcatcagcgacaacccggcccggaacaaaatctgccaacccagtctgagtcaaaggtgaagaacctgtcaagtcaacgcacacatcacg

SEQ ID NO: 681 - DNA, 378 bp, Silene latifolia
gatgcgcgcagctttcattaaaagaaaaataaaagtttacatgaaattggtggggagccgagaaacaagctgggctcccacacccttagcaacagcaaagctaagtctagtaaaaatgtaaggggccacccaagcccccgcatcctgagataccgagaatttctggatccgcttgagcaaggcaacagcatccgaacccagctccccaagtgatgagaaagagaagggaaagaaaccataacgcgctgccgcgcacaaatccccgtacttagcacacttacgctgagcagcatcagcaacaaccaggctaggcacaaaatccgccatcccagtctgagtcaaaggagaggatcatgtcaagtcaacgcacacatcacg

SEQ ID NO: 682 - DNA, 384 bp, Silene latifolia
gatgcgcgcagctttattaaaataaaaataaaagggttacatgaaattggtggggagccgagagacaatctgggctcccacacccttagcaatagcaaagctaagtctagcaaaaatgtaagcggctacccgagcccccgcatcctgagataccgagaatttctggatgcgcttgagcaaggcaacagcatccgaacccagctccccaagtgaagagaaagaaaaagagaaaggtaggaaaccataacccgctaccgcgcacaaatccccatacttagcacacttttgctgagcagcatcagcgacaacccggcccggaacaaaatctgccaacccagtctgagtcaaaggtgaagaacctgtcaagtcaacgcacacatcacg

SEQ ID NO: 683 - DNA, 381 bp, Silene latifolia
gatgcgcgcagctttcattaaaataaaagtaaaagtttacatgaaattggtggggagccgagatacaatctgggctcccacacacttagcaatagaaaagctaagtctagtaaaaatgtaagcggccacccgagcccccgcatcctgagataccgagaatttctggatccgcttgagcagggccacaacatccgaacccagctccccaagtgaagagaaagagaaaggaaggaaaccgtaacccgccaccgcgcacaaatccccatacttagcacactttcgctgagcagcatcagcgacaacccggccaggcacaaagtccgcgatcccagtctggagtcaagggaggaaggaacctgtcaagtcaacgcacacatcacg

SEQ ID NO: 684 - DNA, 382 bp, Silene latifolia
gatgcgcgcagctttcattgaaataaaagtaaaagtttacatgaaattggtgaggagccgagaaaccgtctgggctcccacacccttagcaacagcaaagctaagtctagtaaaaatgtaagcggtcacccgagcccccgcatcctgagataccgagaatttctggatccgcttgagcaaggaaacagcatccgaacccagctccccaagtgaagagaaagagaaaggaaggagaccataacccgctgccgcgcacaaacccccgtacttagcacacttacgctgagcagcatcagcgacaacccggccaggcacaaaatccttcatccctgactgagtaaaagaaaaagacccctgtcaaagtcaaacgcacacatcatct

SEQ ID NO: 685 - DNA, 384 bp, Silene latifolia
gatgcgcgcagctttcattaaaataaaataaaaggtttacatgaaattggtggggagccgagagacaatctgggctcccacacccttagcaatagcaaagctaagtctagtaaaaatgtaagcggctacccgagcccccgcatcctgggataccgagaatttctggatgcgcttgagcaaggcaacagcatccgaacccagctccccaagtgaggagaaagaaaaagagaaaggtaggaaaccataacccgctaccgcgcacaaatccccatacttagcacacttttgctgagcagcatcagcgacaacccggcccggaacaaaatctgccaacccagtctgagtcaaaggtgaagaacctgtcaagtcaacgcacacatcacg

SEQ ID NO: 686 - DNA, 380 bp, Silene latifolia
gatgcgcgcagctttcattaaaagaaaaataaaagtttacatgaaattggtggggagccgagaaacaatctgggctcccacacccttagcaacagcaaaactaagtctagtaaaaatgtaagcggccacccgagcccccgcatcctgagataccgagaatttctgaatccgcttgagcaaggcaacaacatacgaacccagctccccaagtggagggaaagataaaggaaggaaaccatacccagctgccgcgcacacatccccgtacttagcacacttacgctgagcagcattagcgacaacccggccgggcacaaaatccatcatcctagtctgagtcaaatgaggaaggaccctgtcaagtcaacgcacacatcacg

SEQ ID NO: 687 - DNA, 386 bp, Silene latifolia
gatgcgcgcagctttcattgaaagaaaaataaaagtttacatgaaattggtgggcagccgagagacaatctgggctcccacacccttagcaacaacaaagctaagtttagtaaaaatgtaagcggccacccgagcccccgcatcctgagataccgagaatttctggatccgcttgagcaaggcaacagcatccgaacccagctcccctagtgaagagaaagagaagggaaggaaaccataacctgctgccgcgcacaaatcctcgtacttagcacacttacgctgagcagcatcagcgacaacccggccgggcacaaaaatccgtcatcctggtctggagtcaaaagggagaaaggaccctatcaaagtcaaacgcacacatcaca

SEQ ID NO: 688 - DNA, 385 bp, Silene latifolia
gatgcgcgcagctttcattaaaataaaataaaaggtttacatgaaattggtggggagccgagagacaatctgggctcccacacccttagcaatagcaaagctaagtctagtaaaaatgtaagcggctacccgagcccccgcatcctgagataccgagaatttctggatgcgcttgagcaaggcaacagcatccgaacccagctccccaagtgaagagaaagaaaaagagaaaggtaggaaaccataacccgctaccgcgcacaaatccccatacttagcacacttttgctgagcagcatcagcgacaacccggcccggaacaaaatctgccaacccagtctgagtcaaaggtgaaggaacctgtcaagtcaacgcacacatcacg

SEQ ID NO: 689 - DNA, 381 bp, Silene latifolia
gatgcgcgcagctttcattgaaagaaaaataaaagtttacatgaaattggtgggcagccgagagacaatctgggctcccacacccttagcaacaacaaagctaagtttagtaaaaatgtaagcggccacccgagcccccgcatcctgagataccgagaatttctggatccgcttgagcaaggcaacagcatccgaacccagctcccctagtgaagagaaagagaagggaaggaaaccataacctgctgccgcgcacaaatcctcgtacttagcacacttacgctgagcagcatcagcgacaacccggccgggcacaaaatccgtcatcctggtctgagtcaaaggagaaaggaccctatcaaagtcaacgcacacatcacg

SEQ ID NO: 690 - DNA, 372 bp, Silene latifolia
gatgcgcgcagcttttattaaaagagaaagttacatgaaattggtggggagccgagaaacaatctgggctcccacacccttagcaacagaaaagctaagtctagtaaaaatgtaagtggccacccgagcctccgcatcctgagataccgagaatttctggatccgcttgagcaaggcaacagcatccgaacccagctccccaagcgaagagaaagagaaaggaaggaaaccataacccgctaccgcgcacaaatccccatacttagcacactttcgctgagcagcatcagcgacaacccggccaggcacaaaatccgtcatcccagtctgagtcaaaggagaatagcctgtcaagtcaacgcacacatcacg

SEQ ID NO: 691 - DNA, 385 bp, Silene latifolia
gatgcgcgcagctttcattaaatgaaaaacaaaagtttaaatgaaattggtggggagcccgagaaacaagctgggctcctacacccctttagcaacagcaaagctaagtctagtaaaaaatgtaagcggccaccccgagcccccgcatcctgagataccgagaatttctggatccgcttgagcaaagtcaacagcatccgaacccaactccccatatgatgagaaagagaaaggaaggaaaccataacccgttgtcgagcataatccccatacttagcacacttacgctgagcagcatcagcaacaacccggccatgcacaaaaattcgtcatcccagttctagtcacaggagaagacccggtcaagtcaaacgcacacatcacg

SEQ ID NO: 692 - DNA, 379 bp, Silene latifolia
gatgcgcgcagctttcatttgaaagaaaaataaaagtttacatgaaattggtggggagccgagaaacaatctgggctcccacacccttagcaacagcaaaactaagtctagtaaaaatgtaagcggccacccgagcccccgcatcctgagataccgagaatttctggatccgcttgagcaaggcaacaacatccgaacccagctccccaagtgaagggaaagataaaggaaggaaaccatacccagctgccgcgcacacatccccatacttagcacacttacgctgagcagcattagcgacaacccggccgggcacaaaatccatcatcctagtctgagtcaaatgagaagaccctgtcaagtcaacgcacacatcacg

SEQ ID NO: 693 - DNA, 379 bp, Silene latifolia
gatgcgcgcagctttcattataataaaaacaaaatgtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacccgtcaggtcaacgcacacatcacg

SEQ ID NO: 694 - DNA, 379 bp, Silene latifolia
gatgcgcgcagctttcattaatagagaaacaaaagtttacatgaaattggtggggagccgagaaacaagctgggctcccacacccttagcaacagcaaaggtaagtttagaaaaaaatgtaagcggccacccgagcccccgcattctgagataccgagaatttctggatccgcttgagcaaggcaacagcatctgaacccagctccccaagtgatgaaaaagagaagggaaggaaaccataacccactgccgcgcacaaatccccgtacttagcacacttacgctgagcagcatcagcaacaacccggtcaggcacaaaatccgtcatcccagtctgagtcaaaggagaagaccctgtcaagtcaacgcacacatcaca

SEQ ID NO: 695 - DNA, 376 bp, Silene latifolia
gatgcgcgcagctttcattaagagaatataaaagtttacatgaaattggtgggagccgagagacaatctgggctcccacacccttagcaacagcaaagctaagtctagtaaaaatgtatgcggccacccgagcccccgcatcctgagatacagagaatttctggatccgcttgagtaaggcaacagcatccgaacccaactccccaagtgatgagaaagagaatggaaggaaaccataacccgctgccgcgcacaaatccccatacttagcacacttccgctgagcagcatcaacaacaacccggccaggcacaaaattggtcatcccagtctgagtcaaaggagaagactcggtcaagtcaacgcacacatcacg

SEQ ID NO: 696 - DNA, 369 bp, Silene latifolia
gatgcgcgcagctttcattaaaataaaaataaaagtttacatgaaattggtggggagccgagagacaatctgggctcccacacccttagcaacagcaaagctaagtctagtaaaaatgtaagcggccagccgagcccccgcatcctgagataccgagaatttctggatccgcttgagcaaggcaacagcatccgaacccagctcctcaagtgaagagaaagagaaaggtaggaaccataacccgctaccgcgcacaaatcccatacttagcacactttcgttgagcagcatcagcacaccggccagcacaatctgcatccagtctgagtcaatgtgagatctgtcagtcacgcacacatcacgatcacg

SEQ ID NO: 697 - DNA, 378 bp, Silene latifolia
gatgcgcgcagctttcattaaaagaaaaataaaagtttacatgaaattggtggggagccgagagacaatctgggctcctacacccttagcaacagcaaagctaagtctagtaaaaatgtaagcgggcacccgagcccctgcatcctgagataccgagaattttttgatccgcttgagcaaggcaacaatatccaaacccagctccccaagtgaagagaaagagaaaggaaggaaaccataacccgctaccgcgcacaaatccccatacttagcacactttcgctgagcagcatcagcgacaacccgaccaggcgcaaaatccgtcatcccagtctgagtcagaggagaagaacctgtcaagtcaacgcacacatcacg

SEQ ID NO: 698 - DNA, 378 bp, Silene latifolia
gatgcgcgcagctttcattaattgaaaaacaaaagtttacatgaaattggtaggaagccgagaaacaagctgggctcccacacccttagcaacaacaaagctaagtctagtaaaaatgtaagcggccacccgagcccccgcatcctgagataccgagaatttctggatccgcttgagcaaggcaacagcatccgaacccaactccccaagtgatgagaaagagaagggaaggaaaccataacccgctgccgcgcacaaatccccgtacttagcacacttacgctgagtagcatcagcaacaacccggccaggcacaaaattcgtcatcccagtctgagtcaaaggagaagaccctgccaagtcaacgcacacatcacg

SEQ ID NO: 699 - DNA, 379 bp, Silene latifolia
gatgcgcgcagctttcattaaaataaaaataaaaggtttacatgaaattggtggggagccgagagacaatctgggctcccacacccttagcaatagtaaagctaagacgagtaaaaatgtaagcggctacccgagccccagcatcttgagataccgagaatttcttgatccgcttgagcaaggcaacaacatccgaactcagctcccccagtgaagagaaagagaaaggtaggaaaccataacccgctaccgcgcacaaatccccatacttagcacactttcgctgagcagcatcagcgacaacccggcccgacacaaaatctgtcaacccagtccgagtcaaaggtgaagaacctgtcaggtcaacgcacacatcacg

SEQ ID NO: 700 - DNA, 379 bp, Silene latifolia; identical to SEQ ID NO: 693

SEQ ID NO: 701 - DNA, 379 bp, Silene latifolia
gatgcgcgcagctttcattaattgaaaaacaaaagtttacatgaaattggtggggagccgtgaaacaatctgagctcccacacccttagcaatagcaaagctaagtctagtaaaaatgtaagcgggcaacccgagcccccgcatcctgagataccgagaatttctggatccgcttgagcaaggcaacagcatccgaacccagctcccctagtgaagagaaagagaaaggaaggaaaccataacccgctaccgcgcacaaatccccatacttagcacactttcgctgagcagcatcagcaacaacccggcccggcacaaaatctgccaacccagtctgagtcaaaggtgaagaacctgtcaggtcaacgcacacatcacg

SEQ ID NO: 702 - DNA, 377 bp, Silene latifolia
gatgcgcgcagctttcattaaaataagaataaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgccaacccagtctgagtcaaaggtgaagaacctgtcaggtcaacgcccacatcaa

SEQ ID NO: 703 - DNA, 378 bp, Silene latifolia
gatgcgcgcagctttcataaatagaaaaataaaagtttacatgaaattggtggggagccgagagacaatctgggctcctacacccttagcaacagcaaagctaagtctagtaaaaatgtaagcgggcacccgagcccctgcatcctgagataccgagaattttttgatccgcttgagcaaggcaacaatatccaaacccagctccccaagtgaagagaaagagaaaggaaggaaaccataacccgctaccgcgcacaaatccccatacttagcacactttcgctgagcagcatcagcgacaacccgaccaggcgcaaaatccgtcatcccagtctgagtcagaggagaagaacctgtcatgtcaacgcacacatcacg

SEQ ID NO: 704 - DNA, 378 bp, Silene latifolia
gatgcgcgcagctttcattaaaataagaataaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgccaacccagtctgagtcaaaggtgaagaacctgtcaggtcaacgcacacatcacg

SEQ ID NO: 705 - DNA, 378 bp, Silene latifolia
gatgcgcgcagctttcattaaaagaaaaataaaagtttacttgaaattggtgtggagccgagagacaatctgggcccccacacccttagcaacaacaaagctaggtctagtaaaaatataagcagccacccgagcccccgcattctgagataccgagaatttctggatccgcttgagcaaggcaacagcatctgaacccagctccccaagtgatgaaaaagagaagggaaggaaaccataacccactgccgcgcacaaatccccgtacttagcacacttacgctgagcagcatcagcaacaacccggtcaggcacaaaatccgtcatcccagtctgagtcaaaggagaagaccctgtcaagtcaacgcacacatcacg

SEQ ID NO: 706 - DNA, 379 bp, Silene latifolia; identical to SEQ ID NO: 699

SEQ ID NO: 707 - DNA, 378 bp, Silene latifolia
gatgcgcgcagctttcattaaaaggaaaataaaagtttacatgaaattggtggggagccgagagacaatctgggatcccacacccttagcaacatcaaaactaagtctagtaaaaatgtaagcggcaactcgagcccccgcatcctgagataccgagaatttctggatctgcttgagcaaggcaacaacatccgaacccagctccccaagtgatgagaaagagaagggaagaaaaccataacccgctgccgcgcacaaatccccgtacttagcacacatacgctgagcagcatcagcgacaacccggccaggcacataatccgttatcccagtctgagtcaaaggtgaagaacctgtcaagtcaacgcacacatcacg

SEQ ID NO: 708 - DNA, 384 bp, Silene latifolia
gatgcgcgcagctttcattaaaataaaagtaaaagtttacatgaaattagtggggagccgagatacaatctgggctcccacacccttagcaatagcaaagctaagtctagtaaaaatgtaagcggccacccgagcccccgcatcctgagataccgagaatttctggatccgcttgagcaaggcagcagcatccgaacccagctccccaagtgaagagaaagagaaagagaaaggaaggaaaccatagcccgctgccgcgcacaaatccccatacttagcacactttcgctgagcagcatcagcgacaacccggccaggcacaaaatctgtcatcccagtctgagtcaaaggagaagaccgtgtcaagtcaacgcacacatcacg

SEQ ID NO: 709 - DNA, 378 bp, Silene latifolia
gatgcgcgcagctttcattaaaataagaataaaagtttacatgaaattggtggggagccgagagacaatctgggctcccacacccttagcaatagcaaagctaagtctagtaaaaatgtaagcggccacccgagcccccgcatcctgagatacagagaatttctggatccgcttgagcaaggcaacaacatccgaacccagctccccaagtgatgagaaagagaaggggaggaaaccataacccgctgccgcgcacaaatcctcctacttagcacacttacgctgagcagcatcaacaacaacccgaccaggcacaaaatccgtcatcccggtctgagtcaaaggaggagaccctgtcaagtcaacgcacacatcacg

SEQ ID NO: 710 - DNA, 379 bp, Silene latifolia
gatgcgcgcagctttcattaaaattaaaataaaagtttacatgaaattggtggggagccgagagacaatctgggctcccacacccttagcaacagcaaagctaagtctagtgaaaatataagcggccacccgagcccccgcatcctgagacaccgagaatttctggatccgcttgagcaaggcaacaacatccgaacccagctcccccaagtgaagagaaaaagaagggaaggaaaccataaccagctaccgcgcataaatccccatacttagcacacttgcgctgagcagcatcagcgacaacccggccgggcacaaaatccatcatcccagtctgagtaaagggagaagaccctgtcaagtcaacgcacacatcacg

SEQ ID NO: 711 - DNA, 378 bp, Silene latifolia
gatgcgcgcagctttcattaagataaagattgaagtttacatgaaattggtggggagccgagagacaatctgggctcccacacccttagcaacagcaaaactaagtctggtgaaaatataagcggctacccgagcccccgcatcctgagataccgagaatttctggatccgcttaagcaaggcaacaacatccgaacccagctccccaagtgaagagaaagagaaaggaaggaaaccataacccgccaccgcgcacaaatccacatacttagcacactttcgctgagcagcatcagcgacaacccggccaggcacaaaatccgtcatcccagtctgagtcaaaggagaagaacctgtcaagtcaacgcacacatcacg

SEQ ID NO: 712 - DNA, 378 bp, Silene latifolia
gatgcgcgcagctttcattaatagaaaaacaaaagtttacatgaaattggtggggacccgagaaacaatctgggctcccacacctttagcaacagcaaagctaagtctagtaaaaatttaagcggccacccgagcccccgcatcctaagataccgagaatttctggatccgattgatcaaggcaacagcatccgaacccagcccccgaagtgatgagaaagagaagggaaggaaaccataacccgctgccgcgcacaaatccccgtacttagcacacttacgctgagcagcatcagcaacaacccggccaggcacaaaattcgtcatccgagcctgagtcaaaggagaagacctggtcaagtcaacgcacacatcacg

SEQ ID NO: 713 - DNA, 379 bp, Silene latifolia
gatgcgcgcagctttcattataataaaattaaaaggtttacatgaaattggtggggagccgagagacaagctgggctgccacacctttagcaatagtaaagttaatacgagtaaaaatgtaagcggctacccgagccccagcatcctgagataccgagaatttctggatccgcttgagcaaggcaacagcatccgaactcaaccccccaagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 714 - DNA, 379 bp, Silene latifolia
gatgcgcgcagctttcattataataaaaacaaaatgtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacccgtcaagtcaacgcacacatcacg

SEQ ID NO: 715 - DNA, 379 bp, Silene latifolia
gatgcgcgcagctttcattaaaataaaaataaaaggtttacatgaaattggtggggagccgagagacaatctgggctcccacacccttagcaatagcaaagctaagtctagtaaaaatgtaagtggctacccgagcctccgcatcctgagataccgagaatttctggatccgcttgagcaaggcaacagcatccgaacccagctccccaagtgaagagaaagagaaaggtaggaaaccataatccgctaccgcgcacaaatccccatacttagcacactttcgctaagcagcatcagcgacaacccggcccggcacaaaatctgccaacccagtctgagtcaaaggtgaagaacctgtcaagtcaacgcacacatcacg

SEQ ID NO: 716 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccacaacatcctgagataccgagaatttctggatccgcttgagcaaggcaacaacatccgaactcaactccccaagcgaagagaaagagaaaggtaggaaaccataacccgctaccgcgcacaaatccccatacttagcacactttcgctgagcagcatcagcgacaacccggcccggcacaaaatctgccaacccagtttgagtcaaaggtgaagacccagtaaagtcaacgcacacatcacg

SEQ ID NO: 717 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaaccatagcccgctaccgcgcacaaatccccatacttagcacactttcgctgagcagcatcagcgacaacccggcccggcacaaaatctgccaacccagtctgagtcaaaggtgaagaacccgtcaagtcaacgcacacatcacg

SEQ ID NO: 718 - DNA, 378 bp, Silene latifolia
gatgcgcgcagctttcattaaaaggcaaataaaagtttacatgaaattggtggggagccgagagacaatctgggctcccacacccttagcaacagcaaagctaagtctagtaaaaatgtaagcggctaatctagcccccgcatcctgagataccgagaatttctggatccgcttgagcaaggcaacaacatctgaacccagctccccaagtcaagagaaagagaaaggaaggaaaccataacccgctgtcgcgcacaaatccccgtacttagcacacttacgctgagcagcatcagcgacaacccggccaggcagaaaatctgtcatcccagtctgagtcaaaggagaagaccctgtcaagtcaacgcacacatcacg

SEQ ID NO: 719 - DNA, 380 bp, Silene latifolia
gatgcgcgcagctttcattaaaataaaaataaaagtttacattgaaattcggtggggagccgagagacaatctgggctcccacacccttagcaatagcaaagctaagtctagtaaaaatgtaagcggccacccgagcccccgcatcctgagataccgagaatttctggatccgcttgagcaaggcaacaacatctgaacccagctccccaagtgaagagaaagagaaaggaaggaaaccataacccgctaccgcgcacaaaaccccatacttagcacactttcgctgagcagcatcagcgacaacccggccaggcacaaaatccatcatcccagtttgagtcaaaggagaagaacctgtcaagtcaacgcacacatcacg

SEQ ID NO: 720 - DNA, 378 bp, Silene latifolia
gatgcgcgcagctttcattaaaagaaaaataaaagtttacatgaaattggtggggagccgagagacaatctgggctcccacacccttagcaatagcaaagctaagtctagtaaaaatgtaagcggccacccgagcccccgcatcctgagatgccgagaatttctggatccgcttgagcaaggcaacagcatccgaacccagctccccaagtgaagagaaagagaaaggaaggaaaccataacccgctaccgcgcgcaaatccccatacttagcacactttcgctgagcagcatcaacgacaacccggccaggcacaaaatccgtcatcccagtctgagtcaaaggagaagaacctgtcaagtcaacgcacacatcacg

SEQ ID NO: 721 - DNA, 378 bp, Silene latifolia
gatgcgcgcagctttcattaaaaagaaaataaaagtttacatgaaattggtgggtagccgagagacaatctcggctcccacacccctttacacagcaaagctaagtctagtaaaaatgtaagcggccacccgagcccccgcatcctgagataccgagaatttctggatccgcttgagcaaggcaacatcatccgaacccagctccccaagtgaagagaaagagaaaggaaggaaaccataacccgctgccgcacacaagtccccgtacttagcacacttacgctgagcagcatcagcgacaacccggccaggcacaaaatccgtcatcccactctgagtcaaaggagaagacccagtcaactcaacgcacacatcacg

SEQ ID NO: 722 - DNA, 378 bp, Silene latifolia
gatgcgcgcagctttcattaaaataagaataaaggtttacatgaaattggtggggagccgagagacaatctgggctcccacacccttagcaatagtaaagctaatacgagtaaaaatgtaagcggctacccgagccccagcatcctgagataccgagaatttctggatccgctcgagcaaggcaacagcatccgaactcaactccccaagtgatgagaaagagaaaggtaggaaaccataacccgctaccgcgcacaaatccccatacttagcacactttcgctgagcagcatcagcaacaacccggcccggcacaaaatccgccaacccagtctgagtcaaaggtgaagaacctgtcaagtcaacgcacacatcacg

SEQ ID NO: 723 - DNA, 378 bp, Silene latifolia
gatgcgcgcagctttcattaaaagaaaaataaaagtttacatgaaattggtggggagccgagaaacaagctgggctcccacacccttagcaacaacaaagctaagtctagtaaaaatgtaagcggtcacccgagcccccgcgtcctgagataccgaaaatttctgaatccgcttgagcaaggcaacaacatccgaacccagctccccaagtgaagagaaagagaaaggaaggaaaccataacccgctgccgcgcagaaatccgcgtacttagcacacttacgatgagcaccatcagcgacaacccggtcaggcacaaaatccgtcatcccagtctgagtcaaaggagaagaccctgtcaagtcaacgcacacatcacg

SEQ ID NO: 724 - DNA, 378 bp, Silene latifolia
gatgcgcgcagctttcattaaatgaaaaacaaaagtttacatgaaattggtggggagccgagaaacaagctgggctccctcacccttagcaacagcaaagctaagtctagtaaaaatgtaagcggccaccggagcctccgcatcctgagataccgagaatttctggatccgcttgagcaaggcaacagcatccgaacacagctccccaagtgaagagaaagagaaaggaaggaaaccataacccgctaccgcgcacaaatccccatacttagcacactttcgctgagcagcattagcgacaacccggccaggcacaaaatccgtcatcccagtctgagtcaaaggagaagacccggtcaagtcaacgcacacatcacg

SEQ ID NO: 725 - DNA, 379 bp, Silene latifolia
gatgcgcgcagctttcattaaaagagaaaaaaaatgtttacatgaaattggtggggagccgagagacaatctgggctcccacatccttagcaacagcaaaactaagtctagtaaaaatgtaagcggccacctgagcccccgcatcctgagataccgagaatttctggatccgcttgagcaaggcaacaacatccgaacccaactccccaagtgatgagaaagagaagggaaggaaaccataacccgttgtcgtacacaaatccccgtacttagcacacttacgctgagcagcatcagcaacaacccggccaggcataaaatccgtcatcccagtctgagtcaaaggagaagacccggtcaagtcaacgcacacatcacg

SEQ ID NO: 726 - DNA, 378 bp, Silene latifolia
gatgcgcgcagctttcattaatagaaaaacaaaagtttacatgaaattggtggggagccgagagacaatctgggctcccacacccttagcaatagcaaagctaagtctagtaaaaatgtaagcggccacccgagcccccgcatcctgagataccgagaatttctggatccgcttgagcaaggcaacaacatccgaacccagctccccaagtgaagagaaagagaaaggaaggaaaccataacctgctaccgcacacaaatccccatacttagcacactttcgctgcgcagcatcagcgacaaccgggccaggcacaaaatccatcatctcagtctgagtcaaaggagaagaacctgtcaagtcaacgcacacatcacg

SEQ ID NO: 727 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacaacatccgaactcaactccccaagtgaagagaaagagaaaggtaggaaaccataacccgctaccgcgcacaaatccccatacttagcacactttcgctgagcagcatcagcgacaacccggcccgacacaaaatccgccaacccagtctgagtcaaaggtgaagaacctgtcaagtcaacgcacacatcacg

SEQ ID NO: 728 - DNA, 377 bp, Silene latifolia
gatgcgcgcagctttcattaaaaaaaaataaaagtttacatgaaattggtggggagccgagaaacaagcttggctcccacacccttagcaacagcagagctaagtcttataaaaatgtaagcggccacccgagcccccgcatcctgagataccgagaatttctggatccgcttgagcaaggcaacaacatcggaacccagctccccaagtgatgagaaagagaagggaaggaaaccataacccgctgccgcacacaaatccccgtacttagcacacttacgctgagcagcatcagcaacaacccggccaggcacaaaatccgtcatcccagtctgagtcaaagaagaagaccctgtcaagtcaacgcacacatcacg

SEQ ID NO: 729 - DNA, 378 bp, Silene latifolia
gatgcgcgcagctttcattaaatgaaaaacaaaagtttacatgaaattggtggggagccgagaaacaagctggactcccacacccttagcaacaacaaagctaagtctagtaaaaatgtaagcggccacccgagcccccgcatcctgagataccgagaatttctggatccgcttgagcaaggcaacagcatccgaacccaactccccaagtgatgagaaagagaatggaaggaaaccataacccgctaccgcgcacaaatccccatacttagcacacttccgttgagcagcatcagcaacaacccgacccggcacaaaattcgtcatctcagtctgtgtcaaaggagaagacccggtcaagtcaacgcacacatcacg

SEQ ID NO: 730 - DNA, 379 bp, Silene latifolia
gatgcgcgcagctttcattataataaaaataaaaggtttacatgaaattggtggggagccgagagacaatttgggctcccacacccttagcaacaacaaagctaagtctagtaaaaatgtaagcagccacccgagcccccgcatcttgagataccgagaatttctggatccgcttgagcaaggcaaccgtatctgaacccaactctccaagtgatgagaaagagaagggaaggaaaccataacccgctaccgcgcacaaatccccatacttagcacactttcgctgagcagcatcagcgacaacccggcccggcccaaaatctgccaacccagtctgagtcaaaggtgaagaacctgtcaagtcaacgcacacatcacg

SEQ ID NO: 731 - DNA, 379 bp, Silene latifolia
gatgcgcgcagctttcattaaaataaaaataaaaggtctacatgaaattggtggggagccgagagacaatctgggctcccacacccttagcaatagtaaagctaagacgagtaaaaatgtaagcggctacccgagcccccgcatcctgagataccgagaatttttggatccgcttgagcaaggcaacaacatccgaacccagctccccaagtgatgagaaagagaagggaaggaaaccataacccaatgtcgcgcacaaatccccatacttagcacacttacgctgagcagcatcagcaacaacccggccatgcacaaaatccgccaccccagtctaagtcaaaggagaagaccctgtcaagtcaacgcacacatcacg

SEQ ID NO: 732 - DNA, 378 bp, Silene latifolia
gatgcgcgcagctttcattaaaagaaaaataaaagtttacatggaattggttgggagccgagagacaatctgggctcccacacccttagcaacagcaaagctaagtctagtaaaaatgtaagcggccacccgagcccccgcatcctgagataccgagaatttttggatccgcttgagcaaggcaacaacatccgaacccagctccccaagtgaagagaaagagaaatggaggaaaccataaaccgctgtcgcgcacaaatccccgtacttagcatacttacgctgagcagcatcagcgacaacccgaccaggcacaaaatccgtcatcccagtctgagtcaaaggagaagaccctgtcaagtcaacgcacacatcacg

SEQ ID NO: 733 - DNA, 377 bp, Silene latifolia
gatgcgcgcagctttcattaaaaggcaaataaaagtttacatgaaattggtgaggagccgagagacaatctgggctcccacacccttagcaacatcaaaggtaagtctattaaaaatgtaagcggccacccgagcccccgcatcctgagataccgagaatttctggatccgcttgagcaaggcaacagcatccaaacccagctccccaagtgaagagaaagagaaaggaaggaaactataacccgctgccgcgcacaaatccccatacttagcacactttcgctgagcagcatcagcgacaacccggccaggcacaaaatatgtatcccagtctgagtcaaaggagaagaacctgtcaagtcaacgcacacatcacg

SEQ ID NO: 734 - DNA, 376 bp, Silene latifolia
gatgcgcgcagctttcattaaaggaaaaataaaagtttacatgaaattggtggggagccgagagacaatcctggctcccacacccttagcaatagcaaagttaagtgtgtaaaaatgtaagcggccacccgagcccccgcatcctgagataccgagaatttctggatccgcttgagcaaggcaacatcatccgaacccaactccccaagtgaagagaaagataaaggaaggaaaccataacccgctaccgcgcacaaatccccatacttagcacactttcgctgagcagcatcagcgacaacccgaccaggcacaaaatccgtcacccagtctgagtcaaaggagaagaacatgtcaagtcaacgcacacatcacg

SEQ ID NO: 735 - DNA, 379 bp, Silene latifolia
gatgcgcgcagctttcattaaaagaaaaataaaagtttacatgaactttgttggggagccgagagacaatctgggctcccacacccttagcaacaataaagctaagtctagtaaaaatgtaagcggccacccgagcccctgcatcctgatataccgagaatttctggatccgcttgagcaaggcaacatcatccgaacgcagctccccaagtgatgagaaagagaagggaaggaaaccataccccgctggcgcgcaaaaatcctcgtacttagcacacttgcgctgagcagcatcagcaacaacccggccaggcacaaaatccgtcatcccagtcttagtcaaaggagtagaccctgtcaagtcaacgcacacatcacg

SEQ ID NO: 736 - DNA, 378 bp, Silene latifolia
gatgcgggcagctttcattataataaaaataaaagtttacatgaaattggtggggagccgagatacaatctgggctcccacacccttagcaatagaaaagctaagtctagtaaaaatgtaagcggccacccgagcccccgcatcctgagataccgagaatttctggatccgcttgagcaagacaacaacatccgaacccaactccccaagtgatgagaaagagaatggaaggttaccataacccgctgctgcgcacaaatccctatacttagcacacttccgctgagcagcatcagcaacaacccggccaggcacaaaattagtcatcccagtctgagtcaaaggagaagacccggtcaagtcaacgcacacatcacg

SEQ ID NO: 737 - DNA, 384 bp, Silene latifolia
gatgcgcgcagctttcattaaaataaaaataaaagtttacatgaaattggtggggagccgaaagacaatctgggctcccacacccttagcaacagtaaagctaagtctaataaaaatgtaagcggccacccgagccccagcatcctgagagacccagaatttctggatccgtttgagcaaggcaacagcatccgaacccaactccccaagtgaagagaaagagaaagggaaaggaaggaaaccataacccgctgccgcgcacaaatccccgtacttagcacacttgcgctgagcagcatcagcgacaacccggccaggcacaaaatccgtcatcccagtctgagtcaaaggagaagatcccgtcaagtcaacgcacacatcacg

SEQ ID NO: 738 - DNA, 378 bp, Silene latifolia
gatgcgcgcagctttcattaaatgaaaaataaaagtttacatgaaattgttggggagttgagagacaatctgggctcccacacccttagcaatagcaaagctaagtctagtaaaaatataagcggccacccgagccctcgcatcctgagataccgagaatttctggatccgcttgagcaaggcaacaacatccgaacccagctccccaagtgaagagaaagagaaaggtaggaaaccataacccgctaccgcgcacaaatccccatacttagcacacttacgctgagcagcatcagcaacaacccggccagaaacaaaattcgtcatcccagtctgagtcaaaggagaagactcggtcaagtcaacgcacacatcacg

SEQ ID NO: 739 - DNA, 378 bp, Silene latifolia
gatgcgcgcagctttcattaaaataaaaattaaagtttacatgaaattggtggggagccgagagacaatctgggctcccacacccttagcaatagcaaagctaagtctagtaaaaatgtaagcggccacccgagcccccgcatcctgagataccgagaatttctggatccgcttgagcaaggcaacagcatccgaacccagctccccaagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 740 - DNA, 378 bp, Silene latifolia
gatgcgcgcagctttcattaaatgaaaaacaaaagtttacatgaaattggtggggagtcgagaaacaagctgggctcccacacccttagcaacagcaaagctaagtctagtaaaaatgtaagcggccacccgagcccccgcatcctgagataccgagaatttctggatccgcttgagcaaggcaacagcatccgaacccaactccccaagtgatgagaaagagaatggaaggaaaccataacccgctgccgcgcacaaatccccatacttagcacacttccgctgagcagcatcagcgacaaccctgcccggcacaaaatctgccaacccagtctgagtcaaaggtgaagaacctgtcaagtcaacgcacacatcacg

SEQ ID NO: 741 - DNA, 378 bp, Silene latifolia
gatgcgcgcagctttcattaaaagaaaaataaaagtttacatgaaattggtggggagccgagagacaatctgggctccaacacccttagcaatagcaaagctaagtctagtaaaaatgtaagcggccacccgagtccccgcatcctgagataccgagaatttctggatccgcttgagcaaggcaacaacatccgaacccagctccccaagcaaagagaaagagaaaggaaggaaaccataacccgctaccgcgcacaaatccccatacttagaacactttcgctgagcagcatcagcgacaacccggccaggcacaaaatccgtcatcccagtctgagtcaaaggagaagaacctgtcaagtcaacgcacacatcacg

SEQ ID NO: 742 - DNA, 380 bp, Silene latifolia
gatgcgcgcagcttttcattaaaaggcaaataaaagtttacattaaattcggtggggagccgaaagacaatctgggctcccacacccttagcaacagcaaaactaagtctagtaaaaatgtaagcggctaccctagcccccgcatcctgagataccgagaatttctggatccgtttgagctatgcaacaacatccgaacccatctccccaagtgaagagaaagagaaaggaaggaaaccataacccgctgccgcgcataaatccttgtacttagcacatttacgctgagcagcatcagcggcaacccggccaggcacaaaatccgtcatcccagtctgagtcaaaggagaagaccctgtcaagtcaacgcacacatcacg

SEQ ID NO: 743 - DNA, 379 bp, Silene latifolia
gatgcgcgcagctttcattaatagaaaaataaaagtttacatgaaattggtggggagccgagagacaatctgggctcccacacccttagcaacagcaaagctaagtctagtgaaaatataagcggccacccgagcccccgcatcctgagacaccgagaatttctggatccgcttgagcaaggcaacaacatccgaacccagctcccccaagtgaagagaaaaagaaaggaaggaaaccataaccagctaccgcgcataaatccccatacttagcacacttgcgctgagcagcatcagcgacaacccggccgggcacaaaatccatcatcccagtctgagtaaagggagaagaccctgtcaagtcaacgcacacatcacg

SEQ ID NO: 744 - DNA, 384 bp, Silene latifolia
gatgcgcgcagctttcattaaaagaaaaagaaaaataaaagttcacatgaaattggtggggagccgagagacaatctgggctcccatacccttagcaacagcaaagctaagtctagtaaaaatataagcggccacccgagcccccgcatcctgagatattttgtatttctggatccgcttgagcaaggccacatcatccgaacccagctccccaagcgaagagaaagagaagggaaggaaaccataccccgctgtcgcgcacaaatccccgtacttagcacacttacgctgagcagcatcagcgacaacccgaccaggcacaaaatccgtcatcccagtctgagtcaaaggagaagaccctgtcaagtcaacgcacacatcacg

SEQ ID NO: 745 - DNA, 378 bp, Silene latifolia
gatgcgcgcagctttcattaaaagaaaaataaaagtttacatgaaattggcgggaagccgagagacaatctgggctcccacacccttagcaacagtaaagctaagtctagtaaaaatgtaagcagccacccgagctctcgcatcctgagataccgataatttcttgatccgcttgagcaaggcaacagcatccgaacccagctccccaagtgaagagaaagagtaaggaaggaaaccataacccgctgccgcgcacaaatccccgtacttggcacacttacgctgagcagcatcagcgacaacccggccaggcacaaaatccgtcatcccagtctgagtcaaaggagaagaccgtgtcaagtcaacgcacacatcacg

SEQ ID NO: 746 - DNA, 361 bp, Silene latifolia
gatgcgcgcagctttcattaaaaggtaaactggtggggagccgagagacaatctgggctcccacacccttagctacagcaaagctaagtctagtaaaaatgtaagcggccacccgagcccccgtatcctgagataccgagaatttcttgatccgcttgagcaaggcaacagcatccgaacccagctccccaagtgaatagaaagagagaggaaggaaaccataacctgttgccgcgcacaaatccccgtacttagcacgcttacgcagagcaacatcagcgacaacccggcaaggcaaaaaatatatcgtgccagtctgagtcaaaggagaagatcttgtcaagtcaacgcacacatcacg

SEQ ID NO: 747 - DNA, 378 bp, Silene latifolia
gatgcgcgcagctttcattaaaataaaagaaaaagtttacatgaaattggtggggagccgagatactatctgggctcccacacccttagcaatagaaaagctaagtctagtaaaaatgtaagcggccacccgagcccctgcatcctgagataccgagaatttctggatccgcttgagcagggccacagcatccgaacccagctccccaagtgaagagaaagagaaaggaaggaaaccgtagcctgccaccgcgcacaaatccccatacttagcacactttcgctgagcagcatcagcgacaacccggccaggcacaaaatccgtcatcccagtctgagtcaaaggagaagaacctgtcaagtcaacgcacacatcacg

SEQ ID NO: 748 - DNA, 377 bp, Silene latifolia
gatgcgcgcagctttcattaaaagaaaaacaaaagtttacatgaaattggtggggagccgagagacaatctgggctcccacacccttagcaacagcaaagctaaatctagtaaaaatgtaagcggccacccgagcccccgcatcctgagataccgagaatttctggatccgcttgagcaaggcaacgacatccgaacccagctccccaagtgatgagaaagagaagggaaggaaaccataacctgttgccgcacacaaatccccatactttgcacacttacgctgagcagctcagcaacaacccggccaggcacaaaatccgccatccgagtctgagtcaaaggagaagaccctttcaagtcaacgcacacatcacg

SEQ ID NO: 749 - DNA, 378 bp, Silene latifolia
gatgcgcgcagctttcattaaaatgaaaataaaaatttacatgatattggtggggagccgagagacaatctgggctcccacacccttagcaacagtaaagctaagtctagtaaaaatgtaagctgccacccgagcccccgcttcctgagatcccgagaatttatggatccgcttgagcaaggcaacagcatccgaacacagctccccaagcgaagaggaagagaaaggaaggaaaccataacccgctgccgcacacaaaaccccgtacttagcacacttacgctgatcagcattagcgacaaccttgccagccacaaaatccgtcatcccagtctgagtcaaaggagaagacccagttaagtcaacgcacacatcacg

SEQ ID NO: 750 - DNA, 378 bp, Silene latifolia
gatgcgcgcagctttcattaaaataaaaataaaagattacatgaaattggtggggagccgagagacaatctgggctcccacgcccttagcaatagcaaagctaagtctagtaaaaatgtaagcggccacccgagcccccgcatcctgagataccgagaatttctggatccgcttgagcaagacaacagcatccgaacccagctccccaaatgaagagaaagcgaaaggaaggaaaccataacccgctaccgcgcacaaatcctcatacttagcacactttcgctgagcagcatcagcgacaacccggccaggcacaaaatccgtcatcccagtctgagtcaaaggagaagaacctgtcaagtcaacgcacacatcacg

SEQ ID NO: 751 - DNA, 378 bp, Silene latifolia
gatgcgcgcagctttcattaaaaggaaaataaaagtttacatgaaattggtggggagccgagagacaacctgggctcccacacccttagcaacagcaaagctaagtctagaaaaaatgtaagcggccacccgagccccagcatcctgagataccgagaatttctggatccgcttgagcaaggcaacagcatccgaactcagctccccaagtggagagaaagagaaaggtaggaaaccataacccgctaccgcgcacaaatccccatacttagcacactttcgctgagcagcatcagcgacaacccggcccgacacaaaatccgtcatccctgtccgagtcaaaggagaagaccctgtcaagtcaacgcacacatcacg

SEQ ID NO: 752 - DNA, 378 bp, Silene latifolia
gatgcgcgcagctttcattaatagaaaaacaaaagttgacatgaaattggtggggagctgagaaacaagctgggttcccacacccttagcaacagcaaagctaagtctagtaaaaatgtaagcggctaccctggcccccgcatcctgagataccgagaacttctggatccgtttgagcaaggcaacaacatccgaacccagctccccaagtgaagagaaagagaaaggaaggaaaccataacccgctgccgcgcacaaatccccgtacttagcacacttacgctgagcagtatcagcgacaacccggccaggcacaaaatccgtcatcccagtctgtgtcaaaggagaagagcttgtcaagtcaacgcacacatcacg

SEQ ID NO: 753 - DNA, 379 bp, Silene latifolia
gatgcgcgcagctttcattaatagagaaacaaaagtttacatgaaattggtggggagccgagaaacaagctgggctcccacacccttagcaacagcaaaggtaagtttagaaaaaaatgtaagcggccacccgagcccccgcattctgagataccgagaatttctggatccgcttgagcaaggcaacagcatctgaacccagctccccaagtgatgaaaaagagaagggaaggaaaccataacccactgccgcgcacaaatccccgtacttagcacacttacgctgagcagcatcagcaacaacccgatcaggcacaaaatccgtcatcccagtctgagtcagaggagaagaccctgtcaagtcaacgcacacatcacg

SEQ ID NO: 754 - DNA, 378 bp, Silene latifolia
gatgcgcgcagctttcattaaaataaaaataaaggtttacatgaaattggtggggagccgagaaacaatctgggctcccacacccttagcaatagtaaagctaagtctagtaaaaatgtaagcggccacccgagcccctgcatcctgagataccgagaatttctggatccgcttgagcaaggcaacagcatccgaccccaactccccaagtgatgagaaagagaatggaaggaaaccataacccgctgccgcgcacaaatccctatacttagcacacttacgctgagcagcatccgcaacaacctggccaggtaccaaattcgtcatcccagtctgagtcaaaggagaagacccggtcaagtcaacgcacacatcacg

SEQ ID NO: 755 - DNA, 378 bp, Silene latifolia
gatgcgcgcagctttcattaaaataaaaataaaattttacatgaaattggtggggagccgagatacaatctgagctcccacacccttagcaatagcaaagctaagtctagtaaaaatgtaagcggccacccgaccccccgcatcctgagataccgagaatttctgaatccgcctgagcaaggcaacagcatccgaacccaactccccaagtgatgagaaagagaatggaaggaaaccataacccgcagccgcgcacaaatccccatacttggcacacttacgctgagcagcatcagcaacaacccggccaggcacaaaatccgtcatcccagtctgagtcaaaggagaagatccggtcaagtcaacgcacacatcacg

SEQ ID NO: 756 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaaccataacccgctaccgcgcacaaatccccatacttagcacacttccgctgagcagcatcagcgacaacccggcccggtacaaaatctgccaacccagtctgagtcagaggtgaagaacctgtcaagtcaacgcacacatcacg

SEQ ID NO: 757 - DNA, 378 bp, Silene latifolia
gatgcgcgcagctttcattaaaataaaaataaaagtttacatgaaattggtggggggccgagaaacaatctggtctcccacacccttagcaatagcaaagctaagtctagtaaaactgtaaacggccacccgagaccccgcatcctgagataccgagaatttctggatccgcttgagcaaggcaacagcatccgaactcagctccccaagtgaagagaaagagaaaggaaggaaaccataacccgctgccgcgcacaaatccccatacttagcacacttccgctgagcagcatcagcaacaacccggctaggcacaaaattcgtcatcccagtctgagtcaaaggagaagacccggtcaagtcaacgcacacatcacg

SEQ ID NO: 758 - DNA, 378 bp, Silene latifolia
gatgcgcgcagctttcattaatataaaataaaaggtttacatgaaattggtagggagccgagagacaatctgggctcccacacccttagtaatagcaaagctaagtctagtaaaaatgtaagcggctacccgagcccccgcatcctgagataccgagaatttctggatccgcttgagcaaggcaacagcatccgaccccagctccccaaatgaagagaaagagaaaggtaggaaaccataacccgctaccgcgcacaaatctccatacttagcacactttcgctgagcagcatcagcgacaacccggcccggcacaaaatctgccaacccagtctgagtcaaaggtgaagaacctgtcaagtcaacgcacacatcacg

SEQ ID NO: 759 - DNA, 375 bp, Silene latifolia
gatgcgcgcagctttcattaaaataaaaataaaagtttacatgaaattggtggggagccgagagacaatctgggctcccacacccttagcaatagcaaagctaagtctagtaaaaatgtaagcggccacccgagcccccacatcctgagataccgagaatttctagatccgcttgagcaaggcaacagcatccgaacccagctccccaagtgaagagaaagagaaagtaaggaaaccataacctgataccgcacacaaatccccatacttacactttcgctgagtagcatcagcgacaacccggtcaggcataaaatccgccatcccagtctgagtcaaaggagaagaacctgtcaagtcaacgcacacatcacg

SEQ ID NO: 760 - DNA, 377 bp, Silene latifolia
gatgcgcgcagctttcattaaaataaaaatataagttacatgatattggtgggtagccgagaaaaaatctgggcccccacacccttagcagcagcaaagctaagtctagtgaaaatataagcggccacccgagcccccgcatcctgagataccgagaatttctggatccgcttgagcaaggcaacagcatccgaacccagctccctaagtgatgagaaagagaaaggaaggaaaccataacccgctgccgcacacaagtcctcgtacttagcacacttacgctgagcagcatcagcgacaactcaaccaggcacaaaatccgtcatcccagtctgagtcaaaggagaagacccagtcaagtcaacgcacacatcacg

SEQ ID NO: 761 - DNA, 378 bp, Silene latifolia
gatgcgcgcagctttcattacaagaaaaataaaagtttacatgaaattggtggggagccgagaaacaatctgggctcccacacccttagcaacggcaaagttaagtctagtaaaaatgtaagcggccacccgagcccccgcatcctgagataccgagaatttctggatccgcttgagcaaggcaacagcatctgaacctagctccccaagtgatgagaaagagaagggaaggaaaccataacccgctgctgcgcacaaatccccatacttggcacacttacgctgagcagcatcagcaacaacccagccaggcacaaaatccgtcatcccagtctgagtcaaaggagaagaccctgtcaagtcaacgcacacatcccg

SEQ ID NO: 762 - DNA, 378 bp, Silene latifolia
gatgcgcgcagctttcattaaaagaaaaacaaaagtttacatgaacttggcggggagccgagaaacaagctgggctcccacacccttagcaacagcaaagctaagtctagtaaaaatgtaagcggccacccgagcccccgcatcctgagataccaagaatttctggatcggcttgagcaaggcaacaacatccgaaccgaactccccaagtgatgagaaagagaagggaaggaaaccataacccgctgccgcgcacaaatccccatacttagcacacttacgctgagcagcatcagcaacaacccggtcaggcacaaaattcgtcatcccagtctgagtcaaaggagaagacccggtcaagtcaacgcacacatcacg

SEQ ID NO: 763 - DNA, 378 bp, Silene latifolia
gatgcgcgcagctttcattaaaagaaaaataaaagtttacatgaaattggtggggagccgagagacaatctgggctcccacacccttagcaatagcaaagctaagtctagaaaaaatgtaagcggccacccgagcccccgcatcctgagataccgagaatttctggatccgcttgagcaaggcaacagcatccgaacccagctccccaagtgaagagaaagagaaaggaaggaaaccataacccgctgccgcgcacaaatccccatacttagcacactttcgctgagcagcatcagcgacaacccggccaggcacaaaatccgtcatcccagtctgagtcaaaggagaagaacctgttaagtcaacgcacacatcacg

SEQ ID NO: 764 - DNA, 378 bp, Silene latifolia
gatgcgcgcagctttcattataagaaaaataaaagtttacatgaaatcggtggggagccgagagacaacctgggctcccacacccttagcaacaacaaagctaagtctagtaaaaatgtaagcgaccacccaaggccccgcatcctgagataccgagaatttctggatccgcttgagcaaggcaacagcattcgaacccagctccccaggtgaagagaaagagaagggaaggaaaccataactcgctgccgcgcacaaatccccgtacttagcacacttacgttgagcaacatcagcgacaacccgaccaagcacaaaatccgtcatcccagtctgagtcaaaggagaagactctgtcaagtcaacgcacacatcacg

SEQ ID NO: 765 - DNA, 377 bp, Silene latifolia
gatgcgcgcagctttcattagaaggaaaataaaagtttacatgaaattggtggggagctcagagacaatctgggctcccacacccttagcaacagcaaagctaagtctagtaaaaatgtaagcggccacccgagcccccgcatcctgagataccgagaatttctggatccgcttgagcaaggcaacaacatccgaacccagctccccaagtgaagagaaagagaagggaagaaaaccataacccgctgccgcgcacaactccccatacttagcacacttacgctgagcagcatcagcgacaacccggtcgggcacaaaatccgccatcccagtctgaatcatggagaagaccctgttaagtcaacgcacacatcacg

SEQ ID NO: 766 - DNA, 378 bp, Silene latifolia
gatgcgcgcagctttcattaaaagaaaaataaaattttacatgaaattggtggggagccgagagacaatctcggcacccacacccttagcaatagcaaagctaagtttagtaaaaatgtaagcggccacccgagcccccgcatcctgagataccgagaatttctggatccgcttgagcaaggaaacagcatccgaacccagctccctaagtgaagagaaagggaaaggaaggaaaccataaccccctaccgcgcacaaatccccatacttagcacactttcgctgagcagcatcagcgacaacccggccaggcacaaaatccgtcatcccagtctgagtcaaaggagaagaacctgtcaagtcaacgcacacatcacg

SEQ ID NO: 767 - DNA, 378 bp, Silene latifolia
gatgcgcgcagctttcattaaaagaaaaagaaaagtttacatgaaattggtggggagccgagaaacaagctgagttcccacatccttagcaacagcaaaactaagtctagtaaaaatataaacggccacccaagcccccgcatcctgagataccgagaatttctggatccgcttgagcaaggcaacagcatccgaacccagctccccaagtgatgagaaagagaagggaaggaaaccataacctgctaccacgcacaaatccccatacttagcacacttacgttgagcagcatcaacaacaaccccgccaggcacaaagttcgtcatcccagtctgagtcaaaggagaagacccggtcaagtcaacgcacacatcacg

SEQ ID NO: 768 - DNA, 378 bp, Silene latifolia
gatgcgcgcagctttcattaaaataaaaggaaaagtttacatgaaattggtggggagccgagagacaatctgggctcccacacctttagaaatagaaaagctaagacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgccaacccagtctgagtcaaaggtgaagaacctgtcaagtcaacgcacacatcacg

SEQ ID NO: 769 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctattaaaaatgtaagcggccacccgagcccctgcatcctgagataccgagaatttctggatccgcttgagcaaggcaacagcatccgaacccagctccccaactggagagaaagagaagggaaagaaaccataaccagctgccacgcacaaatcctcgcacttagcacacttccgctgagcagcatcagcgacaacccgaccgggcacaaaatccatcatcccagtctgagtcaaaggataagaccctgtcaagtcaacgcacacatcacg

SEQ ID NO: 770 - DNA, 378 bp, Silene latifolia
gatgcgcgcagctttcattaaaagaaaaataaaagtttacatgaaattggtggggagccgagagacaatctgggctcccacacccttagcaacaccaaagctaagtctagtaaaaatgtaagcggccacccgagccccagcatcctgagataccgagaatttctggatccgcttgagcaaggcaacagcatccgaacccaactccccaagtgaagagaaagagaaaggaaggaaaccataacccgctgccgtgcacaaatccccgtacttagcacacttatgctgagcagcatcagcgacaacccggccagacacaaaatttgtcatcccagtctgagttaaaggagaagaccctgtcaagtcaacgcacacatcacg

SEQ ID NO: 771 - DNA, 377 bp, Silene latifolia
gatgcgcgcagctttcattaaaagaaaaataaaagtttatatgaaattggtggggagccgaaacacagtctgggctcccacacccttagcaacaacaaagctaagtctagtaaaaatgtaagcggtcacccgagcccccgcatcctgagataccgagaatttctggatccgcttgagtaaggcaacatcatccgaacccagctccccaagagaatagaaagagaaaggaaggaaaccatagcccgctgccgcgcacaaatcctcatacttagcacactttcgctgagcatcatcagcgacaacctgtcaggcacaaaatccgtcatctcagtctgagtcaaaagagaagaatctgtcaagtcaacgcacacatcacg

SEQ ID NO: 772 - DNA, 377 bp, Silene latifolia
gatgcgcgcagctttcattaaaagaaaaataaaagtttacatgaaattggtggggagccgagagacaatctgggctcccacacccttagcaacagcaaagctaagtctagtaaaaatgtaagcggccactcgagccccgcatcctgagataccgagaatttctggatccgcttgagcaaggcaacaacatccgaacccagctccccaagtgaagagaaagagaaaggaaggaaaccataacccgctgccgcgcacaaatccccgtacttagcacacttacgctgcgcagcatcagcgacaacccgaccaggcacaaaatccgtcatctcagtctgagttaaaggagaagatcctgtcaagtcaacgcacacatcacg

SEQ ID NO: 773 - DNA, 378 bp, Silene latifolia
gatgcgcgcagctttcattaaaagaaaaacaaaagtttacatgaagttggtggggagccgagaaacaagctgggctcccacacccttagcaacaacaaagctaagtctagtaaaaatgtaagcggccacccgagcccccgcatcttgagataccgagaatttctggatccgcttgagcaaggtaacagcatccgaacccagctccccaagtgatgagaaggagaagggaaggaaaccataacccgctgccgcgcataaatccccgtacttagcacacttacgctgagcagcatcagcaacaacccggccaggcacaaaatccgtcatcccagtctgagtcaagggggaaaaccctgtcaagtcaacgcacacatcacg

SEQ ID NO: 774 - DNA, 338 bp, Silene latifolia
gatgcgcgcagctttcattaaaagaaaaataaaagtttacatgaaattggtgggaagccgagagacaatctgggctcccacacccttagcaacggcaaagctaagtctattaaaaatgtaagcggccacccgagcccccgcatcctgagataccgagaatttctggatccgcttgagcaagtcaacagcatccgaacccagttccccaagtgaagagaaagagaaaggaaggaaatcataacccgctgtcgcgcacaaatcccccggccaggcacaaaatccgtcataccagtctgagtcaaaagagaagaacatgtcaagtcaacgcacacatcacg

SEQ ID NO: 775 - DNA, 379 bp, Silene latifolia
gatgcgcgcagctttcattataataaaaataaaaggtttacatgaaattggtggggagccgagagacaatctgggctcccacactcttagcaatagtaaagctaatacgagtaaaaatgtaagcggctacccgagcctcagcatcctgagataccgagaatttctggatccgcttgagcaaggctacagcatctgaactcagctccccaagtgaagagaaagagaaaggtaggaaaccataacccgctgccgcacacaaatccccgtacttaacacactttcgctgagtagcatcagcgacaacccggcccggcacaaaattcgtcatcccggtctgagtcaaaggagaagacccggtcaagtcaacgcacacatcacg

SEQ ID NO: 776 - DNA, 377 bp, Silene latifolia
gatgcgcgcagctttcattcagaaaaataaaagtttacatgaaattggtggagagtcgataaacaatctgggctcccacacccttagcaacagcaaagctaagtctagtaaaaatgtaagcggccacccgagcccccgcatcctgagataccgagaatttctggatccgcttgagtaaggcaacagcatccgaacccagctccccaagtgaagagaaagagaaaggaaggaaaccataacccgctaccgcgcacaaatccccatacttagcacactttcgctgagcagcatcagcgacaacccggccaggcacaaaatccgtcatcccagtctgagtcaaagggagaaggacctgttaagtcaacgcacacatcacg

SEQ ID NO: 777 - DNA, 378 bp, Silene latifolia
gatgcgcgcagctttcattaaaataaaaataaaagtttacatgaaattagtggggagccgagagacaatctgggctcccacacccttagcaatagcaaagctaagtctagtaaaaatgtaagcggccacctgaggccccgcatcctgagataccgagaatttttggatctgcttgagtaaggcaacaacatccgaacccagctccccaagggaagagaaagagaaaggtagaaaaccataacccgctaccgcgcacaaatccccaaacttagcacactttcgctgagcagcatcagcgacaacccggcccggtacaaaatctgccaacccagtctgagtcaaaggtgaaaaacctgtcaagtcaacgcacacatcacg

SEQ ID NO: 778 - DNA, 378 bp, Silene latifolia
gatgcgcgcagctttcattaaaataaaagtaaaagtttacatgaaattggtggggagccgagatacaatctgggctcccacacccttagcaaaagaaaagctaagtctagtaaaaatgtaagcggccacccgagcccccgcatccagagataccgagaatttctggatccgcttgagcagggccacagcatccgaacccagctcccccagcgaagagaaagagaaaggaaggaaaccgtaacccgccaccgcgcacaaatccccatacttagcacacttccgctgagcagcatcagcgacgacccaaccaggcacaaaatccaccatcccagtctgaatcaaaggagaagaacctgttaagtcaacgcacacatcacg

SEQ ID NO: 779 - DNA, 378 bp, Silene latifolia
gatgcgcgcagctttcattaagataaaaattgaagtttacatgaaattggtggggagccgagaaacaatctgagctcccacacccttagcaatagcaaagctaagtctagtaaaaatgtaagcggccacccgagcccccgcatcctgagataccgagaatttctggatccgcttgagcaaagcaaccgcatccgaacccagctcccccagggaagagaaagagaaaggaaggaagccatagcccgctaccgcgcacaaatccccatacttggcacactttcgttgagcagcatcgacgacaacccggcccggcacaaaatctgtcaacccagtctgagtcaaaggggaagaacccgtcaagtcaacgcacacatcacg

SEQ ID NO: 780 - DNA, 361 bp, Silene latifolia
gatgcgcgcagctttcattaaaaggtaaactggtggggagccgagagacaatctgggctcccacacccatagctacagcaaagctaagtctagtaaaaatgtaagcggccacccgagcccccgcatcctgagataccaagaatttctggatccgcttgagcaagacaacgacatccgaacccagctccccaagtgaagagaaagagaaaggaaggaaaccataacccggtgccgcgcacaaattcccgtacttagcacacttacgcttagcagcatcaacgacaacccggccaggcacaaaatccgtcatcccagtctgagtcaaaggagaagaccctgtcaagtcaacgcacacatcacg

SEQ ID NO: 781 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaaccataacccgctaccgcgcacaaatccccatacttagcacactttcgctgagcagcatcagcgacaacccggcccggcacaaactctgccaacccagtctgagtcaaaggtgaagaacctgtcaagtcaacgcacacatcacg

SEQ ID NO: 782 - DNA, 378 bp, Silene latifolia
gatgcgcgcagctttcattaaaagaaaaataaaagtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgctaacccagtctgagtcaaaggtgaagaacctgtcaagtcaacgcacacatcacg

SEQ ID NO: 783 - DNA, 378 bp, Silene latifolia
gatgcgcgcagctttcattaacagaaaaataaaagtttacatgaaattggtggggagccgagaaacaatctgggctcccacacccttagcaacaacaaagctaagtctagtaaaaatgtaagcggccacccgagcccccgcatcctgagataccgagaatttctggatccgcttgagcaaggcaacagtatccgaacccagctccccaagtgatgagaaataaaatggaagaaaaccataaaccgctgccgcgcacaaatccccgtacttagcacacttacgttgagcagcatcagcaacaacccggccaagcacaaaatccgtcatcccagtctgagtcaaaggagaagaccctgtcaagtcaacgcacacatcacg

SEQ ID NO: 784 - DNA, 378 bp, Silene latifolia
gatgcgcgcagctttcattaaaagaaaaataaaagtttacatgaaattggtggggagccgagaaacaatctgggctcccacacccttagcaacagtaaaactaagtctagtaaaaatgtaagcggccacccaagcccccgcatcctgagataccgagaatttctggatccgcttgagcaaggaaataacatccgaacccagctccccaagtgatgagaaagagaagggtaggaaaccataacccgctgccgcgcacaaatccccgtacttagcacacttacgctgagcagcatcagcaacaacacagccaagcacaaaatccgtcatcccagtctgagtcaaaagagaagacccagtcaagtcaacgcacacatcacg

SEQ ID NO: 785 - DNA, 357 bp, Silene latifolia
gatgcgcgcagctttcattataataaaaataaaaggtttacatgagattggtggggagctgagagacaatctgggctcccacaccgttagcaatagtaaagctaagtctagtagaaatgtaagcggccacccgagcccccgcatcctgatataccgagaatttctggatccgcttgagcaaggcaacagcatccgaactcaactcccaagtgagagaagagaaggatgaaccataacccgctgccgcgcctagtctcgtacttagcacacttacctgagcagcatcagcgacaccgcagcacaatctcatccagtctgagtcaatgagagacctgtcagtcacgcacacatatcacg

SEQ ID NO: 786 - DNA, 378 bp, Silene latifolia
gatgcgcgcagctttcattaaaaggaaaataaaagtttacatgaaattggtggggagccgagagacaatctgggttcccacacctttagcaacaggaaagctaagtctagtaaaaatataagcggccacccgagcccccgcatcctgagataccgagaatttctggatccgcttgagcaatgcaacagcatccgaacccagctcccgaagtgaagtgaaagagaaaggaaggaaaccataacccgctgccgcgcacaaatctccgtacttagcacacttacgatgagcggcatcaacaacaacccggccaggcacaaaatctgtcatcccagtctgagtcaaaggagaagaccttgtcaagtcaacgcacacatcacg

SEQ ID NO: 787 - DNA, 378 bp, Silene latifolia
gatgcgcgcagctttcattagaagaaaaataaaagtttacatgaaattggtggggagccgagaaacaagctgggctcccacacccttagcaacaacaaagctaagtctagtaaaaatgtaagcggccacccgaacccccgcatcctgagataccgagaatttctggatccgcttgagcaaggcaacagcatccgaactcaactccccaagtgaagagaaagagaaaggaagaataccatagcccattgccgcgaacaaatcctcgtacttagcacacttacgctgagcagcatcagcgacaacccggccaggcacaaaatccgtcatcccagtctgagtcaaaggagaagaacctgtcaagtcaacgcacacatcacg

SEQ ID NO: 788 - DNA, 378 bp, Silene latifolia
gatgcgcgcagctttcattaaaagaaaaataaaaggtttacatgaaattggtggggagccgagagacaatctgggctcccacacccttagcaacaacaaagctaagtctagtaaaaatgtaagcagccactcgagcccccgcatcctgagataccgataatttctggatccgcttgagcaaggtaaatgcatccgaccccagctccccaagtgaagagaaagagaaaggtaggaaaccataacccgctaccgcgcacaaatccccatacttagcacacttacgctgagcagcatcagcgataacccggcgggcacaaaatccagcatcccagtctgagtcaaaggagaagaccctgttaagtcaacgcacacatcacg

SEQ ID NO: 789 - DNA, 378 bp, Silene latifolia
gatgcgcgcagctttcatttaatgaaaaacaaaagtttacatgaaattggtggggagccgagaaacaagctgggctcccacacccttagcaacagcaaagctaagtctagtaaaaatgtaagcggccacccgagcccccgcatcctgagataccgagaatttctggatccgcttgagcaaggcaacagcatacgaacccaactccccaagtgatgagaaagagaaaggaaggaaaccataacccggtgccgcgcacaaatccccatacttagcacacttccgctgagcagcatcagcaacaacccggccaggcacaaaattcgtcatcccagtctgagtcaaaggagaagacccggtcaagtcaacgcacacatcacg

SEQ ID NO: 790 - DNA, 378 bp, Silene latifolia
gatgcgcgcagctttcattaaaagaaaaataaaagtttacatgaaattggtgggtagccgagagacaatctgggcccccacacccttagcaatagcaaagctaagtctagtaaatatgtaagcggccacccgagcccccgcatcctgagataccgagaatttctagatccgcttgagcaaggcaacagcatccgatcccagttccccaagtgaagagaaagagaagggaaggaaaccataactcgctgtcgcgcacaaatccccatacttagcacactttcgctgagcagcatcaacaacaacccggccaggcacaaaatccgtcatcccagtctgagtcaaaggagaagaacatgtcaagtcaacgcacacatcacg

SEQ ID NO: 791 - DNA, 378 bp, Silene latifolia
gatgcgcgcagctttcattaaaaggcaaataaaagtttacatgaaattggtggggagccgagagacaatctgggctcccacacccttagcaacaacaaagctaagtctagtaaaaatgtaagcggctaccctggcccccgcatcctgagataccgagaatttctggatccgcttgagcaaggcaacagcatccgaactcaactccccgagtgaagagaaagagaaaggtaggaaaccataatccgctgccgcacacaaatctccatacttagcacacttccgctgagcagcatcagcaacaatccggccaggcacaaaattcgtcatcccagtctgagtcaaaggaaaagacccggtcaagtcaacgcacacatcacg

SEQ ID NO: 792 - DNA, 377 bp, Silene latifolia
gatgcgcgcagctttcataaaaggcaaataaaagtttacatgaaattggtgaggagccgagagacaatctgggctcccacacccttagcaacaacaaagctaagtctagtaaaaatgtaagcggctaccctggcccccgcatcctgagataccgagaatttctggatccgcttgagcaaggcaacagcatccgaactcaactccccgagtgaagagaaagagaaaggtaggaaaccataatccgctgccgcacacaaatctccatacttagcacacttccgctgagcagcatcagcaacaatccggccaggcacaaaattcgtcatcccagtctgagtcaaaggaaaagacccggtcaagtcaacgcacacatcacg

SEQ ID NO: 793 - DNA, 378 bp, Silene latifolia
gatgcgcgcagctttcattaaaagaaaaattaacgtttacatgaatttggtggggagccgagagacaatctgggctcccacacccttagcaatagcaaagctaagtctagtaaaaatgtaagcggccacccgagcccccgcatcctgagataccgagaatttcttgatccgcttgagcaagacaacagcatccgaacccagctccccaagtgaagagaaagagaaagataggaaaccataacccgctaccgcgcacaaatccccatacttaggacactttcgctgagcagcataagcgacaacccgacccggcacaaaatctgccaacacagtctgagtcaaaggagaagacccggtcaagtcaacgcacacatcacg

SEQ ID NO: 794 - DNA, 378 bp, Silene latifolia
gatgcgcgcagctttcaataaaataaaaataaaagtttaaatgaaattggtggagagccgagagacaatctgggctcccacacccttagcaacaacaaagctaagtctattaaaaatgtaagtggccacccgagcccccgcatcctgagataccgagaatttctggatccgcttgagcaaggcaacaacatccgaacccagctccccaagtgaggagaaagagaaaggagggaaaccataacctgctaccgcacacaagtccccgtacttaacacacttacgctgagcagcatcagcgacaacccggccaggcacaaaatccgtcatcccagtctgagtcaaaggagaagacccagtcaagtcaacgcacacatcacg

SEQ ID NO: 795 - DNA, 363 bp, Silene latifolia
gatgcgcgcagctttcattaaaagaaaaataaaagtttacatgaaattggtggggagccgagagacaatctgggctcccacacccttagcaatagtaaagctaatacgagtaaaaatgtaagtggctacccgagcccctgcatcctgagaaaccgagaatttctggatccacttgagcaaggcaacagcatccgaacccagttccccaagagaagggaaggaaaccataaccagctgccgcgcataaatccccatacttagcacactttcgctgagcagcatcagcaacaacccggcccggcacaaaatctgctaacccagtctgagtcaaggtgaaaacctgtcagtcacgcacacatcacg

SEQ ID NO: 796 - DNA, 377 bp, Silene latifolia
gatgcgcgcagcttcattaaaagaaaaataaaagtttacatgaaattggtggggagccgagagacaatctgggccaccacacccttagcaacaacaaaactaagtctagtaaaaatgtaagcggccacccgagcccccggatcctgagataccgagaatttctggattagcttgagcaaggcaacaacatccgtacccagctccccaagtgaagagaaagagaaaagaaggaaaccataacccgctgccgcagacaaatccccgtacttagcacacttacgctgagcagcatcagcgacaaccctgccaggcacaaaatccgtcatcccagtctgagtcaaaggagaagacccagctaagtcaacgcacacatcacg

SEQ ID NO: 797 - DNA, 365 bp, Silene latifolia
gatgcgcgcagctttcattaaaagaaaaacagaagtttacatgaaattggtggggagccgagagacaatctgggctcccacacccttagcaatagcaaagctaagcctagtaaaaatgtaagcggccacccgagcccccgcatcctgaggtatcgagaatttctgaattcgcttgagcaaggcaacagcatccgaacccagctcccaagtgaagagaaagagaaggtaggaaccataacccgctaccgctcacaatcccatacttagcacactttcgctgagcagcatagcgacacctgcagcacaatcgtcatctcagtctgagtcaagagagagctgtcagtcacgcacacatcacgatcacg

SEQ ID NO: 798 - DNA, 379 bp, Silene latifolia
gatgcgcgcagctttcattaaaagaaaaataaaaggtttacatgaaattggtggggagccgagggacaatctgggctcccacacccttagcaacagcaaagctaagtctagtaaaaatgtaagcggccacccgagcccccgcatcctgagataccgagaatttctagatccgcttgagcaaggcaacaacatctgaacccagctccccaagtgaagagaaagagaaaggaaggaaatcgtagcccgctgccgcgcacaaatccacatacttagcacactttcgctgagtagcatcagcgacaacccggccaggcacaaaatctgccaacccagtctgagtcaaaggtgaagaacctgtcaggtcaacgcacacatcacg

SEQ ID NO: 799 - DNA, 378 bp, Silene latifolia
gatgcgcgcagctttcattaaaaggaaattaaaagtttacatgaaattggtggggagccgagagacaatctgggctcccacacccttagcaatagcaaagctaagtctagtaaaaatgtaagcggctacccgagcccccgcatcctgagataccgagaatttctggatccgcttgagcaaggcaacagcatccgaacccagctccccaagtgatgagaaagagaaaggaaggaaaccataacccgctgccgcacacaaatccccatacttagcacactttcgctgagcagcatcagcgacaacccggcacgacacaaaatctgccaacccagtctgagtcaaaggtgaagaacctgtcaggtcaacgcacacatcacg

SEQ ID NO: 800 - DNA, 378 bp, Silene latifolia
gatgcgcgcagctttcattaatagaaaaacaaaagtttacatgaaattggtggggagcctagaaacaatctgggctcccagacccttagcaacagcaaagctaagtctagtaaaaatgtaagcgaccacccgagccctcgcatcctgagataccgagaatttttggatccgcttgagcaaggcaacaacatccgaacccaactccccaagtgatgagaaagagaatggaaggaaaccataatccgctgccgcacacaaatctccatacttagcacacttccgctgagcagcatcagcaacaacccggccaggcacaaaatccgccatctcagtctgagtcaaaggagaagaccctgtcaagtcaacgcacacatcacg

SEQ ID NO: 801 - DNA, 378 bp, Silene latifolia
gatgcgcgcagctttcattaaaataagaataaaagtttacatgaaattggtggggagccgagaaacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagcgaagagaaagagaaaggtaggaaaccataacccgctgccgcacacaaatctccatacttagcacacttccgctgagcagcatcagcaacaatccggccaggcacaaaattcgtcatcccagtctgagtcaaaggaaaagacccggtcaagtcaacgcacacatcacg

SEQ ID NO: 802 - DNA, 379 bp, Silene latifolia
gatgcgcgcagctttcattaaaagaaaaataaaaggtttacatgaaattggtggggagccgagagacaatctgggctcccacacccttagcaatagtgaagctaatacgagtaaaaatgtaagcggccacccgagcccccgcatcctgagataccgagaatttctggatccgcttgagcaaggcaacagcatccgaactcaactccccgagtgaagagaaagagaaaggaaggaaaccatagcccgctgccgcgcacaaatccccatacttagcacacttacgctgagcagcatcagcgacaacccggccaggcacaaaatccgacatcccagtccgagtcaaagaagaagaccctatcaagtcaacgcacacatcacg

SEQ ID NO: 803 - DNA, 377 bp, Silene latifolia
gatgcgcgcagctttcattaatagaaaaacaaaattttacatgaaattggtggggagccgagaaacaatctgggctcccacacccttagcaatagtaaagctaatacgagtaaaaatgtaagcggccacccgagccctcgcatcctgagataccgagaatttctgtatccgcttgagcaaggcaacagcatccgaacccaactccccaagtgatgagaaagagaatggaaggaaaccataacccgctgccgcgcacaaatccccgtcttagcacacttacgctgagcagcatcagcgataacccggccaggcacaaaatccttcatcccagtctgagtcaaaggagaagcccctgtcaagtcaacgcacacatcacg

SEQ ID NO: 804 - DNA, 381 bp, Silene latifolia
gatgcgcgcagctttcattaaaaaaagaaaaataaaagtttacatgaaattggtggggagccgagagacaatctgggttcccacacctttagcaacaggaaagctaagtctagtaaaaatataagcggccacccgagcccccgcatcctgagataccgagaatttctggatccgcttgagcaatgcaacagcatccgaacccagctcccgaagtgaagtgaaagagaaaggaaggaaaccataacccgctgccgcgcacaaatctccgtacttagcacacttacgatgagcggcatcaacaacaacccggccaggcacaaaatctgtcatcccagtctgagtcaaaggagaagaccttgtcaagtcaacgcacacatcacg

SEQ ID NO: 805 - DNA, 377 bp, Silene latifolia
gatgcgcgcagctttcattaaaataagaataaaagtttacatgaaattggtggggagccgagagacaatctgggctcccacacccttagcaacaacgaagctaagtctagtaaaaatgtaagcggccacccgagcccccgcatcctgagataccgagaatttctggatccgcttgagcaaggcaacagcatccgaacccaactccccaagtgaagagaaagagaaaggtaggaaaccataacccgctaccgcgcacaaatccccatacttagcacacttcgctgagcagcatcagcgacaacccggcccggcacaaaatctgccaacccagtctgagtcaaaggtgaagaacctgtcaggtcaacgcacacatcacg

SEQ ID NO: 806 - DNA, 378 bp, Silene latifolia
gatgcgcgcagctttcattaaaataagaataaaagtttacatgaaattggtggggagccgagatacaatctggcctcccacacccttagcaatagtaaagctaagtctagtaaaaatgtaagcggctacccgagccccagcatcctgagatgccgagaatttctggatccgcttgagcaaggcaacagcatgcgaacccagctccctaagtgaagagaaagagaaaggaagaataccatagcccgttgccgcgcataaatccccgtacttaacacacttacgctgagcagcatcagcgacaacccgcccgtgcacaaaatccgtcatcccagtctgagtcaagggggaagaccctgtcaagtcaacgcacacatcacg

SEQ ID NO: 807 - DNA, 384 bp, Silene latifolia
gatgcgcgcagctttcattaaaagaaaaatgaaaataaaagtttacatgaaattggtggggagccgagagacaatctgggctcccacacccttagcaacagcaaagctaagtctagagaaaatgtaagcggccacccgagcccccgcatcctgatataccgagaatttcttgatccgcttgagcaaggcaacaacattcgaacccagctccccaaatgatgagaaagagaagggtaggaaaccataacccattgccgcgcacaaatccccgtacttagcacacttatgctgagcagcatcagcaacaacccggccatgcacaaaatccgtcatcccagtctgagtcaaaggagaagaccctgtcaagtcaacgcacacatcacg

SEQ ID NO: 808 - DNA, 377 bp, Silene latifolia
gatgcgcgcagctttcattaaaataaaagtaaaagtttacatgaaattggtggggagccgagagacaatctgggctcacacacccttagccatagcaatgttaagtctagtaaaaatgtaagcggctacccgagccccagcatcctgagataccgagaatttctggatccgcttgagaaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgccaacccagtctgagtaaaaggtgaagaacctgtcagtcaacgcacacatcacg

SEQ ID NO: 809 - DNA, 378 bp, Silene latifolia
gatgcgcgcagctttcattaaaagaaaaataaaagtttacatgaaattggtggggagccgagagacaatctgggctcccacacccttagctacaacaaatctaagtctagtaaaaatgtaagcggccacccgagcccccgcatcctgagataccgagaatttctggatccgcttgagcaaggcaacagcatccgaactcaactccccaagcgaagagaaagagaaaggtaggaaaccataacccgctaccgcgcacaaatccccgtacttagcacactttcgctgagcagcatcagcaacaacccggcccggcacaaaatctgtcatcccagtctgagtcaaaggacaagaccctgtcaagtcaacgcacacatcacg

SEQ ID NO: 810 - DNA, 378 bp, Silene latifolia
gatgcgcgcagctttcattaaaagagaaataaaagtttacatgaaattggtggggtgccgagagacaatctgggctcccacacccttagcaacagcaaagctaagtctagtaaaaatgtaagcggctacccgagcccccgcatcctgagataccaagaatttctggatccgcttgagcaaggcaacagcatccgaacccaactcccaaagagaagagaaagagatgggaaggaaaccataacccgctaccgcgcacaaatccccatacttagcacactttcgctgagcagcatcagcaacaacccggcccgtcacaaaatctgccaacctagtctgagtcaaaggtgaagaacctgtcaggtcaacgcacacatcacg

SEQ ID NO: 811 - DNA, 378 bp, Silene latifolia
gatgcgcgcagctttcattaaaggaaaagtaaaagtttacatgaaattggcgggtagccgagagacaatctgggctcccacacccttagcaataacaaagctaagtctagtaaaaatgtaagcggctacccaagcccccgcatcctgagataccgagaatttctggatccgcttgagcaaggcaacaacatccgaacccacctccccaagggaagagaaagagaaaggtaggaaaccataacccgctaccgcgcacaaatccccatacttagcacactttcgctgagcagcatcagcgacaactcggcccggcacaaaatctgccaacccagtctgagtcaaaggtgaagaacctgtcaggtcaacgcacacatcacg

SEQ ID NO: 812 - DNA, 378 bp, Silene latifolia
gatgcgcgcagctttcattaaaaggaaaataaaagtttacatgaaattggtggggagccgagaaacaatctgggctcctacacccttagcaacagcaaagctaagtttagcaaaactgtaagcggccacccgagcccccgcatcctgagataccgagaatttttggatccgcttgagcaagacaacagcatccgaacccagctccccaagtgaagagaaagagaaaggaaggaaaccataacccgctaccgcgcacaaatccccatacttagcacactttcgctgagcagcatcagcaacaacccggtcaggcacaaaatccgtcatcccagtctgagtcaaagaagaagaaccagtcaagtcaacgcacacatcacg

SEQ ID NO: 813 - DNA, 375 bp, Silene latifolia
gatgcgcgcagctttcattaaaataaaaataaaagtttacatgaaattggtggggagtcgcgaaacaatttaggcccccacacccttagcaacagcaaagctaagtctagtgaaaatataagcggccacccgagccaccgcaacctgagataccgagaatttctggatccgcttgagcaaggcaacaatccgaacccagctccccaagtgaagagaaagagaagagaagtaaaccataaccagctgccgcgcaaaaatccccgtacttagcacacttacgctgagcagcatcagcgataacccggccaggcacaaatccgtcatcccagtctgagacaaaggagaagaccctgtcaagtcaacgcacacatcacg

SEQ ID NO: 814 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagagaagagaaagagaaaggtaggaaaccataacccgctaccgcgcacaaatccccatacttagcacactttcgctgagcagcatcagcgacaacccggcccggcacaaaatccgctaacccagtctgagtcaaaggtgaagaacccgtcatgtcaacgcacacatcacg

SEQ ID NO: 815 - DNA, 378 bp, Silene latifolia
gatgcgcgcagctttcattaaaataagaataaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagcgaagagaaagagaaaggaaggaaaccataacccgctaccgcgcacaaatccccatacttagcacactttcgctgagcagcatcagcgacaacccgaccagacacaaaatccgtcatcccagtcagagtcaaaggagaagaacccgtcaggtcaacgcacacatcacg

SEQ ID NO: 816 - DNA, 376 bp, Silene latifolia
gatgcgcgcagctttcattataaggaaattaaaagtttacatgaaattggtggggagccgagagacaatctgggctcccacacccttagcaacagcaaagctaagtctagtaaaatgtaagcggccacccgagcccccgcatcctgagataccgagaatttctggatcctcttgagcaagggaataacatccgaacccagctccccaagtgaagagaaagagaaaggaaggaaaccataacccgctgccgcgcaaaaatccccgtacttagcacacttacgctgagcagcatcagcgataacccggccaggcacaaatccgtcatcccagtctgagacaaaggagaagaccctgtcaagtcaacgcacacatcacg

SEQ ID NO: 817 - DNA, 376 bp, Silene latifolia
gatgcgcgcagctttcattaaaagaaaaataaaagtttacatgaaattggtgggaagccgagagacaatctgggctcccacaaccttagcaacaacaaagctaagtctagtgaaaatataagcggccacccgagccaccgcaacctgagataccgagaatttctggatccgcttgagcaaggcaacaatccgaacccagcttcccaagtgaagagaaagagaagagaagtaaaccataaccagctgccgcgcataaatcctcatacttagcacacttacgctgagcagcattagcgacaacccgaccgggcacaaaatccatcatcccagtctgagtcaatgcagaagaccctgtcaagtcaacgcacacatcacg

SEQ ID NO: 818 - DNA, 379 bp, Silene latifolia
gatgcgcgcagctttcattaaaaggaaaataaaagtttacatgaaattggtgggggagccgagagacaatctgggctcccacacccttagcaacagcaaagctaagtcaagtaaaaatgtaagcggccacccgagcccccgcatcctgagataccgagaatttctggatccgcttgagcaaggcaacatcatccgaactcaactccccgagttaagagaaagagaaaggtaggaaaccataacccgctaccgcgcacaaatccccatacttagcacactttcgctgagcagcatcaacgacaacccggcccggcacaaaatctgccaacccagtctgagtcaaaggtgaagaacctgtcaggtcaacgcacacatcacg

SEQ ID NO: 819 - DNA, 379 bp, Silene latifolia; identical to SEQ ID NO: 818

SEQ ID NO: 820 - DNA, 378 bp, Silene latifolia
gatgcgcgcagctttcattaaaagaaaaacagaagtttacatgaaattggtggggagccgagaaacaagctgggctcccacacccttagcaacagcaaagctaagtctagtaaaaatgtaagcggccacccgagcccctgcatcctgagaaaccgagaatttctggatccgcttgagcaaggcaacagcatccgaacccagctccccaagggaagagaaagagaaaagaaggaaaccataacccgctaccgcgcacaaatccccatacttagcacactttcgctgagcagcatcagcgacaacccggccaggcacaaaatccgtcatcccagtctgagtcaaaggagaagaacctgtcaagtcaacgcacacatcacg

SEQ ID NO: 821 - DNA, 378 bp, Silene latifolia
gatgcgcgcagctttcattaaaagaaagataaaagtttacatgaaattggtggggagccgagaaacaatctgggctcccacacccttagcaacaacaaagctaagtttagtaaaaatgtaagcggccacccgagcccccgcatcctgagataccgagaatttctggatccgcttgagcaaggcaacagcatccgaacccagctcctcaagtgaagagaaagagaagggaaggaaaccatacccagctgtcgcgcacaaatccccgtacttagcatatttacgctgagcagcatcagcgacaactcggccggggacaaaatccatcatcccggtctgagtcaaaggggaagaccatgtcaagtcaacgcacacatcaag

SEQ ID NO: 822 - DNA, 378 bp, Silene latifolia
gatgcgcgcagctttcattaaaagaaaaacagaagtttacatgaaattggtggggagccgagaaacaagctgggctcccacacccttagcaacagcaaagctaagtctagtaaaaatgtaagcggccacccgagcccctgcatcctgagaaaccgagaatttctggatccgcttgagcaaggcaacagcatccgaacccagctccccaagggaagagaaagagaaaagaaggaaaccataacccgctaccgcgcacaaatccccatacttagcacactttcgctgagcagcatcagcgacaacccggccaggcacaaaatccgtcatcccagtctgagtcgaaggagaagaacctgtcaagtcaacgcacacatcacg

SEQ ID NO: 823 - DNA, 378 bp, Silene latifolia
gaggcgcgcagctttcattaaaataagaataaaggtttacatgaaattggtggggagccgagagacaatctgggctcccacacccttagcaatagcaaagctaagtctagtaaaaatgtaagcggccacccgagccccagcatcctgagataccgagaatttctggatccgcttgagcaaggcaacagcatccgaacccagctccccaagtgaagagaaggagaaaggaaggaaaccataacccgctatcgcgcacaaatccccatacttagcacactttcgctgagcagcatcagcgacaacccggcccggcacaaaatctgtcaacccagtctgagtcaaaggtgaagaacctgtcaagtcaacgcacacatcacg

SEQ ID NO: 824 - DNA, 378 bp, Silene latifolia
gatgcgcgcagctttcattaaaaataaaataaaagattacatgaaattggtggggagccgcgagacaatctgggctcccctacccttagcaacagcaaagctaagtctagtaaaaatataagcggacacccgagcccccacatcctgggatactgagaatttctggatccgcttgagtaaggcaacagcatccgaacccagctccccaagtgaagagaaagataagggaaggaaaccataaccagctgccgcgcacaaatctccgtacttagcacacttacgctgagcagcatcaccgacaacccggccgggcacaaaatccatcattctagtctgagtcaaaggagaagaccctgtcaagtcaacgcacacatcacg

SEQ ID NO: 825 - DNA, 378 bp, Silene latifolia; identical to SEQ ID NO: 820

SEQ ID NO: 826 - DNA, 372 bp, Silene latifolia
gatgcgcgcagctttcattaaaaaaaaagtttacatgaaattggtggggagccgagagacaatctgggctcccaaacccttagcaatagcaaagctaagtcttgtaaaaatgtaagcggccacccgagcccccgcatcctgagataccgagaatttctggatccgcttgagcaaggcaacagcatccgaacccagctccccaagtgaagagttagagaaaggaaggaaacaataacccgctaccgcgcacaaatccccatacttagcacactttcgctgagcagcatcagcgacaacccggccaggcacaaaatccgtcatcccagtctgagtcaaaggagaagaacttgtcaagtcaacgcacacatcacg

SEQ ID NO: 827 - DNA, 375 bp, Silene latifolia
gatgcgcgcagctttcattataataaaaacaaaatgtttacatgaaattggtggggagccgagagacaatctgggctcccacacccttagcaatagtaaagctaatacgagtaaatatgtaagcggctacccgagccccagcatcctgagataccgagaatttctggatccgcttgagcaaggcaacagcatccgaactcaactccccgagtgaagagaaagagaaaggtaggaaaccatagcccgctaccgcgcacaaatccccatacttagcacactttcgctgagcagcatcagcgacaacccggcccggcacaaaatctgccaacccagtctgagtcaaaggtgaagaacccgtcaagtcaacgcacacat

SEQ ID NO: 828 - DNA, 378 bp, Silene latifolia; identical to SEQ ID NO: 820

SEQ ID NO: 829 - DNA, 378 bp, Silene latifolia
gatgcgcgcagctttcattaaaagaaaaacagaagtttacatgaaattggtagggagccgagaaacaagctgggctcccacacccttagcaacagcaaagctaagtctagtaaaaatgtaagcggccacccgagcccctgcatcctgagaaaccgagaatttctggatccgcttgagcaaggcaacagcatccgaacccagctccccaagggaagagaaagagaaaagaaggaaaccataacccgctaccgcgcacaaatccccatacttagcacactttcgctgagcagcatcagcgacaacccggccaggcacaaaatccgtcatcccagtctgagtcaaaggagaagaacctgtcaagtcaacgcacacatcacg

SEQ ID NO: 830 - DNA, 378 bp, Silene latifolia
gatgcgcgcagctttcattaaaatagaaataaaagtttacatgaaattggtggggagccgagagacaatctgggctcccacacccttagcaatagcaaagctaagtctagtaaaaatgtaagcggccacccgagcccccgcatcctgagatatcgagaatttctggacccgcttgagcaaggcaacaacatccgaacccagctccccaagtgaagagaaagagaaaggtaggaaaccataacccgctaccgcgcacaaatccccatacttagcacactgtcgctgagcagcatcagcgacaacccggcccggcacaaaatctgccaacccagtctgagtcaaaggtgaataacctgtcaagtcaacgcacacatcacg

SEQ ID NO: 831 - DNA, 378 bp, Silene latifolia
gatgcgcgcagctttcattaaaagagaaacagaagtttacatgaaattggtggggagccgagaaacaagctgggctcccacacccttagcaacagcaaagctaagtctagtaaaaatgtaagcggccacccgagcccctgcatcctgagaaaccgagaatttctggatccgcttgagcaaggcaacagcatccgaacccagctccccaagggaagagaaagagaaaagaaggaaaccataacccgctaccgcgcacaaatccccatacttagcacactttcgctgagcagcatcagcgacaacccggccaggcacaaaatccgtcatcccagtctgagtcaaaggagaagaacctgtcaagtcaacgcacacatcacg

SEQ ID NO: 832 - DNA, 379 bp, Silene latifolia
gatgcgcgcagctttcattataataaaaataaaaggcttacatgaaattggtggggagccgagagacaatctgggctcccacacccttagcaatagtaaagctaatacgagtaaaaatgtaagcggctacccgagccccagcatcctgagatgccgagaatttctggattcgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgctaacccagtctgagtcaaaggtgaagaacctgtcaagtcaacgcacacatcacg

SEQ ID NO: 833 - DNA, 378 bp, Silene latifolia
gatgcgcgcagctttcattaaaaataaaataaaagattacatgaaattggtggggagccgcgagacaatctgggctcccctacccttagcaacagcaaagctaagtctagtaaaaatataagcggacacccgagcccccacatcctgggatactgagaatttctggatccgcttgagtaaggcaacagcatccgaacccagctccccaagtgaagagaaagataagggaaggaaaccataaccagctgccgcgcacaaatctccgtacttagcacacttacgctaagcagcatcaccgacaacccggccgggcacaaaatccatcattctagtctgagtcaaaggagaagaccctgtcaagtcaacgcacacatcacg

SEQ ID NO: 834 - DNA, 378 bp, Silene latifolia; identical to SEQ ID NO: 824

SEQ ID NO: 835 - DNA, 378 bp, Silene latifolia
gatgcgcgcagctttcattaaaaggaaaataaaagtttacatgaaattggtggggagccgagagacaatctgggctcccacacccttagcaacagcaaagctaagtctagtaaaaatgtaagcggccaccctagcccccgcatcctaagatatcgagaatctctggatccgcttgagcaaggcaacagcatctgaacccagctccccaagtgaagagaaagagaaaggaaggaaaccataacccgctgccgcgcacaaatccccgtacttagcacacttacgctgagcagcatcagcgacaacccggccaggcacaaaatccgccatcccagtctgagtcaaaggagaagaccctgtcaagtcaacgcacacatcacg

SEQ ID NO: 836 - DNA, 379 bp, Silene latifolia
gatgcgcgcagctttcattaaaagaaaaacagaagtttacatgaaattggtggggagccgagaaacaagctgggctcccacacccttagcaacagcaaagctaagtctagtaaaaatgtaagcggccaccacgagcccctgcatcctgagaaaccgagaatttctggatccgcttgagcaaggcaacagcatccgaacccagctccccaagggaagagaaagagaaaagaaggaaaccataacccgctaccgcgcacaaatccccatacttagcacactttcgctgagcagcatcagcgacaacccggccaggcacaaaatccgtcatcccagtctgagtcaaaggagaagaacctgtcaagtcaacgcacacatcacg

SEQ ID NO: 837 - DNA, 378 bp, Silene latifolia; identical to SEQ ID NO: 820

SEQ ID NO: 838 - DNA, 378 bp, Silene latifolia
gatgcgcgcagctttcattaaaaataaaataaaagattacatgaaattggtggggagccgcgagacaatctgggctcccctacccttagcaacagcaaagctaagtctagtaagaatataagcggacacccgagcccccacatcctgggatactgagaatttctggatccgcttgagtaaggcaacagcatccgaacccagctccccaagtgaagagaaagataagggaaggaaaccataaccagctgccgcgcacaaatctccgtacttagcacacttacgctgagcagcatcaccgacaacccggccgggcacaaaatccatcattctagtctgagtcaaaggagaagaccctgtcaagtcaacgcacacatcacg

SEQ ID NO: 839 - DNA, 379 bp, Silene latifolia
gatgcgcgcagctttcattaaaataaaaataaaaggtttacatgaaattggtggggagccgagagacaatctgggctcccacacccttagcaatagcaaagctaagtctagtaaaaatgtaagcggctacccgagcccccgcatcctgagataccgagaatttctggatccgcttgagcaaggcaacagcatccgaacccagctccccaagtgaagagaaagagaaaggtaggaaaccataactcgctaccgcgcacaaatccccatacttagcacactttcgctgagcagcatcagcgacaacccggcccggcacaaaatctgccaacccagtctgagtcaaaggtgaaaaacctgtcaagtcaacgcacacatcacg

SEQ ID NO: 840 - DNA, 384 bp, Silene latifolia
gatgcgcgcagctttcattaaaataaaaataaaaataaaagtttacatgaaattggtggggagccgagagacaatctgggctcccacacccttagcaatagcaaagctaagtctagtaaaaatgtaagcggccacccgagcccccgcatcctgagataccgagaatttctggatccgcttgagcaaggcaacagcatccgaacccagctccccaagtgaagagaaagagaaaggtaggaaaccatagcccgctaccgcgcacaaatccccatacttagcacactttcgctgagcagcatcagcgacaacccggcccggcgcaaaatctgccaacccagtctgagtcaaaggtgaagaacctgtcaagtcaacgcacacatcacg

SEQ ID NO: 841 - DNA, 378 bp, Silene latifolia; identical to SEQ ID NO: 824

SEQ ID NO: 842 - DNA, 378 bp, Silene latifolia
gatgcgcgcagctttcattaaaagaaagataaaagtttacatgaaattggtggggagccgagaaacaatctgggctcccacacccttagcaacaacaaagctaagtttagtaaaaatgtaagcggccacccgagcccccgcatcctgagataccgagaatttctggatccgcttgagcaaggcaatagcatccgaacccagctcctcaagtgaagagaaagagaagggaaggaaaccatacccagctgtcgcgcacaaatccccgtacttagcatatttacgctgagcagcatcagcgacaactcggccggggacaaaatccatcatcccggtctgagtcaaaggagaagatcatgtcaagtcaacgcacacatcacg

SEQ ID NO: 843 - DNA, 378 bp, Silene latifolia
gatgcgcgcagctttcattaaaacaaaaataaaagtttacatgaaattggtggggagccgtgaaacaatctgagctcccacacctttagcaatagcaaagctaagtccagtaaaaatgtaagcggcaacccgagcccccgcatcctgagataccgagaatttctggatccgcttgagtaaggcaacagcatccgaacccagctcccctagtgaagagaaagagaaaggaaggaaaccataacccgctaccgcgcacaaatccccatacttagcacactttcgctgagcagcatcagcaacaacccggcccgacacaaaatctgccaacccagtctgagtcaaaggtgaagaacctgtcaagtcaacgcacacatcacg

SEQ ID NO: 844 - DNA, 377 bp, Silene latifolia
gatgcgcgcagctttcattaagagaaaaatatcagattacatgaaattggtgggaggccgagagacaatctaggctctcacacccttagcaacagcaaagctaagtctagtgaaaatataagcggccaccagagccccgcatcctgagataccgagaatttctggatccgcttgagcaagacaacagcatccgaactcagctccccaagtaaagagaaagagaagggtaggaaactataaccagctgtcgcgcataaatccccatacttagcacacttacgctgagcagcatcggtgacaacccgatcgagcacaaaatccagcatcgcagtttgagtcaaaggagaagaccctgtcaagtcaacgcacacatcacg

SEQ ID NO: 845 - DNA, 378 bp, Silene latifolia
gatgcgcgcagctttcattaaaagaaaaataatagttacatgaaattggtggggagccgagatacaatctgggctcccacacccttagcaatagcaaagctaagtctagtaaaaatgtaagcggccacccgagcccccgcatcctgagataccgagaatttctggatccgcttgagtaaggcaacaacatccgaacccagccccccaagtgaagagaaagagaaaggaaggaaaccgtaatccgccaccgcgcacaaatccccatacttagcacactttcgctgagcagcatcagcgacaacctggccaggcacaaaatccgtcatcccgggtctgagtcaaaggagaagaacctgtcaagtcaacgcacacatcacg

SEQ ID NO: 846 - DNA, 379 bp, Silene latifolia
gatgcgcgcagctttcattaaaataaaagtaaaaggtttacatgaaattggtggggagccgagagacaatctgggctcccacacccttagcgatagcgaagctaagtctagtaaaaatgtaagcggctacccgagcccccgcatcctgagatacggagaatttctggatccacttgagcaaggcaacagcatccgaacccaactccccaagagaagagaaagagaaaggtaggaaaccataacccgctaccgcgcacaaatccccatacttagcacactttcgctgagcagcatcagcaacaacccggcccgacacaaaatctgccaacccagtctgagtcaaaggtgaagaacctgtcaagtcaacgcacacatcacg

SEQ ID NO: 847 - DNA, 379 bp, Silene latifolia
gatgcgcgcagctttcattaaaataaaagtaaaaggtttacatgaaattggtggggagccgagagacaatctgggctcccacacccttagcaatagcgaagctaagtctagtaaaaatgtaagcggctacccgagcccccgcatcctgagatacggagaatttctggatccacttgagcaaggcaacagcatccgaacccaactccccaagagaagagaaagagaaaggtaggaaaccataacccgctaccgcgcacaaatccccatacttagcacactttcgctgagcagcatcagcaacaacccggcccgacacaaaatctgccaacccagtctgagtcaaaggtgaagaacctgtcaagtcaacgcacacatcacg

SEQ ID NO: 848 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaggtgaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 849 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccacccgagcccccgcatcctgagataccgagaatttctgaatccgcttgagcaaggcaacagcatccgaacccagctccccaagtgaagagaaagacaaaggaaggaaaccataacccgctatcgcgcacaaatccccatacttagcacactctcgttgagcagcatcagcgacaacccggccaggcacaaaattcgtcatcccagtctgagtcaaaggagaagaacctgtcaagtcaacgcacacatcacg

SEQ ID NO: 850 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccacccgagcccccgcatcctgagataccgagaatttctgaatccgcttgagcaaggcaacagcatccgaacccagctccccaagtgaagagaaagacaaaggaaggaaaccataacccgctatcgcgcacaaatccccatacttagcacactttcgttgagcagcatcagcgacaacccggccaggcacaaaattcgtcatcccagtccgagtcaaaggagaagaacctgtcaagtcaacgcacacatcacg

SEQ ID NO: 851 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgccaacccagtctgagtcaaaggtgaagaacctgtcaagtcaacgcacacatcacg

SEQ ID NO: 852 - DNA, 378 bp, Silene latifolia
gatgcgcgcagctttcattaaaagagaaataaaagtttacatgaaattggtggggagccgagagacaatctgggctcccacacccttagcaacagcaaagctaagtctagtaaaaatgtaagcggccacccgagcccccatattctgagataccgagaatttctggatccgcttgagcaaagcaacagcatccgaacccagctccccaagtgaagagaaagagaaaggaaggaaaccatagcccgctgccgcgcacaaatccccatacttagcgcactttcgctgagcagcatcagcgacaacccggccaggcacaaaatccgtcaaaccagtctgagtcaaaggagaagaacctgtcaagtcaacgcacacatcacg

SEQ ID NO: 853 - DNA, 378 bp, Silene latifolia; identical to SEQ ID NO: 820

SEQ ID NO: 854 - DNA, 379 bp, Silene latifolia; identical to SEQ ID NO: 851

SEQ ID NO: 855 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccacccgagcccccgcatcctgagataccgagaatttctgaatccgcttgagcaaggcaacagcatccgaacccagctccccaagtgaagagaaagacaaaggaaggaaaccataacccgctatcgcgcacaaatccccatacttagcacactttcgttgagcagcatcagcgacaacccggccaggcacaaaattcgtcatcccagtctgagtcaaaggagaagaacctgtcaagtcaacgcacacatcacg

SEQ ID NO: 856 - DNA, 378 bp, Silene latifolia
gatgcgcgcagctttcattaaaagaaaaataaaagtttacatgaaattggtggggagccgagagataatctgggctcccacacccttagcaacaacaaagttaagtctagtaaaaatgtaagcggccacccgagcccccgcatccttagataccaagaatttcttgatccgcttgagcaaggcaacagtatccgaacccagctctccaagtgaagagaaagagaagggaaggaaaccataacccgctgctgcgcacaaatccccgtacttagcacacttgcgcagagcagcatcagcgagaacccgaccaggcacaaaatccgtcatcccagtctaagtcaaaggagaagaccctgtcaagtcaacgcacacatcacg

SEQ ID NO: 857 - DNA, 378 bp, Silene latifolia
gatgcgcgcagctttcattaaatgaaaaacaaaagtttacatgaaattggcggggagccgagaaacaagctgggctcccacacccttagcaacagcaaagctaagtctagtaaaaatgtaagcggccacccgagcccccgcatcctgagataccgagaatttctgaatccgcttgagcaaggcaacagcatccgaacccaactccccaagagatgagaaagagaatggaagaaaaccataacccgctgccgcgcacaaatccccatacttagcacacttacgctgagcagcatcaacaacaacccggccaggcacaaaattcgccatcccagtctgggtcaaaggagaagacccggtcaagtcaacgcacacatcacg

SEQ ID NO: 858 - DNA, 378 bp, Silene latifolia
gatgcgcgcagctttcattaaaataaaagtaaaagtttacatgaaattggtggggagccgagagacaatctgggctcccacacccttagcaatagcaaagccaagcctagtgaaaatgtaagcggctacccgagcccccgcatcctgagataccgagaatttctggatccgcttgagcaaggcaacagcatccgaacccagctccccaagggaagagaaggagaaaggtaggaaaccataacccgctaaagcacacaaatccccatacttagcatactttcgctgagcagcatcagcgacaacccggcccgacacaaaatctgtcaacccagtctgagtcaaaggtgaagaacctgtcaagtcaacgcacacatcacg

SEQ ID NO: 859 - DNA, 378 bp, Silene latifolia
gatgcgcgcagctttcattaaaagagaaataaaagtttacatgaaattggtggggagccgagagacaatctgggctcccacacccttagcaacaacaaagctaagtctagtaaaaatgtaagcggccacccgagcccccgcatcctgagataccgagaatttctgaatccgcttgagcaaggcaacagcatccgaacccagctccccaagtgaagagaaagacaaaggaaggaaaccataacccgctatcgcgcacaaatccccatacttagcacactttcgttgagcagcatcagcgacaacccggccaggcacaaaattcgtcatcccagtctgagtcaaaggagaagaacctgtcaagtcaacgcacacatcacg

SEQ ID NO: 860 - DNA, 378 bp, Silene latifolia; identical to SEQ ID NO: 855

SEQ ID NO: 861 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaggaacctgtcaagtcaacgcacacatcacg

SEQ ID NO: 862 - DNA, 373 bp, Silene latifolia
gatgcgcgcagctttcattaaaagaaaaaataaaagtttacatgaaattggtggggagccgagagacaatctgggctcccacacctttagcaacagcaaagctaagtctagtaaaaatataagcagccacccgaacccccgcatcctgtgataccgagaatttctggatccgcttgagcaaggcaacaacatccgagcccagctccccaagtgaagagaagggaaggaaaccataaccagttgtcgcgcataaatccccgtacttaacacacttccgctgagcagcatcagcgacaacccggccgagcacaaaatccatcatcccagtctgagtcaaaggggaagaccctgtcaagtcaacgcacacatcacg

SEQ ID NO: 863 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgtaagcgaccacccgagcccccgcatcctgagataccgagaatttctggatccgcttgagcaaggcaaaagcatccgaacccaactccccaagtgatgagaaagagaatggaaggaaaccataacccgctgccgcgcacaaattcccatacttagcacacttccgctgagcagcatcagcaacaacccggccaggcacaaaattcgtcatcccagtctgagtcaaaggagaagacccggtcaagtcaacgcacacatcacg

SEQ ID NO: 864 - DNA, 378 bp, Silene latifolia
gatgcgcgcagctttcattaaaaggaaaataaaagtttacatgaaattggtggggagccgagagacaatctgagctcccacacccttagcaacagcaaagctaagtctagtaaaaatgtaagcggccaccctagcccccgcatcctaagatatcgagaatttctggatccgcttgagcaaggcaacagcatctgaacccagctccccaagtgaagagaaagagaaaggaaggaaaccataacccgctgccgcgcacaaatccccgtacttagcacacttacgctgagcagcatcagcgacaacccggccaggcacaaaatccgccatcccagtctgagtcaaaggggtagaccctgtcaagtcaacgcacacatcacg

SEQ ID NO: 865 - DNA, 378 bp, Silene latifolia
gatgcgcgcagctttcattaaaagagaaataaaagtttacatgaaattggtggggagccgagagacaatctgggctcccacacccttagcaacagcaaagctaagtctagtaaaaatgtaagcggccacccgagcccccatattctgagataccgagaatttctggatccgcttgagcaaagcaacagcatccgaactcaactccccgagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 866 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccacccgagcccccgcatcctgagataccgagaatttctgaacccgcttgagcaaggcaacagcatccgaacccagctccccaagtgaagagaaagacaaaggaaggaaaccataacccgctatcgcgcacaaatccccatacttagcacactttcgttgagcagcatcagcgacaacccggccaggcacaaaattcgtcatcccagtctgagtcaaaggagaagaacctgtcaagtcaacgcacacatcacg

SEQ ID NO: 867 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccacccgagcccccgcatcctgaggtaccgagaatttctgaatccgcttgagcaaggcaacagcatccgaacccagctccccaagtgaagagaaagacaaaggaaggaaaccataacccgctatcgcgcacaaatccccatacttagcacactttcgttgagcagcatcagcgacaacccggccaggcacaaaattcgtcatcccagtctgagtcaaaggagaagaacctgtcaagtcaacgcacacatcacg

SEQ ID NO: 868 - DNA, 378 bp, Silene latifolia
gatgcgcgcagctttcattaaaagaaaaataaaagtttacatgaaattggtggggagccgagagacaatctgggctcccatgcccttagcaatagcaaagctatgtctagtaaaaatgtaagcggccacccgagcccccgcatcctgagataccgagaatttctggatccgcttgagcaaggcaacagcatccgaacccagctccccaagtgaagagaaagagaaaggaaggaaaccataacccgctaccgcgcacaaatccccatacttagcacactttcgctgagcagcatcagcgacaacccggccaggcacaaaatccgtcatcccagtctgattcaaaggagaagaacctgtcaagtcaacgcacacatcacg

SEQ ID NO: 869 - DNA, 377 bp, Silene latifolia; identical to SEQ ID NO: 844

SEQ ID NO: 870 - DNA, 378 bp, Silene latifolia; identical to SEQ ID NO: 855

SEQ ID NO: 871 - DNA, 378 bp, Silene latifolia
gatgcgcgcagctttcattaaaataaaagtaaaagtttacatgaaattggtggggagccgagagacaatctgggctcccacacccttagcaatagcaaagctaagcctagtgaaaatgtaagcggctacccgagcccccgcatcctgagataccgagaatttctggatccgcttgagcaaggcaacagcatccgaacccagctccccaagggaagagaaggagaaaggtaggaaaccataacccgctaaagcacacaaacccccatacttagcatactttcgctgagcagcatcagcggcaacccggcccgacacaaaatctgtcaacccagtctgagtcaaaggtgaagaacctgtcaagtcaacgcacacatcacg

SEQ ID NO: 872 - DNA, 373 bp, Silene latifolia
gatgcgcgcagctttcattaaaagaaaaataaaagtttacatggaattggtggggagccgagagacaatctgggctcccacacccttagcaacagcaaagctaagtctagtaaatatgtaagcggccacccgagctcccgcatcctgagataccgagaatttttggatccgcttgagcaaggcaacagcatccgaacccagctccccaagcgaagagaaagagaaaggaaggaaaccataacccgctgccgcgcacaagtccccgtacttagcacacttacgctgagcagcatcagcgacaacccggccaggcacaaaatccgccatcccaggtcaaaggagaagactttgtcaagtcaacgcacacatcacg

SEQ ID NO: 873 - DNA, 379 bp, Silene latifolia; identical to SEQ ID NO: 847

SEQ ID NO: 874 - DNA, 379 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagatgccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgctaacccagtctgagtcaaaggtgaagaacctgtcaagtcaacgcacacatcacg

SEQ ID NO: 875 - DNA, 378 bp, Silene latifolia
gatgcgcgcagctttcattaaaagaaaaacagaagtttacatgaaattggtggggagccgagaaacaagctgggctcccacacccttagcaacagcaaagctaagtctagtaaaaatgtaagcggccacccgagcccctgcatcctgagaaaccgagaatttctggatccgctcgagcaaggcaacagcatccgaacccagctccccaagggaagagaaagagaaaagaaggaaaccataacccgctaccgcgcacaaatccccatacttagcacactttcgctgagcagcatcagcgacaacccggccaggcacaaaatccgtcatcccagtctgagtcaaaggagaagaacctgtcaagtcaacgcacacatcacg

SEQ ID NO: 876 - DNA, 378 bp, Silene latifolia
gatgcgcgcagctttcattaaaagaaaaataatagtttacatgaaattggtggggagccgagatacaatctgggctcccacacccttagcaatagcaaagctaagtctagtaaaaatgtaagcggccacccgagcccccgcatcctgagataccgagaatttctggatccgcttgagtaaggcaacaacatccgaacccagctccccaagtgaagagaaagagaaaggaaggaaaccgtaatccgccaccgcgcacaaatccccatacttagcacactttcgctgagcagcatcagcgacaacctggccaggcacaaaatccgtcatcccagtctgagtcaaaggagaagaacctgtcaagtcaacgcacacatcacg

SEQ ID NO: 877 - DNA, 391 bp, Silene latifolia
gatgcgcgcagctttcattataataaaaataaaaggtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagcgaagagaaagagaaagagaaagagaaaggtaggaaaccataacccgctaccgcgcacaaatccccatacttagcacactttcgctgagcagcatcagcgacaacccggcccggcacaaaatctgccaacccagtctgagacaaaggtgaagaacctgtcaagtcaacgcacacatcacg

SEQ ID NO: 878 - DNA, 378 bp, Silene latifolia
gatgcgcgcagctttcattaaaaggaaaataaaagtttacatgaaattggtggggagctgaaagacaatctgggctcccacacccttagcaacagcaaagctaagtctagtaaaaatgtaagcagccacccgagcctccgtatcctgagataccgagaatttctggatctgcttgaggaaggcaacaacatccgaacccgactccccaagggaagagaaagagaaaggaaggaaaccataacccgctgtcgcgcacaaatccccgtacttagcacacttacgctgagcagcatcagcgacaacccgaccagacacaaaatccgtcatcccagtctgagtcaaaggagaagaccctgtcaagtcaacgcacacatcacg

SEQ ID NO: 879 - DNA, 377 bp, Silene latifolia
gatgcgcgcagctttcattaatagaaaaacaaaagcttacatgaaattggtggggagccgagagacaagctgggctccacatccttagcaacagcaaagctaagtctagtgaaaatgtaagcggccacccgagcccccgcatcctgagataccgagaatttctagatccgcttgagcaaggcaacagcatccgaacccaactccccaagtgatgagaaagagaaaggaaggaaaccataacccgctgcagcacacaaatccccgtacttagcacacttacgctgagcagcatcagcaacaatccggccagatacaaaatccgtcatcccagtctgagtcaaaggagaagacccggtcaagtcaacgcacacatcacg

SEQ ID NO: 880 - DNA, 378 bp, Silene latifolia
gatgcgcgcagctttcattaaaagaaaaacaaaagtttatatgaaattggtggggagccgagaaacaagctgggctcccacacccttagcaacagcgaagctaagtctagtaaaaatgtaagcggccacccgagcccccgcatcctgagataccgagaatttctggatccgcttgagcaaggcaatagcatccgaacccaactccccaagtgatgagaaagagaaaggaaggaaaccataacccgctgccgagcatagatccccatacttagcacacttacgctgagcagcatcagcaacaacccggccaggcacaaaattcgtcatcccagtctgagtcaaaggagaagacccggtcaagtcaacgcacacatcacg

SEQ ID NO: 881 - DNA, 378 bp, Silene latifolia
gatgcgcgcagctttcattaaaagaaaaacagaagtttacatgaaattggtggggagccgagaaacaacctgggctcccacacccttagcaatagcaaagataagtctagtaaaaatgtaagcggctacccgagcccccgcatcctaagatacaaagaatttctggatccgcttgagcaaggcaacaacatccgaacccagctccccaactgaagagaaagagaaaggtaggaaaccataacccgctaccgcgcacaaatccccatacttagcacactttcgctgagcagcatcagcgacaacccggcccggcataaaatctgccaacccagtctgagtcaaaggtgaagaacctgtcaagtcaacgcacacatcacg

SEQ ID NO: 882 - DNA, 377 bp, Silene latifolia
gatgcgcgcagctttcattaaaagaaaaataaaagtttacatgaaattggtggggagccgagagacaatctgggctcccatgcccttagcaatagcaaagctatgtctagtaaaaatgtaagcggccacccgagcccccgcatcctgagataccgagaatttctggatccgcttgagcaaggcaacagcatccgaacccagctccccaagtgaagagaaagagaaaggaaggaaaccataacccgctaccgcgcacaaatccccatacttagcacactttcgctgagcagcatcagcgacaacccggccaggcacaaaatccgtcatcccagtctgattcgaggagaagagcctgtcaagtcaacgcacacatcacg

SEQ ID NO: 883 - DNA, 378 bp, Silene latifolia
gatgcgcgcagctttcattaaaagaaaaataaaagtttacatgaaattggtggggagccgagagacaatctgggctcccatgcccttagcaatagcaaagctatgtctagtaaaaatgtaagcggccacccgagcccccgcatcctgagataccgagaatttctggatccgcttgagtaaggcaacagcatccgaacccagctccccaagtgaagagaaagagaaaggaaggaaaccataacccgctaccgcgcacaaatccccatacttagcacactttcgctgagcagcatcagcgacaacccggccaggcacaaaatccgtcatcccagtctgattcaaaggagaagaacctgtcaagtcaacgcacacatcacg

SEQ ID NO: 884 - DNA, 366 bp, Silene latifolia
gatgcgcgcagctttcattaatagaaaaacaaaagtttacatgaaattgatggggggccgaaaaacaagctgggctcccacaccaaagctaagtctagtaaaaatgtaagcggccacccgagcccccgcatcctgagataccgagaatttctggatccgcttgagcaaggcaacagcatccgaacccagctccccaagtgatgagaaagagaagggaaggaaaccataacccgctgccgcgcacaaatccccgtacttagcacacttacgctgagcagcatcagcaacaacccggccaggcacaaaatccgtcatcccagtctgagtcaaaggagaagaccctgtcaagtcaacgcacacatcacg

SEQ ID NO: 885 - DNA, 378 bp, Silene latifolia
gatgcgcgcagctttcattaaaagaaaaacagaagtttacatgaaattggtggggagccgagaaacaagctgggctcccacacccttagcaacagcaaagctaagtctagtaaaaatgtaagcggccacccgagcccctgcatcctgagaaaccgagaatttctggatccgcttgagcaaggcaacagcatccgaacccagctccccaagggaagagaaagagaaaagaaggaaaccataacccgctaccgcgcacaaatccccatacttagcacactttcgctgagcagcatcagcgacaacccggccaggcacaaaatccgtcatcccagtctgagtcaaaggagaagaacctgccaagtcaacgcacacatcacg

SEQ ID NO: 886 - DNA, 378 bp, Silene latifolia
gatgcgcgcagctttcattaaaataaaaataaaagtttacacgaaattggtggggagccgagagacaatctgggctcccacacccttagcaatagcaaagctaagtctagtaaaaatgtaagcggccacccgagcccccacatcctgagataccgagaatttctggatccgcttgagcaaggcaacagcatccgaacccagctccccaagtgaagagaaagagaaaggaaggaaaccataacccgctaccgcgcacaaatcctcatatttagcacactttcaatgagcagcatcagcgacaacccggccaggcacaaaatccgtcatcccagtctgagtcaaaggtgaagaacctgtcaagtcaacgcacacatcacg

SEQ ID NO: 887 - DNA, 377 bp, Silene latifolia
gatgcgcgcagctttcattaagagaaaaatatcagattacatgaaattggtgggaggccgagagacaatctaggctcccacacccttagcaacagcaaagctaagtctagtgaaaatataagcggccaccagagccccgcatcctgagataccgagaatttctggatccgcttgagcaagacaacagcatccgaactcagctccccaagtaaagagaaagagaagggtaggaaactataaccagctgtcgcgcataaatccccatacttagcacacttacgctgagcagcatcagtgacaacccgaccgagcacaaaatccagcatcgcagtttgagtcaaaggagaagaccctgtcaagtcaacgcacacatcacg

SEQ ID NO: 888 - DNA, 378 bp, Silene latifolia; identical to SEQ ID NO: 654

SEQ ID NO: 889 - DNA, 378 bp, Silene latifolia
gatgcgcgcagctttcattaaaagaagaataaaagtttacatgaaattggtggggagccgagagacaatctgggctcccacgcccttagcaacagcaaagctaagtctagtaaaaatgtaagcggccacccgagcccccgcatcctgagataccgagaatttctggatccgcttgagcaaggcagcaacatccgaacccagctgcccaagtgaagagaaagagaaaggaaggaaaccataacccgctgccgcgcacaaatccccatacttagcacactttcgctgagcagcatcagcgacaacccggtcaggcacaaaatccgtcatcccagtctgagtcaaaggagaagaacctgtcaagtcaacgcacacatcacg

SEQ ID NO: 890 - DNA, 378 bp, Silene latifolia
gatgcgcgcagctttcattaaaagaaaaacagaagtttacatgaaattggtggggagccgagaaacaagctgggctctcacacccttagcaacagcaaagctaagtctagtaaaaatgtaagcggccacccgagcccctgcatcctgagaaaccgagaatttctggatccgcttgagcaaggcaacagcatccgaacccagctccccaagggaagagaaagagaaaagaaggaaaccataacccgctaccgcgcacaaatccccatacttagcacactttcgctgagcagcatcagcgacaacccggccaggcacaaaatccgtcatcccagtctgagtcaaaggagaagaacctgtcaagtcaacgcacacatcacg

SEQ ID NO: 891 - DNA, 378 bp, Silene latifolia; identical to SEQ ID NO: 820

SEQ ID NO: 892 - DNA, 378 bp, Silene latifolia
gatgcgcgcagctttcattaaaataaaataaaaggtttacatgaaattggtggggagccgagagacaatctgggctcccacacccttagcaatagcaaagctaagtctagtaaaaatgtaagcggctacccgagcccccgcatcctgagataccgagaattcctggatccgcttgagcaaggcaacagtatccgatcccagctccccaagtgaagagaaagagaaaggtaggaaaccataacccgctaccgcgcacaaatccccatacttagcacactttcgttgagcagcatcagcgacaacccggcccggcacaaaatctgccaacccagtctgagtcaaaggtgaagaacctgtcaagtcaacgcacacatcacg

SEQ ID NO: 893 - DNA, 378 bp, Silene latifolia
gatgcgcgcagctttcattaaaaggaaaataaaagtttacatgaaattggtggggagctgaaagacaatctgggctcccacacccttagcaacagcaaagctaagtctagtaaaaatgtaagcagccacccgagcctccgtatcctgagataccgagaatttctggatctgcttgaggaaggcaacaacatccgaacccaactccccaagggaagagaaagagaaaggaaggaaaccataacccgctgtcgcgcacaaatccccgtacttagcacacttacgctgagcagcatcagcgacaacccgaccagacacaaaatccgtcatcccagtctgagtcaaaggagaagaccctgtcaagtcaacgcacacatcacg

SEQ ID NO: 894 - DNA, 378 bp, Silene latifolia; identical to SEQ ID NO: 654

SEQ ID NO: 895 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgtaagcggccacccgagcccccgcatcctgagataccgagaatttccggatccgcttgagcaaggcaacagcatccgaacccaactccccaagtgatgagaaagagaatggaagaaaaccataacccgctgccgcgcacaaatccccatacttagcacatttacgctgagcagcatcagcaacaacccggccaggcacaaaattcgtcatccaagtatgagtcaaaggagaagacccggtcaagtcaacgcacacatcacg

SEQ ID NO: 896 - DNA, 379 bp, Silene latifolia
gatgcgcgcagctttcattataataaaaacaaaatgtttacatgaaattggtggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaaccataacccgctaccgcgcacaaatccccatacttagcacacttccgctgagcagcatcagcgacaacccggcccggcacaaaatctgccaacccagtctgagtcaaaggtgaagaacccgtcaagtcaacgcacacatcacg

SEQ ID NO: 897 - DNA, 378 bp, Silene latifolia
gatgcgcgcagctttcattaaaacaaaggtaaaagtttacatgaaattggtgaggagccgagagacaatctgggctcccacacccttagcaatagcaaaactaagcctagtaaaaatgtaagcggctatccgagcccccgtatcctgagataccgagaatttctggatccgcttgaacaaggcaacaacatccgaacccagctccccaagggaagagaaagagaaaggtaggaaaccataacccgctaccgcgcacaaatccccatacttagcacactttcgctgagcagcatcagcgacaacccggcccgacacaaaatctgtcaacccagtctgagtcaaaggtgaagaacctgtcaagtcaacgcacacatcacg

SEQ ID NO: 898 - DNA, 377 bp, Silene latifolia
gatgcgcgcagctttcattaagagaaaaatatcagattacatgaaattggtgggaggccgagagacaatctaggctcccacacccttagcaacagcaaagctaagtctagtgaaaatataagcggccaccagagccccgcatcctgagataccgagaatttctggatccgcttgagcaagacaacagcatccgaactcagctccccaagtaaagagaaagagaagggtagggaaccataacccgctaccgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 899 - DNA, 377 bp, Silene latifolia
gatgcgcgcagctttcattaattaaaaaacaaaagtttacatgaaattggtggggagccgaggaacaagctgggctcccacacccttagcaacagcaaagcttaatctagtaaaaatgtaagcggccacccgagcccccgcatcctgagatactgagaatttctggatccgcttgagcaaggcaacagcatccgaacccaactccccaagtgatgagaaagagaatggaaggaaaccataacccgctgccgcacacaaatccccatacttagcacacttacgctgagtagcatcagcaacaacccgaccaggcacaaaattcgcatcccagtctgagtcaaaggagaagacccggtcaagtcaacgcacacatcacg

SEQ ID NO: 900 - DNA, 377 bp, Silene latifolia
gatgcgcgcagctttcattaatagaaaaacaaaagcttacatgaaattggtggggagccgagaaacaagctgggctccacatccttagcaacagcaaagctaagtctagtgaaaatgtaagcggccacccgagcccccgcatcctgagataccgagaatttctagatccgcttgagcaaggcaacagcatccgaacccaactccccaagtgatgagaaagagaaaggaaggaaaccataacccgctgcagcacacaaatccccgtacttagcacacttacgctgagcagcatcagcaacaatccggccaggtacaaaatccgtcatcccagtctgagtcaaaggagaagacccggtcaagtcaacgcacacatcacg

SEQ ID NO: 901 - DNA, 379 bp, Silene latifolia
gatgcgcgcagctttcattaaaattaaaataaaaggtttacatgaaattggtggggagccgagagacaatctgggctcccacacccttagcaatagcaaagctaagtctagtaaaaatgtaagcggctacccgagcccccgcatcctgagataccgagaatttctggatcggcttgagcaaggcaacagcatccgaacccagctcccccagtgaagagaaagagaaaggtaggaaaccataacccgctaccgcgcacaaatccccatacttagcacactttcgctgagcagcatcagcaacaacccggcccggcacaaaatttgccaacccagtctgagtcaaaggtgaagaacctgtcaagtcaacgcacacatcacg

SEQ ID NO: 902 - DNA, 378 bp, Silene latifolia
gatgcgcgcagctttcattaaatgaaaaacaaaaggttacatgaaattgggggggagccgagaaacaagctgggctcccacacccttagcaacagcaaagctaagtctagtaaaaatgtaagcggccacccgagcccccgcatcctgagataccgagaatttccggatccgcttgagcaaggcaacagcatccgaacccaactccccaagtgatgagaaagagaatggaagaaaaccataacccgctgccgcgcacaaatccccatacttagcacatttacgctgagcagcatcagcaacaacccggccaggcacaaaattcgtcatccaagtatgagtcaaaggagaagacccggtcaagtcaacgcacacatcacg

SEQ ID NO: 903 - DNA, 378 bp, Silene latifolia
gatgcgcgcagctttcattaaaacgaaaataaaaatttacatgaaattggtggggagccgagagacaatctgggctcccacacccttagcaacagcaaagctaagtctagaaaaaatgtaagcggccacccgagtccccgcatcctgagataccgagaatttctggatccgcttgagcaaggcaacagcatccgaacccagctccccaagtgaagagaaagggaaaggaaggaaaccataacccgctgtcgcgcacaaatccccgtacttagcacacttacgctgagcagcatcagcgacaacccggccaggcacaaaatccgtcatcccagtctgagtcaaaggagaagatcatgtcaagtcaacgcacacatcacg

SEQ ID NO: 904 - DNA, 378 bp, Silene latifolia; identical to SEQ ID NO: 876

SEQ ID NO: 905 - DNA, 375 bp, Silene latifolia
gatgcgcgcagctttcattaaaagaaaaataaaagtttacatgaaattcggtggggagccgagatacaatctgggctcccacacccttagaaatagcaaagctaagtctagtaaaaatgtaagcggccacccgagcccccgcatcctgagataccgagaatttatggatccgcttgagcaaggcaacagcatccgaacccagctccccaagcgaagagaaacagaaaggaaggaaaccgtaacccgtcaccgcgcacaaatccccatacttagcacactttcgctgagccagcgacaacccggccaggcacaaaatccgccatccgagtctgagtcaaaggggaagaacctctctaagtcaacgcacacatcacg

SEQ ID NO: 906 - DNA, 374 bp, Silene latifolia
gatgcgcgcagctttcattaaaagaaaaataaaagtttacatgaaattggtggggagccgagatacaatctgggctcccacacccttagaaatagcaaagctaagtctagtaaaaatgtaagcggccacccgagcccccgcatcctgagataccgagaatttatggatccgcttgagcaaggcaacagcatccgaacccagctccccaagcgaagagaaacagaaaggaaggaaaccgtaacccgtcaccgcgcacaaatccccatacttagcacactttcgctgagccagcgacaacccggccaggcacaaaatccgccatccgagtctgagtcaaaggagaagaacctctctaagtcaacgcacacatcacg

SEQ ID NO: 907 - DNA, 375 bp, Silene latifolia
gatgcgcgcagctttcattaaagaaaaataaaagtttacatgaaattggtggggagccgagagacaatctgggctcccacacccttagcaacaacaaagctaagtctagtaaaaatgtaagcggtcaccctagcccccgcatccttagataccgagaatttctggatccgcttgagcaaggcaacagcatccgaacccagctccccaagtgaagagagagaaaggaaggaaaccataactcgctgccgcgcacaaatccccgtacttagtacacttacgctgagcagcatcagcgacagcccggccaggcacaaaatccgtcatcctagtctgagtcaaaggagaagaccctgtcaagtcaacgcacacatcacg

SEQ ID NO: 908 - DNA, 377 bp, Silene latifolia
gatgcgcgcagctttcattaatagaaaaacaaaagcttacatgaaattggtggggagccgagaaacaagctgggctccacagccttagcaacagcaaagctaagtctagtgaaaatgtaagcggccacccgagcccccgcatcctgagataccgagaatttctagatccgcttgagcaaggcaacagcatccgaacccaactccccaagtgatgagaaagagaaaggaaggaaaccataacccgctgcagcacacaaatccccgtacttagcacacttacgctgagcagcatcagcaacaatccggccagatacaaaatccgtcatcccagtctgagtcaaaggagaagacccggtcaagtcaacgcacacatcacg

SEQ ID NO: 909 - DNA, 378 bp, Silene latifolia
gatgcgcgcagctttcattaaaagaaaaataaaagtttacataaaattggtggggagccgagagacaatctgggctcccacacccttagcaacagcaaagctaagtctaataaaaatgtaagcagccacccgagcccccgcatcctgagataccgagaatttctggatccgcttgagcaaggcaacaacatccgaacccagctccccaagtgaagacaaagagaagggaaggaaaccataacccgctgccgcgcacaaatccccgtacttagcacacttacgctaagcagcatcagcgacaacccggccaggcacaaaatccgccatcccagtctgagtcaaaggagaagaccctgtcaagtcaacgcacacatcacg

SEQ ID NO: 910 - DNA, 378 bp, Silene latifolia
gatgcgcgcagctttcattaaaataaaaataaaagtttacatgaaattggtggggagctgagagacaatctgggctcccacacccttagcaatagcaaagctaagtctagtagaaatgtaagcggccacccgagcccccacatcctgagataccgagaatttctggatccgcttgagcaaggcaacaacatccgaacccagctccccaagggaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 911 - DNA, 378 bp, Silene latifolia
gatgcgcgcagctttcattaaatgaaaaacaaaagttcacatgaaattggtggggagccgagaaacaagctgggctcccacacccttagcaacagcaaagctaagtctagtaaaaatgtaagcggccacccgagtcctcgcatcctgagatacagagaatttctggatccgcttgagtaaggcaacagcatccgaacccaactccccaagtgaagagaaagagaaaggaaggaaaccataacccgttgccgcgcacaaatcaccatacttagcacactttcgctgagcagcatcagcaacaacccggccaggcacaaaattcgtcatcccagtctgagtcaaaggagaagacccggtcaagtcaacgcacacatcacg

SEQ ID NO: 912 - DNA, 374 bp, Silene latifolia
gatgcgcgcagctttcattaaaagaaaaataaaagtttacatgaaattggtggggagccgagatacaatctgggctcccacacccttagaaatagcaaagctaagtctagtaaaaatgtaagcggccacccgagcccccgcatcctgagataccgagaatttatggatccgcttgagcaaggcaacagcacccgaacccagctccccaagcgaagagaaacagaaaggaaggaagccgtaacccgtcaccgcgcacaaatccccatacttagcacactttcgctgagccagcgacaacccggccaggcacaaaatccgccatccgagtctgagtcaaaggagaagaacctctctaagtcaacgcacacatcacg

SEQ ID NO: 913 - DNA, 378 bp, Silene latifolia
gatgcgcgcagctttcattaaaagaaaaacaaaagtttacatgaaattggtggggagccgagaaacaagctgggctcccacacccttagcaacagcaaagctaagtctagtaaaaatgtaagcggccacccgagcccccgcatcctgagataccgagaatttctggatccgcttgagcaaggccacagcatccgaacccaactccccaagtgatgagaaagagaaaggaaggaaaccataacccgctgccacacacaaatccccatacttagcacacttccgctgagcagcatcagcaacaacccggccaggcgcaaaattcgtcatcccagtctgagtcaaaggagaggacccggtcaagtcaacgcacacatcacg

SEQ ID NO: 914 - DNA, 379 bp, Silene latifolia
gatgcgcgcagctttcattataataaaaataaaatgtttacatgaaattggcggggagccgagagacaatctgggctcccacacccttagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacccgtcaagtcaacgcacacatcacg

SEQ ID NO: 915 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccactcgagccaccgcatcgtgagataccgagaatttctggatccgcttgagcaaagcaacaacatccgaacccaactcctcaagtgaggagaacgagaagggaatgaaaccataaccagctgccgcacacaaacccccgtacttagcacacttacgctgagcagcatcagcgacaactctgctgggcacaaaatccatcatcccagtctaagtcaaaggagaagaccctgtcaagtcaacgcacacatcacg

SEQ ID NO: 916 - DNA, 378 bp, Silene latifolia
gatgcgcgcagctttcattaaaagaaaaacaaaagtttacatgaaattggtggggagccgagaaacaagctgggctcccacacccttagcaacagcaaagctaagtctagtaaaaatgtaagcggccacccgagcccccgcatcctgagataccgagaatttctggatccgcttgagcaaggccacagcatccgaacccaactccccaagtgatgagaaagagaaaggaaggaaaccataacccgctgccacacacaaatccccatacttagcacacttccgctgagcagcatcagcaacaacccggccaggcacaaaattcgtcatcccagtctgagtcaaaggagaggacccggtcaagtcaacgcacacatcacg

SEQ ID NO: 917 - DNA, 374 bp, Silene latifolia; identical to SEQ ID NO: 906

SEQ ID NO: 918 - DNA, 374 bp, Silene latifolia; identical to SEQ ID NO: 906

SEQ ID NO: 919 - DNA, 381 bp, Silene latifolia
gatgcgcgcagctttcattaaaagaaaattaaaaaagtttacatgaaaattggtggggagccgagagacaatctgggctcccacacccttagcaacaacaaaactaagtctggtgaaaatataagcggctacccgagcccccgcatcctgagatacagagaatttatggatctgcttgagcaaggcaacaacatccgaacccagctccccaagtgaagagaaagagaagggaaggaaaccataacccgctgtcgcgcacaaatctctatacttagcacactttcgctgagtagcatcagcgacaacccggctaggcacaaaatccgccatcccagtctgagtcaaaggagaggaccctgtcaagtcaacgcacacatcacg

SEQ ID NO: 920 - DNA, 338 bp, Silene latifolia
gatgcgcgcagctttcattaaaagaaaaatgaaagtttacatgaaattggtgggaagccgagagacaatctgggctcccacacccttagcaacagcaaagctaagtctattaaaaatgtaagcggccacccgagcccccgcatcctgagataccgagaatttctggatccgcttgagcaagtcaacagcatccgaacccagttccccaagtgaagagaaagagaaaggaaggaaatcataacccgctgtcgcgcacaaatcccccggccaggcacaaaatccgtcataccagtctgagtcaaaagagaagaacatgtcaagtcaacgcacacatcacg

SEQ ID NO: 921 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgtaagcggccacccgagtcctcgcatcctgagatacagagaatttctggatccgcttgagtaaggcaacagcatccgaacccaactccccaagtgaagagaaagagaaaggaaggaaaccataacccgttgccgcgcacaaatcgccatacttagcacactttcgctgagcagcatcagcaacaacccggccaggcacaaaattcgtcatcccagtctgagtcaaaggagaagacccggtcaagtcaacgcacacatcacg

SEQ ID NO: 922 - DNA, 378 bp, Silene latifolia
gatgcgcgcagctttcattaaaagaaaaataaaagtttagatgaaattggtggggagccgagaaacaagctgggctcccacacccttagcaacaacaaagctaagtctagtaaaaatgtaagcggccacccgagatcccgcatcctgagataccgagaatttatggatccgcttgagcaaggcaacaacatccgaacccagctccccaagtgatgagaaagagaagggaaagaaaccataacccgttgccgcgcacaaatccccgtacttagcacacttacgctgaggagcatcagcaacaacccggccaggcacaaaatctgtcatcccagtctgagtcaaaggagaagaccctgtcaagtcaacgcacacatcacg

SEQ ID NO: 923 - DNA, 378 bp, Silene latifolia
gatgcgcgcagctttcattaaaagaaaaacaaaagtttacatgaaattggtggggaaccgagaaacaagctgggcccccacacccttagcaacagcaaagctaagtctagtaaaaatgtaagcggccacccgagcccccgcatcctgagataccgagaatttctggatccgcttgagcaaggcaacagcatccgaacccaactccccaagtgatgagaaagagaatggaaggaaaccataacctgttgccgcgcacaaatccccatacttagcacacttccgcagagcagcatcaacaacaacccggccagacacaaaattcgtcatcccagtctgagtcaaaggagaagacccggtcaagtcaacgcacacatcacg

SEQ ID NO: 924 - DNA, 378 bp, Silene latifolia
gatgcgcgcagctttcattaaaataaaaataaaagtttacatgaaattggtggggagccgagagacaatctgggctcccacacccttagcaatagcaaagctaagtctagtaaaaatgtaagcggccacccgagcccccgcatcctgagataccgagaatttctggatccgcttgagcaaggcaacagcatccgaacccagctccccaagtgaagagaaagagaaaggtaggaaaccataacccgctaccgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 925 - DNA, 338 bp, Silene latifolia
gatgcgcgcagctttcattaaaaaaaaaataaaagtttacatgaaattggtgggaagccgagagacaatctgggctcccacacccttagcaacagcaaggctaagtctattaaaaatgtaagcggccacccgagcccccgcatcctgagataccgagaatttctggatccgcttgagcaagtcaacagcatccgaacccagttccccaagtgaagagaaagagaaaggaaggaaatcataacccgctgtcgcgcacaaatcccccggccaggcacaaaatccgtcataccagtctgagtcaaaagagaagaacatgtcaagtcaacgcacacatcacg

SEQ ID NO: 926 - DNA, 379 bp, Silene latifolia
gatgcgcgcagctttcattaaaagaaaaataaaagtttacataaaattcggtggggagccgagagacaatctgggctcccacacccttagcaacagcaaagctaagtctaataaaaatgtaagcagccacccgagcccccgcatcctgagataccgagaatttctggatccgcttgagcaaggcaacaacatccgaacccagctccccaagtgaagacaaagagaagggaaggaaaccataacccgctgccgcgcacaaatccccgtacttagcacacttacgctaagcagcatcagcgacaacccggccaggcacaaaatccgccatcccagtctgagtcaaaggagaagaccctgtcaagtcaacgcacacatcacg

SEQ ID NO: 927 - DNA, 378 bp, Silene latifolia
gatgcgcgcagctttcattaaaagaaaaacaaaagtttacatgaaattggtggggagccgagaagcaagctgggctcccacacccttagcaacagcaaagctaagtctagtaaaaatgtaagcggccacccgaacccccgcatcctgagataccgagaatttctggatccgcatgagcaaggccacagcatccgaacccaactccccaagtgatgagaaagagaaaggaaggaaaccataacccgctgccacacacaaatccccatacttagcacacttccgctgagcagcatcagcaacaactcgaccaggcacaaaattcgtcatcccagtctgagtcaaaggagaggacccggtcaagtcaacgcacacatcacg

SEQ ID NO: 928 - DNA, 378 bp, Silene latifolia; identical to SEQ ID NO: 916

SEQ ID NO: 929 - DNA, 378 bp, Silene latifolia; identical to SEQ ID NO: 916

SEQ ID NO: 930 - DNA, 374 bp, Silene latifolia
gatgcgcgcagctttcattaaaagaaaaataaaagtttacatgaaattggtggggagccgagatacaatctgggctcccacacccttagaaatagcaaagctaagtctagtaaaaatgtaagcggccacccgagcccccgcatcctgagataccgagaatttatggatccgcttgagcaaggcaacagcatccgaacccagctccccaggcgaagagaaacagaaaggaaggaaaccgtaacccgtcaccgcgcacaaatccccatacttagcacactttcgctgagccagcgacaacccggccaggcacaaaatccgccatccgagtctgagtcaaaggagaagaacctctctaagtcaacgcacacatcacg

SEQ ID NO: 931 - DNA, 359 bp, Silene latifolia
gatgcgcgcagctttcattaaaagaaaaaaaataaaagtttacatgaaattggtgggaagccgagagacaatctgggccctcacacccttagcaacagcaaagctaagtctagtaaaagtataagcggccaaatacggagaatttctggatccgtttgagcaaaacaacagcatccgaacccaactcccctagtgaagagaaagaagggaagaaaaccataaccagttgccgcgcataaatccccgtacttagaacacttacgctgagcagcatcagcgacaacccgaccgggcacaaactccatcatcccagtctgagtcaaaggagaagaccatgtcaagtcaacgcacacatcacg

SEQ ID NO: 932 - DNA, 374 bp, Silene latifolia; identical to SEQ ID NO: 906

SEQ ID NO: 933 - DNA, 374 bp, Silene latifolia; identical to SEQ ID NO: 906

SEQ ID NO: 934 - DNA, 377 bp, Silene latifolia
gatgcgcgcagctttcattaaatgaaaaataaaagtttacatgaaattgttggggagttgagagacaatctgggctcccacacccttagcaacaacaaggctaagtctagtaaaaatgtaagcggccacccgagccctcgcatcctgagataccgagaatttctggatccgcttgagcaaggcaacagtatccgaacccagctccccaagtgatgagaaagagaagggaagaaaaccataacccgctgccgcgcacaaatccccatacttgcatacttacgctgagcagcatcggcaacaacccggccaggcacaaattccgtcatcccagtctgagtcaaaggataaaaccctgtcaagtcaacgcacacatcacg

SEQ ID NO: 935 - DNA, 379 bp, Silene latifolia
gatgcgcgcagctttcattataataaaaacaaaatgtttacatgaaattggtggggagccgagagacaatctgggctcccacacccctagcaatagtaaagctaatacgagtaaaaatgtaagcggctacccgagccccagcatcctgagataccgagaatttctggatccgcttgagcaaggcaacagcatccgaactcaactccccgagtgaagagaaagagaaaggtaggaaatcataacccgctaccgcgcacaaatccccatacttagcacactttcgctgagcagcatcagcgacaacccggcccggcacaaaatctaccaacccagtctgagtcaaaggtgaagaacccgtcaagtcaacgcacacatcacg

SEQ ID NO: 936 - DNA, 378 bp, Silene latifolia; identical to SEQ ID NO: 909

SEQ ID NO: 937 - DNA, 377 bp, Silene latifolia
gatgcgcgcagcttttcattaaaagaaaaataaaagtttacattgaaatttggtggggagccgagatacaatctgggctcccacacccttagaaatagcaaagctaagtctagtaaaaatgtaagcggccacccgagcccccgcatcctgagataccgagaatttatggatccgcttgagcaaggcaacagcatccgaacccagctccccaagcgaagagaaacggaaaggaaggaaaccgtaacccgtcaccgcgcacaaatccccatacttagcacactttcgctgagccagcgacaacccggccaggcacaaaatccgccatccgagtctgagtcaaaggagaagaacctctctaagtcaacgcacacatcacg

SEQ ID NO: 938 - DNA, 381 bp, Silene latifolia
gatgcgcgcagctttcattataataaaaacaaaatagtttacatgaaattaggtggggagccgagagacaatctgggctcccacacccttagcaatagtaaagctaatacgagtaaaaatgtaagcggctacccgagccccagcatcctgagataccgagaacttctggatccgcttgagcaaggcaacagcatccgaactcaactccccgagtgaagagaaagagaaaggtaggaaatcataacccgctaccgcgcacaaatccccatacttagcacactttcgctgagcagcatcagcgacaacccggcccggcacaaaatctaccaacccagtctgagtcaaaggtgaagaacccgtcaagtcaacgcacacatcacg

SEQ ID NO: 939 - DNA, 378 bp, Silene latifolia
gatgcgcgcagctttcattaaaataaaaataaaagtttacatgaaattggtggggagccgagatacaatctggactcccacacccttagcaatagcaaagctaagtctagtaaaaatgtaagcggccacccgagcccccgcatcctgagataccaagaatttctggatccgcttgagcaaggcaacagcatccgaacccagctccccaagtgaagagaaagagaaaggaaggaaaccgtaacccgccaccgcgcacaaatccccatacttagcacactttcgctgagcagcatcaacgacaacccggccaggcacaaaatccgccattccactctgagtcaaaggagaagaacctgtcaagtcaacgcacacatcacg

SEQ ID NO: 940 - DNA, 374 bp, Silene latifolia
gatgcgcgcagctttcattaaaagaaaaataaaagtttacatcgaaattggtggggagccgagagacaatctgggctcccacacccttagcaacagcaaagctaagtctagtaaatatgtaagcggccacccgagctcccgcatcctgagataccgagaatttttggatccgcttgagcaaggcaacagcatccgaacccagctccccaagtgaagagaaagagaaaggaaggaaaccataacccgctgccgcgcacaagtccccgtacttagcacacttacgctgagcagcatcagcgacaacccggccaggcacaaaatccgccatcccaggtcaaaggagaagactttgtcaagtcaacgcacacatcacg

SEQ ID NO: 941 - DNA, 374 bp, Silene latifolia; identical to SEQ ID NO: 906

SEQ ID NO: 942 - DNA, 378 bp, Silene latifolia; identical to SEQ ID NO: 922

SEQ ID NO: 943 - DNA, 378 bp, Silene latifolia
gatgcgcgcagctttcattaaaagaaaaataaaagtttacatgaaattggtggggagccaagaaacaatctgggctcccacacccttagcaacagtaaagctaagtctagtaaaaatgtaagcggccacctgtgcccccgcatcctgatataccgagaatttctggatccgcttgagcaaggcaacatcatccgaacccagctccccaagtgatgagaaagagaagggtaggaaaccataacccgctgccgcgcacaaatcctcgtacttagcacacttacgctgagcagcatcagcaacaactcggccaggcacaaaatccgtcatcccagtttgagtcaggggagaagaccctgtcaagtcaacgcacacatcacg

SEQ ID NO: 944 - DNA, 376 bp, Silene latifolia
gatgcgcgcagctttcattaagaggaaaatatcagattacatgaaattggtgggaggccgagagacaatctaggctcccacacccttagcaacagcaaagctaagtctagtgaaaatataagcggccaccagggccccgcatcctgagataccgagaatttctggatccgcttgagcaagacaacaacatccgaactcagctccccaagtaaagagaaagagaagggtaggaaactataaccagctgtcgcgcataaatccccatacttagcacacttacgctgagcagcatcagtgacaacccgacgagcacaaaatccagcatcgcagtttgagtcaaaggagaagaccctgtcaagtcaacgcacacatcacg

SEQ ID NO: 945 - DNA, 378 bp, Silene latifolia
gatgcgcgcagctttcattaaaagaaaaataaaagtttacatgaaattggtgtggagccgagagacaatctgggctcccacacccttagcaacaacaaagctaagtctagtaaaaatgtaagcggccactcgagccaccgcatcgtgagataccgagaatttctggatccgcttgagcaaagcaacaacacccgaacccaactcctcaagtgaggagaacgagaagggaatgaaaccataaccagctgccgcacacaaatccccgtacttagcacacttacgctgagcagcatcagcgacaactctgctgggcacaaaatccatcatcccagtctaagtcaaaggagaagaccctgtcaagtcaacgcacacatcacg

SEQ ID NO: 946 - DNA, 378 bp, Silene latifolia; identical to SEQ ID NO: 654

SEQ ID NO: 947 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccactcgagccaccgcatcgtgagataccgagaatttctggatccgcttgagcaaagcaacaacatccgaacccaactcctcaagtgaggagaacgagaagggaatgaaaccataaccagctgccgcacacaaatccccgtacttagcacacttacgctgagcagcatcagcgacgactctgctgggcacaaaatccatcatcccagtctaagtcaaaggagaagaccctgtcaagtcaacgcacacatcacg

SEQ ID NO: 948 - DNA, 379 bp, Silene latifolia
gatgcgcgcagctttcattataataaaaataaaaggtttacatgaaattggtggggagccgagagacaatctgggctcccacacccttagcaataataaagctaatacgagtaaaaatgtaagcggctacccgagccccagcatcctgagatgccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgctaacccagtctgagtcaaaggtgaagaacctgtcaagtcaacgcacacatcacg

SEQ ID NO: 949 - DNA, 378 bp, Silene latifolia
gatgcgcgcagctttcattaaaataagaataaaagtttacatgaaattggtggggagccgagaaacaagctgggctcccacacccttagcaacagcaaagctaagtctagtaaaaatgtaagcggccacccgagcccccgcatcctgagatacagagaatttctggatccgcttgagcaaggcaacagcatccgaccccagctccccaagtgaagagaaggagaaaggaaggaaaccataacccgctatcgcgcacaaatccccatacttagcacactttcgctgagcagcatcagcgacaacccgacccggcacaaaatctgccaacccagtctgagtcaaaggtgaagaacctgtcaagtcaacgcacacatcacg

SEQ ID NO: 950 - DNA, 378 bp, Silene latifolia
gatgcgcgcagctttcattaaaagaaaaataaaagtttacatgaaattggtggggagccgagagacaatctgggctcccacacctttagcaacagtaaagctaagtctagtaaaaatataagcagccacccgagcccccgcatcctgtgataccgagaatttctggatccgcttgagcaaggcaacaacatccgagcccagctccccaagcgaagagaaaaagaagggaagaaaaccataaccagatgccgcgcataaatccccgtacttagcacacttccgctgagcagcatcagcgacaacccggccgagcacaaaatccatcatcccagtctgagtcaaaggggaagaccatgtcaagtcaacgcacacatcacg

SEQ ID NO: 951 - DNA, 378 bp, Silene latifolia; identical to SEQ ID NO: 949

SEQ ID NO: 952 - DNA, 381 bp, Silene latifolia; identical to SEQ ID NO: 919

SEQ ID NO: 953 - DNA, 378 bp, Silene latifolia
gatgcgcgcagctttcattaaaataagaataaaagtttacatgaaattggtggggagccgagaaacaagctgggctcccacacccttagcaacagcaaagctaagtctagtaaaaatgtaagcggccacccgagcccccgcatcctgagatacagagagtttctggatccgcttgagcaaggcaacagcatccgaccccagctccccaagtgaagagaaggagaaaggaaggaaaccataacccgctatcgcgcacaaatccccatacttagcacactttcgctgagcagcatcagcgacaacccgacccggcacaaaatctgccaacccagtctgagtcaaaggtgaagaacctgtcaagtcaacgcacacatcacg

SEQ ID NO: 954 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgtaagcggccacccgagtcctcgcatcctgagatacagagaatttctggatccgcttgagtaaggcaacagcatccgaacccaactccccaagtgaagagaaagagaaaggaaggaaaccataacccgttgccgcgcacaaatcgccatacttagcacactttcgcagagcagcatcagcaacaacccggccaggcacaaaattcgtcatcccagtctgagtcaaaggagaagacccggtcaagtcaacgcacacatcacg

SEQ ID NO: 955 - DNA, 378 bp, Silene latifolia
gatgcgcgcagctttcattaaaataagaataaaagtttacatgaaattggtggggagccgagaaacaagctgggctcccacacccttagcaacagcaaagctaagtctagtaaaaatgtaagcggccacccgagcccccgcatcctgagatacagagaatttctggatccgcttgagcaaggcaacagcatccgaccccagctccccaagtgaagagaaggagaaaggaaggaaaccataacccgctatcgcgcacaaatccccatacttagcacactttcgctgagcagcatcagcgacaacccggcccggcacaaaatctgccatcccagtctgagtcaaaggtgaagaacctgtcaagtcaacgcacacatcacg

SEQ ID NO: 956 - DNA, 379 bp, Silene latifolia
gatgcgcgcagctttcattataataaaaataaaaggtttacatgaaattggtggggaaccgagagacaatctgggttcccacacccttagcaatagtaaagctaatacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgccaacccagtctgagtcaaaggtgaagaacctgtcaagtcaacgcacacatcacg

SEQ ID NO: 957 - DNA, 379 bp, Silene latifolia
gatgcgcgcagctttcattataataaaaataaaaggtttacatgagattggtggggagccgagagacaatctgggctcccacacccttagcaataataaagctaatacgagtaaaaatgtaagcggctacccgagccccagcatcctgagatgccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgctaacccagtctgagtcaaaggtgaagaacctgtcaagtcaacgcacacatcacg

SEQ ID NO: 958 - DNA, 378 bp, Silene latifolia
gatgcgcgcagctttcattaaaagaaaaataaaagtttacatgaaattggtggggagtcgagagacaatctgagctcccacacccttagcaacagcaaagctaagtctagtaaaaatgtaagcggccacccgagcccccgcatcctaagataccgagaatttctggatccgcttgaggaaggcaacagcatctgaacccagcttcccaagtgaagagaaagagaaaggaaggaaactataacccgctgccgcgcacaaatccccgtacttagcacacttacgctcagcagcatcagcgacaacccggccaggcacaaaattcgtcatccgagtctgagtcaaaggagaagatcctgtcaagtcaacgcacacatcacg

SEQ ID NO: 959 - DNA, 378 bp, Silene latifolia
gatgcgcgcagctttcattaaaagaaaaataaaagtttacataaaattggtggggagccgagagacaatctgggctcccacacccttagcaacagcaaagccaagtctaataaaaatgtaagcagccacccgagcccccgcatcctgagataccgagaatttctggatccgcttgagcaaggcaacaacatccgaacccagctccccaagtgaagacaaagagaagggaaggaaaccataacccgctgccgcgcacaaatccccgtacttagcacacttacgctaagcagcatcagcgacaacccggccaggcacaaaatccgccatcccagtctgagtcaaaggagaagaccctgtcaagtcaacgcacacatcacg

SEQ ID NO: 960 - DNA, 374 bp, Silene latifolia
gatgcgcgcagctttcattaaaagaaaaataaaagtttacatgaaattggtggggagccgagatacaatctgggctcccacacccttagaaatagcaaagctaagtctagtaaaaatgtaagcggccacccgagcccccgcatcctgagataccgagaatttatggatccgcttgagcaaggcaacagcatccgaacccagctccccaagcgaagagaaacagaaaggaaggaaaccgtaacccgtcaccgcgcacaaatccccatacttagcacgctttcgctgagccagcgacaacccggccaggcacaaaatccgccatccgagtctgagtcaaaggagaagaacctctctaagtcaacgcacacatcacg

SEQ ID NO: 961 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccacccgagcccccgcatcctgagataccgagaatttctcgatccgcttgagcaaggcaacagcattcgaacccagctccccaagtgaagagaaagagaaaggaaggaaaccataacccgctgcttcgcacaaatccccgtacttatcacacttacgctgagcagcatcagcgacaacccggccagacacaaaatccgtcatcccagtctgagtcaaaggagaagaccctgtcaagtcaacgcacacatcacg

SEQ ID NO: 962 - DNA, 377 bp, Silene latifolia
gatgcgcgcagctttcattaactggaaaacaaaagtttacatgaaattggtggggagccgagaaacaagctgggctcccacacccttagcaacagcaaagctaagtctagtaaaaatgtaagcagccacccgagccccgcatcctgagataccgagaatttctggatccgcttgggcaaggcaacatcatccgaacccaactcctcaagtgatgagaaagagacaggaagaaaaccataacccgctaccacgcacaaatccccatacttggcacacttacgctgagcagcatcagcaacaacccggccaggcgcaaaattcgtcatcccagtctgagtcaaaggagaagacccggccaagtcaacgcacacatcacg

SEQ ID NO: 963 - DNA, 378 bp, Silene latifolia
gatgcgcgcagctttcattaaaataagaataaaagtttacatgaaattggtggggagccgagaaacaagctgggctcccacacccttagcaacagcaaagctaagtctagtaaaaatgtaagcggccacccgagcccccgcatcctgagatacagagaatttctggatccgcttgagcaaggcaacagcatccgaccccagctccccaagtgaagagaaggagaaaggagggaaaccataacccgctatcgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 964 - DNA, 378 bp, Silene latifolia
gatgcgcgcagctttcattaaaagaaaaataatagtttacatgaaattggtggggagccgagatacaatctgggctcccacacccttagcaatagcaaagctaagtctagtaaaaatgtaagcggccacccgagcccccgcatcctgagataccgagaatttctgggtccgcttgagcaaggcaacaacatccgaacccagctccccaagtgaagaggaagagaaaggaaggaaaccgtaatccgccaccgcgcacaaatccccatacttagcacactttcgctgagcagcatcagcgacaacctggccaggcacgaaatccgtcatcccagtctgagtcaaaggaaaagaacctgtcaagtcaacgcacacatcacg

SEQ ID NO: 965 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccactcgagccaccgcatcgtgagataccgagaatttctggatccgcttgagcaaagcaacaacatccgaacccaactcctcaagtgaggagaacgagaagggaatgaaaccataaccagctgccgcacacaaatccccgtacttagcacacttacgctgagcagcatcagcgacaactctgctgggcacaaaatccatcatcccagtctaagtcaaaggagaagaccctgtcaagtcaacgcacacatcacg

SEQ ID NO: 966 - DNA, 378 bp, Silene latifolia
gatgcgcgcagctttcattaaaagagaaataaaagtttacatgaaattggtggggagccgagaggcaatctgggctcccacacccttagcaacagcaaagctaagtctagtaaaaatgtaagcggcaacccgagcccctgcatcctgagataccgagaatttctggatccgcttgagcaaggcaacagcatccgaacccagctcccctagtgaagagaaagagaaaggaaggaaaccataacccgctaccgcgcacaaatccccatacttagcacactttcgctgagcagcattagcaacaacccggcccggcacaaaatctgccaacccagtctgagtcaaaggtgaagaacctgtcaagtcaacgcacacatcacg

SEQ ID NO: 967 - DNA, 378 bp, Silene latifolia
gatgcgcgcagctttcattaaaataaggataaaagtttacatgaaattggtggggagccgagaaacaagctgggctcccacacccttagcaacagcaaagctaagtctagtaaaaatgtaagcggccacccgagcccccgcatcctgagatacagagaatttctggatccgcttgagcaaggcaacagcatccgaccccagctccccaagtgaagagaaggagaaaggaaggaaaccataacccgctatcgcgcacaaatccccatacttagcacactttcgctgagcagcatcagcgacaacccgacccggcacaaaatctgccaacccagtctgagtcaaaggtgaagaacctgtcaagtcaacgcacacatcacg

SEQ ID NO: 968 - DNA, 381 bp, Silene latifolia
gatgcgcgcagctttcattaaaagaaaattaaaaaagtttacatgaaaattggtggggagccgagagacaatctgggctcccacacccttagcaacagcaaaactaagtctggtgaaaatataagcggctacccgagcccccgcatcctgagatacagagaatttatggatctgcttgagcaaggcaacaacatccgaacccagctccccaagtgaagagaaagagaagggaaggaaaccataacccgctgtcgcgcacaaatctctatacttagcacactttcgctgagtagcatcagcgacaacccggctaggcacaaaatccgccatcccagtctgagtcaaaggagaggaccctgtcaagtcaacgcacacatcacg

SEQ ID NO: 969 - DNA, 378 bp, Silene latifolia
gatgcgcgcagctttctttaaatgaaaaacaaaagtttacatgaaattggtggggagccgagaaacaagctgggctcccacacccttagcaacagcaaagctaagtctagtaaaaatgtaagcggccacccgagtcctcgcatcctgagatacagagaatttctggatccgcttgagtaaggcaacagcatccgaacccaactccccaagtgaagagaaagagaaaggaaggaaaccataacccgttgccgcgcacaaatcgccatacttagcacactttcgctgagcagcatcagcaacaacccggccaggcacaaaattcgtcatcccagtctgagtcaaaggagaagacccggtcaagtcaacgcacacatcacg

SEQ ID NO: 970 - DNA, 374 bp, Silene latifolia
gatgcgcgcagctttcattaaaagaaaaataaaagtttacatgaaattggtggggagccgagatacaatctgggctcccacacccttagaaatagcaaagctaagtctagtaaaaatgtaagcggccacccgagcccccgcatcctgagataccgagaatttatggatccgcttgagcaaggcaacagcatccgaacccagctccccaagcgaagagaaacagaaaggaaggaaaccgtaacccgtcaccgcgcacaaatccccatacttagcacactttcgctgagccagcgacaacccggccaggcacaaaatccgccatccgagtctgagtcaaaggagaagaacctctctaagtcaacgcacacatcatg

SEQ ID NO: 971 - DNA, 378 bp, Silene latifolia
gatgcgcgcagctttcattaaaataagaataaaagtttacatgaaattggtggggagccgagaaacaagctgggctcccacacccttagcaacagcaaagctaagtctagtaaaaatgtaagcggccacccgagcccccgcatcctgagatacagagaatttctggatccgcttgagcaaggcaacagcatccgaccccagctccccaagtgaagagaaggagaaaggaaggaaaccataacccgctatcgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 972 - DNA, 381 bp, Silene latifolia
gatgcgcgcagctttcattaaaagaaaattaaaaaagtttacatgaaaattggtggggagccgagagacaatctgggctcccacacccttagcaacaacaaaactaagtctggtgaaaatataagcggctacccgagcccccgcatcctgagatacagagaatttatggatctgcttgagcaaggcaacaacattcgaacccagctccccaagtgaagagaaagagaagggaaggaaaccataacccgctgtcgcgcacaaatctctatacttagcacactttcgctgagtagcatcagcgacaacccggctaggcacaaaatccgccatcccagtctgagtcaaaggagaggaccctgtcaagtcaacgcacacatcacg

SEQ ID NO: 973 - DNA, 378 bp, Silene latifolia; identical to SEQ ID NO: 921

SEQ ID NO: 974 - DNA, 378 bp, Silene latifolia
gatgcgcgcagctttcattaaaagaaaaataaaagtttacatgaaattggcggggagccgagacacaatctggacccccacacccttagcaacagcaaagctaagtctagtaaaaatgtaagcggccacccgagcccccgcatcctgagataccgagaatttctggatccgcttgagcaaggcaacagcatccgaacccaactccccaagtgatgagaaagagaagggaaggaaaccataacccacagccgcgcacaaatccccgtacttagcacacttacgctgagcagcatcagcaacaacccggccaggcacaaaattcgtcatcccattctgagtcaaaggagaagacccggtcaagtcaacgcacacatcacg

SEQ ID NO: 975 - DNA, 381 bp, Silene latifolia
gatgcgcgcagctttcattaaaagaaaattaaaaaagtttacatgaaaattggtggggagccgagagacagtctgggctcccacacccttagcaacaacaaaactaagtctggtgaaaatataagcggctacccgagcccccgcatcctgagatacagagaatttatggatctgcttgagcaaggcaacaacatccgaacccagctccccaagtgaagagaaagagaagggaaggaaatcataacccgctgtcgcgcacaaatctctatacttagcacactttcgctgagtagcatcagcgacaacccggctaggcacaaaatccgccatcccagtctgagtcaaaggagaggaccctgtcaagtcaacgcacacatcacg

SEQ ID NO: 976 - DNA, 381 bp, Silene latifolia
gatgcgcgcagctttcattaaaagaaaattaaaaaagtttacatgaaaattggtggggagccgagagacaatctgggctcccacacccttagcaacaacaaaactaagtctggtgaaaatataagcggctacccgagcccccgcatcctgagatacagagaatttatggatctgcttgagcaaggcaacaacatccgaacccagctccccaagtgaagagaaagagaagggaaggacaccataacccgctgtcgcgcacaaatctctatacttagcacactttcgctgagtagcatcagcgacaacccggctaggcacaaaatccgccatcccagtctgagtcaaaggagaggaccctgtcaagtcaacgcacacatcacg

SEQ ID NO: 977 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccactcgagccaccgcatcgtgagataccgagaatttctggatccgcttgagcaaagcaacaacatccgaacccaactcctcaagtgaggagaacgagaagggaatgaaaccataaccagctgccgcacacaaatccccgtacttagcacacttacgctgagcagcatcagcgacaactctgctgggcacaaaatccatcatcccagtctaagtcaaaggagaggaccctgtcaagtcaacgcacacatcacg

SEQ ID NO: 978 - DNA, 378 bp, Silene latifolia
gatgcgcgcagctttcattaaatgaaaaataaaagtttacatgaaattggtggggagccgagatacaatctgggctcccacacccttagcaatagcaaagccaagtctagtaaaaatgtaagcggccactcgagcctccgcatcctgagataccgagaatttctggatccgcttgagcaaggcaatagcatccgaacccagctccccaagtgaagagaaagagaaaggaaggaaaccataacccgccactgcacacaaatccccatacttagcacactttcgctgatcagcatcagcgacaacccggccaggcacaaaatccgtcatcccagtctgagtcaaaggagaagaacctgtcaagtcaacgcacacatcacg

SEQ ID NO: 979 - DNA, 378 bp, Silene latifolia; identical to SEQ ID NO: 965

SEQ ID NO: 980 - DNA, 378 bp, Silene latifolia
gatgcgcgcagctttcattaaaagaaaaataaaagtttacatgaaattggtggggagccaagagacaatctgggctcccacacccttagcaatagcaaagctaagtctagtaaaaatgtaagcggccacccgagcccccgcatcctgagataccgagaatttctggatccgcttgagcaaggcaacagcatccgaacccagctccccaagggaagagaaagagaaaggaaggaaaccataacccgctaccgcgcacaaatccccatacttagcacactttcgctgagcagcatcagcgacaacccggccaggcacaaaatccgtcatcccagtctgagttaaaggagaagaacctgtcaagtcaacgcacacatcacg

SEQ ID NO: 981 - DNA, 378 bp, Silene latifolia
gatgcgcgcagctttcattaaaagaaaaataatagtttacatgaaattggtggggagccgagatacaatctgggctcccacacccttagcaatagcaaagctaagtctagtaaaaatgtaagcggccacccgagcccccgcatcctgagataccgagaatttctggacccgcttgagcaaggcaacaacatccgaacccagctccccaagtgaagagaaagagaaaggaaggaaaccgtaatccgccaccgcgcacaaatccccatacttagcacactttcgctgagcagcatcagcgacaacctggccaggcacaaaatccgtcatcccagtctgagtcaaaggagaagaacctgtcaagtcaacgcacacatcacg

SEQ ID NO: 982 - DNA, 378 bp, Silene latifolia
gatgcgcgcagctttcattaaatgaaaaacaaaagtttacatgaaattggtggggagccgagaaacaagctgggctcccacacccttagcaacagcgaagctaagtctagtaaaaatgtaagcggccacccgagtcctcgcatcctgagatacagagaatttctggatccgcttgagtaaggcaacagcatccgaacccaactccccaagtgaagagaaagagaaaggaaggaaaccataacccgttgccgcgcacaaatcgccatacttagcacactttcgctgagcagcatcagcaacaacccggccaggcacaaaattcgtcatcccagtctgagtcaaaggagaagacccggtcaagtcaacgcacacatcacg

SEQ ID NO: 983 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgtaagcggccacccgagtcctcgcatcctgagatacagagaatttctggatccgcttgagcaaggcaacagcatccgaacccaactccccaagtgaagagaaagagaaaggaaggaaaccataacccgttgccgcgcacaaatcgccatacttagcacactttcgctgagcagcatcagcaacaacccggccaggcacaaaattcgtcatcccagtctgagtcaaaggagaagacccggtcaagtcaacgcacacatcacg

SEQ ID NO: 984 - DNA, 378 bp, Silene latifolia
gatgcgcgcagctttcattaaaagaaaagtaaaagtttacatgaaattggtggggagccgagagacaatctgggctcccacacccttagcaacaacaaagctaagtctagtaaaaatgtaagcggccactcgagccaccgcatcgtgagataccgagaatttctggatccgcttgagcaaagcaacaacatccgaacccaactcctcaagtgaggagaacgagaagggaatgaaaccataaccagctgccgcacacaaatccccgtacttagcacacttacgctgagcagcatcagcgacaactctgctgggcacaaaatccatcatcccagtctaagtcaaaggagaagaccctgtcaagtcaacgcacacatcacg

SEQ ID NO: 985 - DNA, 379 bp, Silene latifolia
gatgcgcgcagctttcattataataaaaataaaaggtttacgtgaaattggtggggagccgagagacaatctgggctcccacacccttagcaataataaagctaatacgagtaaaaatgtaagcggctacccgagccccagcatcctgagatgccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcgcaaaatccgctaacccagtctgagtcaaaggtgaagaacctgtcaagtcaacgcacacatcacg

SEQ ID NO: 986 - DNA, 378 bp, Silene latifolia
gatgcgcgcagctttcattaaaagaaaaataatagtttacatgaaattggtggggagctgagaaacaagctgggctcccacacccttagcaacaacaaagctaagtctagtaaaaatgtaagcggccacccgagatcccgcatcctgagataccgagaatttatggatccgcttgagcaaggcaacaacatccgaacccagctccccaagtgatgagaaagagaagggaaagaaaccataacccgttgccgcgcacaaatccccgtacttagcacactttcgctgagtagcatcagcgacaacccggccaggcacaaaatctgtcatcccagtctgagtcaaaggagaagaccctgtcaagtcaacgcacacatcacg

SEQ ID NO: 987 - DNA, 378 bp, Silene latifolia; identical to SEQ ID NO: 965

SEQ ID NO: 988 - DNA, 379 bp, Silene latifolia
gatgcgcgcagctttcattaaaagaaaaataatagtttacatgaaattcggtggggagccgagatacaatctgggctcccacacccttagcaatagcaaagctaagtctagtaaaaatgtaagcggccacccgagcccccgcatcctgagataccgagaatttctggatccgcttgagcaaggcaacaacatccgaacccagctccccaagtgaagagaaagagaaaggaaggaaaccgtaatccgccaccgcgcacaaatccccatacttagcacactttcgctgagcagcatcagcgacaacctggccaggcacaaaatccgtcatcccagtctgagtcaaaggagaagaacctgtcaagtcaacgcacacatcacg

SEQ ID NO: 989 - DNA, 379 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccactcgagccaccgcatcgtgagataccgagaatttctggatccgcttgagcaaagcaacgacatccgaacccaactcctcaagtgaggagaacgagaagggaatgaaaccataaccagctgccgcacacaaatccccgtacttagcacacttacgctgagcagcatcagcgacaactctgctgggcacaaaatccatcatcccagtctaagtcaaaggagaaagaccctgtcaagtcaacgcacacatcacg

SEQ ID NO: 990 - DNA, 378 bp, Silene latifolia; identical to SEQ ID NO: 921

SEQ ID NO: 991 - DNA, 378 bp, Silene latifolia; identical to SEQ ID NO: 965

SEQ ID NO: 992 - DNA, 374 bp, Silene latifolia; identical to SEQ ID NO: 906

SEQ ID NO: 993 - DNA, 378 bp, Silene latifolia; identical to SEQ ID NO: 965

SEQ ID NO: 994 - DNA, 379 bp, Silene latifolia
gatgcgcgcagctttcattataataaaaataaaaggtttacatgaaattggtggggagccgagagacaatctgggctcccacacccttagcaataataaagctaatacgagtaaaaatgtaagcggctacccgagccccagcatcctgagatgccgagaatttctgggtccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaatccgctaacccagtctgagtcaaaggtgaagaacctgtcaagtcaacgcacacatcacg

SEQ ID NO: 995 - DNA, 378 bp, Silene latifolia; identical to SEQ ID NO: 921

SEQ ID NO: 996 - DNA, 378 bp, Silene latifolia
gatgcgcgcagctttcattaaaataagaataaaagtttacatgaaattggtggggagccgagaaacaagctgggctcccacacccttagcaacagcaaagctaagtctagtaaaaatgtaagcggccacccgagcccccgcatcctgagatacagagaatttccggacccgcttgagcaaggcaacagcatccgaccccagctccccaagtgaagagaaggagaaaggaaggaaaccataacccgctatcgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 997 - DNA, 378 bp, Silene latifolia
gatgcgcgcagctttcattaagataagaataaaagtttacatgaaattggtggggagccgagaaacaagctgggctcccacacccttagcaacagcaaagctaagtccagtaaaaatgtaagcggccacccgagcccccgcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaacctgccaacccagtctgagtcaaaggtgaagaacctgtcaagtcaacgcacacatcacg

SEQ ID NO: 998 - DNA, 378 bp, Silene latifolia
gatgcgcgcagctttcattaaaagaaaaataaaagtttacatgaaattggtggggagccgagaaacaatctgtgctcccacacccttagcaacagcaaagctaagtttagtaaaaatgtaagcggtcacccgagcccccgcatcctgagataccgagaatttctggatccgcttgagcaaggcaacagcatccgaacccaattccccaagtgaagagaaagaggaaggaaggaaaccataacccgttgccgcgcacaaatcgccatacttagcacactttcgctgagcagcatcagcaacaacccggccaggcacaaaattcgtcatcccagtctgagtcaaaggagaagacccggtcaagtcaacgcacacatcacg

SEQ ID NO: 999 - DNA, 378 bp, Silene latifolia
gatgcgcgcagctttcattaaaagaaaaataaaagtttacatgaaattggtagggagccgagagacaatctgggctcccacacccttagcaatagaaaagctaagtctagtaaaaatgtaagcggccacccgagcccccgcatcctgagataccgagaatttctggatccgcttgagtaaggcaacagcatccgaacccagctccccaagtgaagagaaagaggaaggaaggaaaccataacccgctaccgcgcacaaatccccatacttagcacactttcgctgagcagcatcagtgacaacccggccaggcacaaaatccgtcatcccagtgtgagtcaaaggagaagaacatgtcaagtcaacgcacacatcacg

SEQ ID NO: 1000 - DNA, 378 bp, Silene latifolia; identical to SEQ ID NO: 965

SEQ ID NO: 1001 - DNA, 378 bp, Silene latifolia
gatgcgcgcagctttcattgaaataagaataaaagtttacatgaaattggtggggagccgagaaacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcggcatcagcgacaacccggcccggcacaaaacctgccaacccagtctgagtcaaaggtgaagaacctgtcaagtcaacgcacacatcacg

SEQ ID NO: 1002 - DNA, 381 bp, Silene latifolia
gatgcgcgcagctttcattaaaagaaaattaaagaagtttacatgaaaattggtggggagccgagagacaatctgggctcccacacccttagcaacaacaaaactaagtctggtgaaaatataagcggctacccgagcccccgcatcctgagatacagagaatttatggatctgcttgagcaaggcaacaacatccgaacccagctccccaagtgaagagaaagagaagggaaggaaaccataacccgctgtcgcgcacaaatctctatacttagcacactttcgctgagtagcatcagcgacaacccggctaggcacaaaatccgccatcccagtctgagtcaaaggagaggaccctgtcaagtcaacgcacacatcacg

SEQ ID NO: 1003 - DNA, 378 bp, Silene latifolia
gatgcgcgcagctttcattaaaataagaataaaagtttacatgaaattggtggggagccgagaaacaatctgggctcccacacccttagcaatagtaaagctaatacgagtaaaaatgtaagcggctacccgagccccagcatcctgagataccgagaatttctggatccgcttgagcaaggcaacagcatccgaactcaactccccaagtgaagagaaagagaaaggtaggaaaccataacccgctaccgcgcacaaatccccatacttagcacactttcgctgagcagcatcagcgacaacccggcccggcacaaaacctgccaacccagtctgagtcaaaggtgaagaacctgtcaagtcaacgcacacatcacg

SEQ ID NO: 1004 - DNA, 378 bp, Silene latifolia
gatgcgcgcagctttcattaaaagaaaattaaaagtttagatgaaattggtggggagccgagaaacaagctgggctcccacacccttagcaacaacaaagctaagtctagtaaaaatgtaagcggccacccgagatcccgcatcctgagataccgagaatttatggatccgcttgagcaaggcaacaacatccgaacccagctccccaagtgatgagaaagagaagggaaagaaaccataacccgttgccgcgcacaaatccccgtacttagcacacttacgctgaggagcatcagcaacaacccggccaggcacaaaatctgtcatcccagtctgagtcaaaggagaagaccctgtcaagtcaacgcacacatcacg

SEQ ID NO: 1005 - DNA, 378 bp, Silene latifolia
gatgcgcgcagctttcattaaaagaaaaataaaagtttacatgaaattggtggggagtcgagagacaatctgagctcccacacccttagcaacagcaaagctaagtctagtaaaaatgtaagcggccacccgagcccccgcatcctaagataccgagaatttctggatccgcttgaggaaggcgacagcatctgaacccagcttcccaagtgaagagaaagagaaaggaaggaaactataacccgctgccgcgcacaaatccccgtacttagcacacttacgctcagcagcatcagcgacaacccggccaggcacaaaattcgtcatccgagtctgagtcaaaggagaagatcctgtcaagtcaacgcacacatcacg

SEQ ID NO: 1006 - DNA, 378 bp, Silene latifolia
gatgcgcgcagctttcattaaaagaaaaataaaagtttacataaaattggtggggagccgagagacaatctgggctcccacacccttagcaacagcaaagctaagtctaataaaaatgtaagcagccacccgagcccccgcatcctgagataccgagaatttctggatccgcttgagcaaggcaacaacatccgaacccagctccccaagtgaagacaaagagaagggaaggaaaccataacccgctgccgcgcacaaatccccgtacttagcacacttacgctaagcagcatcagcgacaacccggccaggcacaaaatccgccatcccagtcagagtcaaaggagaagaccctgtcaagtcaacgcacacatcacg

SEQ ID NO: 1007 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgtaagcggccacccgagcccccgcatcctgagatacagagaatttctggatccgcttgagcaaggcaacagcatccgaccccagctccccaagtgaagagaaggagaaaggaaggaaaccataacccgctatcgcgcacaaatccccatacttagcacactttcgctgagcagcatcagcgacaacccggcccggcacaaaatctgccaacccagtctgagtcaaaggtgaagaacctgtcaagtcaacgcacacatcacg

SEQ ID NO: 1008 - DNA, 378 bp, Silene latifolia
gatgcgcgcagctttcattaaatgaaaaacaaaagtttacatgaaattggtggggagccgagaaacaagctgggctcccacactcttagcaacagcagagctaagtctagtaaaaatgtaagcggccacccgagtcctcgcatcctgagatacagagaatttctggatccgcttgagtaaggcaacagcatccgaacccaactccccaagtgaagagaaagagaaaggaaggaaaccataacccgttgccgcgcacaaatcgccatacttagcacactttcgctgagcagcatcagcaacaacccggccaggcacaaaattcgtcatcccagtctgagtcaaaggagaagacccggtcaagtcaacgcacacatcacg

SEQ ID NO: 1009 - DNA, 378 bp, Silene latifolia
gatgcgcgcagctttcattaaaagaaaaataaaagtttacatgaaattggtggggagccgagagacaatctgggctcccacacccttagcaacaacaaagctaagtctagtaaaaatgtaagcggccactcgagccaccgcatcgtgagataccgagaatttctggatccgcttgagcaaagcaacaacatccgaacccaactccccaagtgaggagaacgagaagggaatgaaaccataaccagctgccgcacacaaatccccgtacttagcacacttacgctgagcagcatcagcgacaactctgctgggcacaaaatccatcatcccagtctaagtcaaaggagaagaccctgtcaagtcaacgcacacatcacg

SEQ ID NO: 1010 - DNA, 378 bp, Silene latifolia
gatgcgcgcagctttcattaaatgaaaaacaaaagtttacatgaaattggtggggagccgagaaacaagctgggctcccacacccttagcaacagcaaagctaagtctagtaaaaatgtaagcggccacccgagtcctcgcatcctgagatacagaggatttctggatccgcttgagtaaggcaacagcatccgaacccaactccccaagtgaagagaaagagaaaggaaggaaaccataacccattgccgcgcacaaatcgccatacttagcacactttcgctgagcagcatcagcaacaacccggccaggcacaaaatccgtcatcccagtctgagttaaaggagaagaacctgccaagtcaacgcacacatcacg

SEQ ID NO: 1011 - DNA, 359 bp, Silene latifolia
gatgcgcgcagctttcattaaaagaaaaaaaataaaagtttacatgaaattggtgggaagccgagagacaatctgggccctcacacccttagcaacagcaaagctaagtctagtaaaagtataagcggccaaatacggagaatttctggatccgtttgagcaagacaacagcatccgaacccaactcccctagtgaagagaaagaagggaagaaaaccataaccagttgccgcgcataaatccccgtacttagaacacttacgctgagcagcatcagcgacaacccgaccgggcacaaactccatcatcccagtctgagtcaaaggagaagaccatgtcaagtcaacgcacacatcacg

SEQ ID NO: 1012 - DNA, 381 bp, Silene latifolia
gatgcgcgcagctttcattaaaagaaaattaaaaaagtttacatgaaaattggtggggagccgagagacaatctgggctcccacacccttagcaacaacaaaactaagtctggtgaaaatataagcggctacccgagcccccgcatcctgagatacagagaatttatggatctgcttgagcaaggcaacaacatccgaacccagctccccaagtgaagagaaagagaaggggaggaaaccataacccgctgtcgcgcacaaatctctatacttagcacactttcgctgagtagcatcagcgacaacccggctaggcacaaaatccgccatcccagtctgagtcaaaggagaggaccctgtcaagtcaacgcacacatcacg

SEQ ID NO: 1013 - DNA, 378 bp, Silene latifolia
gatgcgcgcagctttcattaaaataagaataaaagtttacatgaaattggtggggagccgagaaacaagctgggctcccacacccttagcaacagcaaagctaagtctagtaaaaatgtaagcggccacccgagcccccgcatcctgagatacagagaatttctggatccgcttgagcaaggcaacagcatccgaccccagctccccaagtgaagagaaggagaaaggaaggaaaccataacccgctatcgcgcacaaatccccatacttagcacactttcgctgagcagcatcagcgacaacccggcccggcacaaaatctgccaacccagtctgagccaaaggtgaagaacctgtcaagtcaacgcacacatcacg

SEQ ID NO: 1014 - DNA, 379 bp, Silene latifolia
gatgcgcgcagctttcattaaaaggaaaaattaaggtttacatgaaattggtggggagccgagagataatctgggctcccacacccttagcaacaacaaagctaagtctagtaaaaatataagcggccacccgagcccccgcatcctgagataccgagaatttctggatccgcttgagcaaggcaacagcatccgagcccagctccccaagtgaagagaaagagaagggaaggaaaccataacccgctgccgcgcacaaatccccgtacttagcacacttacgctgagcagcatcaacgacaacccgactaggcacaaaatccgtcatcccagtctgagtcaaaggagaagaccttgtcaagtcaacgcacacatcacg

SEQ ID NO: 1015 - DNA, 5198 bp, Ciona intestinalis
tcaatcaataaggaggtgttttctttggtctgttgttttatagtttaccgttataatagtctgttgtcctatagttttccgtggtgtatttctggtctactatagttggtgcctctaaaacattattataccgaagagtgctagcgatttctattattaactcacccaccagtactgctgtgcatccacgcagcaccacgcctgccatcacgtacagtgcgcttgctgccttgtgttttgttttgcagacaccactggacgatagatggcgacttcgtcttcctccgtttcatcggggaatgttcagaccgaggtgcgttgcgtctaccacggaaaaggagacttgttgctggaatgcccagttgcccattgccctagcatacaccccacagttgccacaatcacaaaacacttaaaaaaacatcacacacctcaattcgaacagataaccactaaaaatctcacaataacatatacatgcagtcaatgtagtttctccaccaccggtctcacacaacaccacatatccaaacactacaaaacatgcaaaggcgtgggcgctgttcaggaaggcaacaagggtcgattctgctgccctgcatgcggtaccaggtgggctcttttgtgtaaggcacggcaccattttaataatgtccacttcgagtatgacacccctccaattgccgctttctctggcacaccctataaactaaaaaaacggaaatttacaattattaataaggccctaacatattcatgccctctccccctcaaccaactactttgccctttgtggtcgtgctccctcacgatcttaaataaacctctttcaagcgtgcagcaggaaacggcacatggcgacggctcacaaggccagagttatgttccaactcagttgcggcaggtgctcagagcccgttgccactgcggaaaccctccaattggaaagggccactgggcatcttgccaagggaagcgaccactctcttcacctaagggtgggcgcagttcgcccactccacctgctaatctaaccctccacttccttaactatctccccttccaacttccctcacaaagctcctccccccaaagtagcaccctcgaccctacggcctgtaaagctcgagtccccatcccctctttcctacgcggcgactgtgaagtcacctttttcatcatcccctccgttaatttttatagaccctacctctcctaccccctcaggatgttctggcgtaaccgaacatcctccggtcactgttccctacaccgggtcgttcgaggctttgtccgagagcgactcgtcccccatcctcggtcgaaatcgccggcgaggactccccttgaattcctctgcgagttccggctcgcgggggtcttccccgatcctgggaaggtcgcgtcccttcgacccgtaccagctccccttacgctttgcctttctccaccagtcgctggtccaatgatttcctgtgaggaccacagcgcccccccttccgttcgctcgagctcccccattcctaactccccagcctccgtaagctccgtggaggcgcacttgtctgacttgttagacaaagtgtcttccggagaactgcggccgctgtcccccaccctgccttcttcaggcttttttggccctctgttgccacccactccccctccccgacctaccccctcggccgaaaaggcatctccttcaggcctttcctacctaccctgcagagaagtaaaaatcgcgtccattgcacggccatcccctgcctcacagagggtcggctgcgacgcggaccgaacagggccttcgctgaaccctaattatcagcaaacctcccccccgtctactccgagtttctcccccatagttagaccccctaaattcccccggtcgggcgccaaagtaaattccaagtccaaaccccccggcgtccgaccacgccgtgccaagccaattgagccagggaccgagtcggcatcacccgttgatgtcgacactattagtagttcggttcaggaaccttgtactccagaaaacagaaccccggaatttttttatgagcgaaagtggctcgtgagtattttaaatattcacgagcgggagggatccaatttttttcaatttaaccgggatctggagtattggacgcagttgctttcaggctcccagaagggaggacgcgcgaagcgtgcgtcctacaatcgtggtgcggcgaaccaagcgatgaaaaaccgcgattccggccgtaaggatttcgatccccggccggtagcaggccacagtagtggaggtggcaccgagctcggttcgcggccacgataccctaagggcgcacgtcttcgtgccgacttctggagggacatgaaagggacggtccgtaagttacttgatggttcgaacggtgagcgtcgctgcgggattcccctcgatatcatagagcggaaattccggcaagtatccatgcccggctggatagaccacagacggtacgcggccggcgcgtccccgtccctagtaacccaagctgaaacggatgttgccatcaccagtgaggaagttgaggcggtcctcagtggcctaaacgttcagtccgctccgggctcggatggcctctcctatcgattttggaagggcctcgatcctagtggtcgattgttgtcatgccttttcgaaatcgttaggaggcatggtcgtattccgggcgcgtggccgacttgtagcgtcatcctgctctgtaaagatgctcagggtgacgttcaggacgtgggaaactggagaccgatcaccatctgccgcactctgtacaaattgtacgcggctgtgatcgccagacgtattcagacttgggcgaaacagggcggggtgctctcgcggctccagaaagggttcatgccagttgagggtgtgtttgagcacgtcttcatgttggataccgtcctttccgacgccaagctgaggcgcaagaatcttcttgccgtcttccttgacgttcggaatgcgttcggaagcgtccggcatgaatgcttgctcaaagttcttcggcacttcgatgctccccattacctggttgaactcgtgagggatatttacaccggtgcgacctgccgtgttagatcttcggttggtgagaccggtgatataccctgtgatcgaggtgtcaggcagggctatcccctgtctggcattcttttcaacctggtaacggaggtgctaataccggggctcagtgccgggaatgatggctaccggatggcttgcttaggtggtaagctcactcaagtcctggcctacgctgacgatctggtggtagtcacggaaaaccgtgatcagatgctacgtcagctgggtgtgtgtgaggaattcggccgttgggcaggccttgcattcaatcaacggaagtgtggcctgatcggctggaggacgttgcggggagggaggagggtcgcactggaggatcctctgctccttaacggagtagagatccccctgttgcggcccggtgaacactataaataccttggcgccatgactggcgtcatgagtgttccccgcaccggatcccagctgatcaaggacttccgtgcaaggctccaacgactgtttacatcgttcctcacaccacaccagaagctgatcgctctgaaacggtttctgctgccaagtctcagctttcatctgagggttcgtccgattgcgcggtctgagctgatcgcgctcgaccgtcgcgtgcgcgagtgccttagggtggcgtttcgcttgaccaagccctcgtgtcaggctgtgtttcatacaccgactgacatggatggtctgggtgtcccgtcggtatgcagtgagagcagcatactgacgatcgcccaggggttcaaggtgttaacgtcacccgacggcacagtgtccgcgacggcttcggcgcgcgtgaagctctacgccgctaaatttggcggcctcactgaagcaggtccttcggactgggcgcgttatctatctggtgatgacgtcaacgggaatagcactcgcaaacccggcgctaacctgccttctggtctgtggactcgcgtccgctgtgccagcaggcagttaggtgctgtgtggcgcgtttgcccggaaaacggcatcactgtccgggtgcgtaattctgtgattacctcccgagaccgacggaagctcatcagatccttccacgattgctctaatcagcagtggaaggagcagtggatgcagcaccccaaccaggagaagaccgctgcagcgcatatggcttatgccgatgcgaaccgctgggtgaagcagccgtcggttatggaacctcatacatacttttttgcattgagggcgcgcttgaacctgttacccactagggtttcacgagctatttatagcagggaccaacacccggacattttatgccgacgttgtggtgcgtcagttgagtccctcccgcatgtactaaaccattgtcctcccaatatgagcataatactcgggaggcataatttggtactgcaggaggttctgaacgcggtagacaaaacccagttcaaagagatatccgttgaccgaacggtccccgagcacatgtcggagacaggtgaggccttgcggcctgacatagtggcacggcggaatgacggttccgtcgtggtcgtcgacgtggcttgcccgttcgatcaaaaggcgaactttgatgaggcggcaaaacggaagctcctaaagtacgacaagctttgttgcaatatcgctgcctccacaggtaaacctgtggagtgtcattcgatagtcgtgggctccttggggagcctcgcggagggtctgtccacctccctccgggctttgggaataaccgattttgctcgctctaagcttgtcgcttgccatcaagggtagccaaaagatttggtgttcttggcgagctgcagtcccggcagagtaggcgagatcgtgagctctacaccgcttcacgatttgacgagttcttcttgagtcgatccccaacggcaacgcactccaaatttaacgaccgcatggcgacgccactgatctcccagtcatccgtgctccgagggcacttaaggggaaccgattcactgatgctgcaagttggcgggggcgcactcaccaatggaagatgagggagcccaacgatgccccgaactaccgcaccgtccccagcaccgtgtccttgtgagtaatattt

SEQ ID NO: 1016 - protein, 1390 aa, Artificial Sequence
  source: /note="Description of Artificial Sequence: Synthetic polypeptide"
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1017 - protein, 1406 aa, Artificial Sequence
  source: /note="Description of Artificial Sequence: Synthetic polypeptide"
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDSGSETPGTSESATPESCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1018 - protein, 1394 aa, Artificial Sequence
  source: /note="Description of Artificial Sequence: Synthetic polypeptide"
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDGGGSCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1019 - protein, 1406 aa, Artificial Sequence
  source: /note="Description of Artificial Sequence: Synthetic polypeptide"
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRSGSETPGTSESATPESTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1020 - protein, 1394 aa, Artificial Sequence
  source: /note="Description of Artificial Sequence: Synthetic polypeptide"
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRGGGSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1021 - protein, 1406 aa, Artificial Sequence
  source: /note="Description of Artificial Sequence: Synthetic polypeptide"
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAASGSETPGTSESATPESASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1022 - protein, 1394 aa, Artificial Sequence
  source: /note="Description of Artificial Sequence: Synthetic polypeptide"
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAGGGSASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1023 - protein, 16 aa, Artificial Sequence
  source: /note="Description of Artificial Sequence: Synthetic peptide"
SGSETPGTSESATPES

SEQ ID NO: 1024 - protein, 4 aa, Artificial Sequence
  source: /note="Description of Artificial Sequence: Synthetic peptide"
GGGS

SEQ ID NO: 1025 - DNA, 4181 bp, Adineta vaga
gaaatagtttgcaatggtaggtgtatggcgcctctgtgtctctctttcgctggatatagtttgacgattttgtaccaggtatctgtttcttgtgagttcagcaccagtttgaacaggcttagcgatagaccttcgaacttgaaacactgttgtgaagctggctgggcccctgcagattttctcgattagaacgtgagtgttacgtccagaatgacccaccagtggttagttctacgttgccctggaaaggagaaaagttgagctaaaatcgcacggcctagttgtttatcaaataggcacggtgaggaactcttctatgtaccctgactaaagtactcacttgtgcgctgggtttgctccccctcgcattgacttatctgatcgcactacccaccaaacgaaacataaacttagctcgtggtatcagtccacagcgtgtgcagtcggattcaggggagcgtgttagtgacaagcaggataatattaacatagttaatgttaaggcgttcaacattccttatccaattggaagagttgactgtgaagtttgtcatgaagacattggacaaatgaatttgccgattcgagagcatgccgtatctgtacacaatataaacaaatttaattatttatgccagctatgttctaagtcttatgatactattaatagtgttaaagctcactatgttgcatgcagaagacagaagaatgcctcatccacaacagctgttccaaccaatgtcatcaacaacaaccaacttgctataaatactaatcaagtaatatcaagaaatccacttcagtgcgttgagtgtctaatgaaacaagttgatttctatgctaaagatacaaaggcactagtcacgcacatgcgtactaaacatgctgctgcctacgaggaatcaaagaaagtcgcaacaagaagagttgcctggagccctgatgaggatcaaattcttgctgaactagaagtcaaattgaaaaagatacaaaaaggtcaattacttagtcgtcttgtcgttgaatataataaatgtgctgataaatcgaaagctccttccaggtccaaggatgctattcgtacaagacgccaacaacatgattacaaactattgcttcgctcactccaatctcaacaaccgccagttggtagcgaagacagtgacagtgacatatcttctagtaataacaatcctttaacaacaacacataatgtcactccaacgccagattcatccaacgttgtactactaatacaaaagatccgtgaatctgtagattccattgtaaaaataacgaacctcaaattgaacacgaatatgctgaacgcagcaagtgcgttcattaatcaaaataacaacatggatccacttgaactatctatgcgtggtatcgaagaggatgtgaaggcaattcgagacaaagaacttcagaaaccaaccaggaacgttccttcttcaacaacttcgagaaagccaactcgaaatgccaaaaggcttgagaaatcaaaaaaatatggctattatcaacatctgtactataataacaagaaaaaattagtagcggaaatcctcgatggcgaaacaagtggtgctaagccacctccaatgaacctggttgaagattattatagaaatatttggtcacgttctactattgatgattcgcctgttaacaatattaaaaccgttaatagtgactctatatttgctccaatttcgcgtgatgaaatcaaattagcattatcaaatacgaaaaaggattcagcagctggacctgacgctgtaacaataaaagaagcaaaagctattattgacaatctttatgttgcatataatatatggctaggtgttcaaggaattcctgaacaactgaaattgaataaaactatcttaattccaaaaggaaattccgatcttagtctactgaaaaactggcgacctattacaatctcgtctattatcctaagagtatacaacagattattagcatacagaatgaacaagatctttaaaactaatgataaacaagttggattcaaacctgttaatggttgtggtattaatatatcttggcttcactctctcttgaagcatgcacgcttaaacaaaaattcaatatatgcttgtcttgtcgatgtgtctaaagcctttgattctgtgtcacatcaatcaatagtaagagctctcacaatgaatggtgcaccatccttgctagtgaaattaataatggatcaatatacgaatgtaaatactgtcatcacatgttctggttctatatcaaacaagataaatatctccagtggtgtcaagcaaggtgacccactatctagcttgttgttcaatctggttatagatgaactgttcgatgtaataaaggaccaatatggttatacaattgataacattggcaccaccaatgcacgatgcttcgccgatgatttaacactaatatcatcatctagaatgggtatgaataaattgcttgagctcaccacgaaattcttcaaagaacgtggactaaatgtaaacccatcaaagtgcatgtctattggcatgtccaaaggttataaaggaaagaagagtaaaatcgaatctgaaccactcttctctatcaccgatgctcagataccgatgttgggctatattgataagacaactcgatatctcggtgtaaatttcacatctattggtgccattgatgcaaaaagaatcaaaaaagaccttcaggacacactcgataagcttgaacatcttaaactcaaagctcagtgcaaaatggatctcttacgaacttatatgataccaagattcatgtttcaattaattcatactgagttatatccgaaattgcttattaaaatggacatcttaattaggaaattagctaaacgaatcctacatctgcccatatcaacgagtagtgaattcttttacttacccttcaaagaaggaggtcttcaactaacctcacttaaagaagcagttggtttagccaaaataaaattacacaagaagataatgtccagtaatgatccaatgttatgctacttgattgagagccagaggagccgtattgtcgaacattttatgaaagaccttaaacttggagattctttaacattaaacgaaatgaataacatcaaagagtgcttcatgaaagaaaaaagaatctcatttgctcaaaaaattcacggtgtcggcttcgaagtattctcatcaagtcctttgacgaaccaatggattaatggcgaaattaagacaatgacaactaaaacatacattaactcaattaaacttagaacaaatactctagaaactcgggtaacaacatctcggggactgaacatcataaaaacatgtagaagatgccacgtagctgacgaaagtctcatgcatgtgctccaatgttgctcttctaccaaaggtttacgatactctcgtcatcacaaaatatgtgccaaagtagcaaataaattggtaatgaatggttatggtgtatttcgtgagaagagttatccagatccaaacaactcaggttcataccttcgaccggatataattgcagtaaaaaatggtcatgttattgttcttgatgtaacggttgtgtacgaagtaactggtgctacgtttattaatgcctaccaaacaaaaataaataaatataatgcgattatggtacaaatcgagcaaatgttcaattgtgttaatggtgaattgcatggtctagtaattggatcacgtggttcaattcatcacagtcaactccacatctggcatcaaatgggattctcttccatagaacttaaatatgtggctataggatgcatggaggattcgctcagaatcatgtccacattctcaaaagctatcacatgaactagtctccttcttctattagtcagtctaattaatttttcttacattctacatctagttccattattaaattggtatgatcagtgctatctctgctacactcaatgcttaatcgtatgttattgacagtctgacacttgattactcttacgacatatgcactgtttgcttcagagaaaccactgttcatatagtgaagttcctcagttttctgttgatatattcttctttcattctcgcttctccttttctactgtgttctttttatcagttttttgtggaaaaattgagaataaataaagt

(The sequence listing continues in the following parts.)

---

What is claimed is:

1. A composition for modifying DNA, the composition comprising a first engineered RNA and a second engineered RNA, wherein:

(a) the first engineered RNA encodes a polypeptide, wherein the polypeptide comprises (i) a reverse transcriptase domain and (ii) a endonuclease domain, wherein the polypeptide comprises an amino acid sequence according to any of SEQ ID NOs: 1016-1021; and (b) the second engineered RNA comprises a template RNA, wherein the template RNA comprises (i) a sequence according to SEQ ID NO: 1140 that binds the encoded polypeptide and (ii) a heterologous object sequence, wherein (a) and (b) are separate RNAs.

2. The composition of claim 1, wherein the template RNA further comprises a sequence comprising at least 20 nucleotides of at least 80% identity to a target DNA.

3. The composition of claim 2, wherein the target DNA is a genomic safe harbor (GSH) site.

4. The composition of claim 1, wherein the template RNA comprises: (iii) at least 10 bases of identity to a target DNA at the 3' end of the template RNA, and (iv) at least 10 bases of identity to the target DNA at the 5' end of the template RNA.

5. The composition of claim 1, wherein the template RNA comprises: (iii) at least 3 bases of identity to a target DNA at the 3' end of the template RNA, and (iv) at least 3 bases of identity to the target DNA at the 5' end of the template RNA.

6. The composition of claim 1, wherein the sequence that binds the polypeptide comprises one or both of a 3' untranslated region and a 5' untranslated region.

7. The composition of claim 1, wherein the heterologous object sequence encodes an enzyme, a membrane protein, a blood factor, an intracellular protein, an extracellular protein, a structural protein, a signaling protein, a regulatory protein, a transport protein, or a motor protein.

8. The composition of claim 1, wherein the heterologous object sequence comprises a non-coding sequence or a regulatory sequence.

9. The composition of claim 1, wherein the heterologous object sequence encodes a therapeutic polypeptide or fragment thereof.

10. The pharmaceutical composition of claim 8, wherein the regulatory sequence is a promoter.

11. The composition of claim 1, wherein the polypeptide further comprises one or both of a nuclear localization signal and a nucleolar localization signal.

12. The composition of claim 1, which comprises only RNA, or comprises more RNA than DNA by an RNA:DNA ratio of at least 10:1, 20:1, 30:1, 40:1, 50:1, 60:1, 70:1, 80:1, 90:1, or 100:1.

13. The composition of claim 1, which comprises no more than 1%, 0.5%, 0.2%, 0.1%, 0.05%, 0.02%, or 0.01% DNA by mass or by molar amount of nucleic acid.

14. The composition of claim 1, which is capable of modifying DNA in the absence of homologous recombination activity.

15. The composition of claim 1, wherein the template RNA does not encode a reverse transcriptase.

16. The composition of claim 1, wherein the template RNA does not encode an endonuclease.

* * * * *

UNITED STATES PATENT AND TRADEMARK OFFICE

CERTIFICATE OF CORRECTION

PATENT NO. : 12,031,129 B2
APPLICATION NO. : 16/706448
DATED : July 9, 2024
INVENTOR(S) : Jacob Rosenblum Rubens et al.

It is certified that error appears in the above-identified patent and that said Letters Patent is hereby corrected as shown below:

In the Claims

At Column 801, Claim number 1, Line numbers 2-15, delete "A composition for modifying DNA, the composition comprising a first engineered RNA and a second engineered RNA, wherein:

(a) the first engineered RNA encodes a polypeptide, wherein the polypeptide comprises (i) a reverse transcriptase domain and (ii) an endonuclease domain, wherein the polypeptide comprises an amino acid sequence according to any of SEQ ID NOs: 1016-1021; and (b) the second engineered RNA comprises a template RNA, wherein the template RNA comprises (i) a sequence according to SEQ ID NO: 1140 that binds the encoded polypeptide and (ii) a heterologous object sequence, wherein (a) and (b) are separate RNAs." and insert --A composition for modifying DNA, the composition comprising a first engineered RNA and a second engineered RNA, wherein:

(a) the first engineered RNA encodes a polypeptide, wherein the polypeptide comprises (i) a reverse transcriptase domain and (ii) an endonuclease domain, wherein the polypeptide comprises the amino acid sequence according to any of SEQ ID NOs: 1016-1021; and (b) the second engineered RNA comprises a template RNA, wherein the template RNA comprises (i) the sequence according to SEQ ID NO: 1140 that binds the encoded polypeptide and (ii) a heterologous object sequence, wherein (a) and (b) are separate RNAs.--.

At Column 802, Claim number 10, Line numbers 12-13, delete "The pharmaceutical composition of claim 8, wherein the regulatory sequence is a promoter." and insert --The composition of claim 8, wherein the regulatory sequence is a promoter.--.

Signed and Sealed this
Twenty-second Day of October, 2024

Katherine Kelly Vidal

Katherine Kelly Vidal
*Director of the United States Patent and Trademark Office*